United States Patent 12,576,115 (BACTERIAL COMPOSITIONS FOR TREATING AND PREVENTING HALITOSIS) - sequence listing, part 11

SEQ ID NO: 25 - DNA, 2819516 bp, Enterococcus faecium (residues 1-1,409,758 of 2,819,516)
  source 1..2819516: mol_type = genomic DNA
aataaaaaaagcgttagcaactatgcttaaaaagcatatcgactgaataaactaagcattggacaggctgaaagactacatttaaaatgaaatgcgaagaaacaatagaaaataaagttgccttagaaccatagttgaatcacctaacagtcgtgaagggagaataagagaaatggcagaaaaacaaaccgcaggacgagatcaattaggagattttgcaccaaaatttgcagaattgaatgatgatgttttatttggacaagtatggtccagagaagaattatctgctcatcagcgtagtatcatcaccatatctgcattaatttcaggaggaaattttgaacaattgccagctcatctgaagattggcaagcaaaatggcattactagtgaagaaatagcagaaatcattacccatttagctttttatgtaggatggccaaaagcttggtcagcttttagtttagcaaaagaaatctatttagaagaaaatagcgaagataagaaagaggcgtaaatgatgacaaaacacgaagaaatacacaatggcgtgatttttccagcaggtgaaaaaaacgaagcttacgctcaagtatttaccgggcaaagctatctgaatatgttagtgaatgatcccgaagtttctgttggtgtaggtaatgtaacttttgaaccaggttgtcgcaatcactggcatttccatacagacggctatcaaatcttacttgtgaccggaggagaaggctggtatcaggaagaaggaaagccagcaagacgattaatggctggagatgtcgtcgtaacgcacaaagagattaaacattggcatggtgcgacaaaagacagttggtttgaacatttggcgatcactgctggtaattcagagtttttagaacctgtaacagatgaagtgtatgaaggattggaaaatcaataatgtcaagcttgaacagctcctgaaagtagattttaatcgaactttcaggagctgcttttttgattcagtcttttataaatagaaaatagggttaataataggaatgagaagcacgtcgaaagatcttaatattgataatcggctgggcatacatgatttccacgtcatcaatcaaactacctaacagatgataatcttcccgatcatgtcggggattacctaatagttcttgatagtagatttccatactagggtcccgaggattgttcagcaaatcagcaagtacatctaaatcttctggctgagtttctgccgtaccctgtatctctatgaaaagcccttcctcagcaaattctactccaatacgtatttcagttatttcatgggaatataaataagtaagaagctcatcgatgattctttttgataattctttttccaagtgtctttttttcctttctgacagcggtaaagttatctagtatcggtacaaggatacctgcaacgaaaccagttgaaaaaccactgttatatagatttagtcctccgtgcaaagtgctgacgttatggacaagagcaatatgtagcacaccagctattacaccgtaaaaactgccgtaaaaaccgcttatgggcgcgagacctgtcccaaacacagctgcaacaagcatgccagtactggtgatctcatgaaaagttccaaacaaagtagcaataaatattccgactagtatcggaaaactgttttttaaatgacaaccaaaagcactgaaacccaccgcagataaaatagcaccgatgacaggtccatttaactgaccgccaaccagcaaaacataagaagacagcatcagaccaactaagcccatgttgatcaaagtagcaccaataccagaattagcaatgaaatcagttgtcaattttccagatgaatcgaaaatttctcgaatccccgaaagccgaaaggaattataatagaaaccaattccgactgtcagcgaaaaaaagccaaaaataatccaaatgagaggaaagtgatattcattgaaaaccaatgtgttttcgacgattgaatagctgaataacctcaaaacagcagtaaaagtcatcgcaatcaacccagaggtgaatccaatattataaagtgtgaatccacgatggaaaactaaagtttgagcagctaagggcggaagaagtagaccaattgctatgccagctaaattccccaataaaatacctatcagtaaaggaaaacgcataccaaaagtgatataactaacgaccggtgataatgcgctaccaaacagtccgatcatgatgtactgagaaaaaggtttattgacaaatacagcgtatagatacacacctaaaatgattgagatagaattataaaggtttttgccaaaaaaagagaaaccggtaactgttagaatcgaagcaaataagggaccgtttaaaatcaccttgtgccgataagctaaaagcacagaaagtaaggtcaaaatccctacatttatgaatgcgcttccgaaaccgcctaaagcaaaataatctgtcaaaagattgcttggcgaggtaagaatagttagcaatccactccaattatcagtaggagtattagaaagcaagccaataaaaagaaaaaaaacacctgtaaaaccaagataaaaatactttcttttctgtgaaacgattcgtttttgaggatgaatataaataacgtcagtttcgttttccattacacaccttctttttcattttctttaactataacttgaaatgaaagatttggacaactatcatttaggtcaaaactaaaaatgtaagggaacccattgaatttaaccaaatttttttaattttgcaaaaaaaagttaaagaagactgaaaaaaaatttaaaatataacgttttgagtaaaatgtttgcaaaaaatgctaaaaatagggtacaataaaacaacatatactgcagtaaagaagtgggggagttttaatgagaagaaaagtctataccaaggatcaaattctaaaagctgcttatgatgttgttgcaaaggaagggtttaaaggatttactgcgagaaatattgctaaaaagatggggatttcgacacagccgatttatctggaattcaaaaacatggaagatttaaaaaatacgttgctggattctatctttgaacaactaaaagaagatgttttccctattgaacgtactggtgataaaatcattgatctcggtttgaactatatctactttgcaaaaaagcatcatagtctttacatggcattgtacattgatgaacatggggacggaaagaaaatgcatgatttttcatacaattatttccgtgaaatagttaaagaagatgaaagatacaatcaattatcggataaatatgtcgatgctctgcatactggtacatgggtagcagtgactggcttagcgtcattgatgtcatcaaacatcatgcatccaacagaagaacaaatcattgcactgatcaaacggacaattgactcgattttagcattagataatcctgaaataatcagatagtgttctatcagtatgaatttgatcggtaagtccgttggctgcaaactgtcaatggacttttttgctaaaaaaagcgatttctgttatttatctattagaaataggcttgacatttcgtggaaaaagtttaaaaatagtacttacggaaggttggcagagtggtaatgcaccggactcgaaatccggcgaaccggctaataccggcgcgcaggttcaaatcctgtaccttccttatatatcaacgattagacacgatttcgatcgtgtcttttttgttgtatgtttagcccaaaatattttttgactccccttttgactccccctgagtactattcttcataaatgctacaaaattattgatgacttttttgttttgagtttcagttacatgagtgtaaatatttgaagtagtttgaatgtctgcatgccctaaacgttcctgaacatcttttaaagaagctcctgattcaaaaaggagagaggcatgagtatgtcgaaaaccatgagtagtgattcttttagtcaattctggatgatgcttatatatgacattaagccacgaacgtgaaactgtagggttatagagaagaccatcatggtgaaaaattaagttttcgctttggattgtaacgatcgttttgttttttatataatactttctcaataaactgatcaaatcattgtccagataaatttttctttttccagattttgatttaggagtatttacgatcaatctcccttgataacctcttgttacagttttattaatattgagtgttttgctcttaaaatcaatatccgaccaggtcagtgcaaaagcttctccttttcttatacctgtaaaagccaatagggaaaagaataaatatctttcatcatcatcgtttcttattgcttctaaaaattcgattaattcttctttagtataaaattcgatatttttatcttcgatatctagagcttctccacgtggaatagaaactaatttcataggattgctagttataatttgtaaagaagcagcgtaatcaaaaacattagatgtgtaattttttattttcttaaaaattttaggatggctatcggaccaagtgtttactgcttcttgacagaaaaaaacgtctattttgtcaatgaacttatctccaaacacttttaagatgtgtgtgtcaaaaatttgtttggtggaggaccaagtgctttctttaactgtctttttataattttcaaaccataagccgtaaacatattcgaatttcttgctcttttgagctgtagaagcttgcagtcctttttcctgtatatctgtctccaatctttttaaagctctctcagcggctaatggcgtactaaaacctcgtctcgttgtttttcttttttttcctgttagcggatcaactcctaagtacagactaaactgatatttttcttcgcctttttttgttaagtgctttttaattcgtttatcaatttctttttttgccatcttttatctttcctttcgtacgtttgttcggttgtacagcggatttcgagatggtaaaatagggtacaacaaatagacctactttaccgtagctctttgcacatttgcgttcttggtcgggcggtaaatgtgctttttttattgatcgctttctaatggtgtatctacacctttattaggatctagattgctatatagatataggacggtataattagttgcatcttttttcgaataaatcaaagaaaagttgtattttttgtcttgccaagtaaaatctccagtaccattgtagacatttttgtactcttcaccagtttctgcatttttatcgtcaggaaattgagtaactttgatagattttaaatccatcttcaaattatctattgaatatatttctttaatgtgtttctcggcaatagttgcaaactcagcggtttgatcagagtctacttctttgatagtactgtttgtctcactataattttttgattcctttgtttcagctgttgatgttccacatcctcccataactgtcactactagtaatccaataattccaaatttaataaatttcattttctactccttatctctatgatattattttattggggaatcttagaaataaggtttcgagtccgtgttgctgcacgggctttttttatttaaataagtcccaaaagctaaacgtagtctttttataaactttattgtatgcagctttttttgggtctttaatccatccagagcctttctttccataaccaggaatcacagcttttttcacagctctttttgcctttccagtagttctagcaccgatagatttctttatgctcggttttctcattccaattttcattttataccctctcaaattaattatagttggacaatatatacaacgactttcccataaatttgaacgtatttagtatcatcataattaaccacaatatcagtgaaagaaatgttagaagaatcaggtctaaaaatgatgcgattattttgttgatcatttatatatctttttacagaaaattcgttatcgttgctaaagactactatatctccatcttttaactcatcacagctctctattttctttacagcaattaatgatccatcaggaataacgttattcatggaatctccatttattttagtaaaaaatacatcttgatatcctgcatattttcccatggcataatcaggaatagcaatttgctcaatatggtcttgatcaaaagcttcgactgaagaaggtatgccggcagcaacagaagtgtcaaaaaagttatattcttgaatatcacttgatagaactgtcataatgtttcctctatcagttttagttctgttcaaagtcatccctgctgcatttgctttttctgctaactctacaaatttatcagcaacgaaacttttattgttttcctgtaattcatctaaaacttctttctttaaatcataataattgtattctctggaatatcttggatctatatcagatttatcaacattaaaagctttagctattaattcagcgttttccatactgatagttgatttttcagtaaaatatcccgatagcgtcgtaacaggaatacctgtcatatctgacaattgtgctcttgtgtagccatgcgtaattttttttaaattgttagcgataatggagcgagcttttttatcttcttctgataatggttttcttggcatgttattttctcctccttttttattaataatatcgaattaaatcaatataaacaagtataaagtagttttataacagtgttttttaatttaaaaaacgtcaaaaatcgttgactggtagtataaactagtataaaataatttacataaacgaaggaggaataaaaatggaattacaaattactttggaagcagctagagttatgatgggatattctttaaaagaagcagcaaaactctttgatgttcaccatcaaaccttagcaaattgggaacaagatccgaataaaatgaagcaaaaatatgtgcaattaataccagaaatataccattttccaacagcaaatattttttttggaagcaaagacgagtttatacgatataaacttcataacgattcatttttaataaaataacttatggaaaacatatttattcatttttaaggagtgtaatccatgaaagaactaattaaagtaacaacaaatgaggagaatgagcagttagtaaacggcagagaattgcatgagtttttggaggtggcaacagaatacaaaaaatggtttagtcgtatggcggaatatggttttgttgaaaatatagatttcgtaagggtgacccaaaaatgtccgacccctggaggaattcagaatattaccgaccatgcaatgaaattggacatggcaaaagaaatctcaatgattcaacgaacagaaaaaggaaaacaagcgcgtcaatattttattgaagtagaaaaagaatacaaacaacaattacttgatacttcaaagctaagtccagaacttcaaatgttccaaggaatatttaacgcagtagctaagcaagagttagagacaaaacgtctagcaacacaaatggagaatattactgaaattgtggcattgaatacaactgactggcgtagagaatgtcgaaagctcgtaaataaaatggcggaaactcaaggcggatacggtgcttatcaagaaattcaaacagcgatatatgaagaagttgatcgtagagctggctcctctctcaaaactagattaaccaatttacgtaaccgtatggctggcgaaggtgttccaaaatccaagcgagataagacaaataagttagatgtaatcgaaagcgataaaaggttaaaagaaatttatctatctgtagtcaaggatttcgctattaagtatggagtttggaaagaaaaataaaattcgataggaggcaagtcatgaatattctaagcgaagagtttctgactcgtttgagaattgcaattgttgaagttgtgaaggacgcacttaatcagctttcaaaaaagaatctttcagaaacacgatatttgaaaaaaatcgaagctagaaagtatgtgggaggtgtaaatgatcaaggctttgagaagctagtagatcatgggttaaaagaaattcgtatagatggctttttaaggtatgacaaaaaagacatcgatgaactgatggctaaatacaaaatctaaaaggaggacatacatgacagagatcaccatcacagacggacatatgtctcataccgtgaaaacaaaagaagaggcacaacgtattattgatcgatattttccggaaggggagtcaactatgcaaataagaaaaccaatcgttgagcgctcgagtagcaaaatgctgctcgcaacacttgccgaacacaaaaagccagtatacaaagctcgtcagctgcaagcactttgctatatcagcttagttctaaacgtcattttattgtctgttgtctttgccgttttataaaaaaaggaggttagaaaattgtcgtacaacaaatggacaagagaagaggagcaacttcttattcaaaatgtcagatacgaccatcgcggatttgtttgtaattgtaatgaattagctgagttacttgggatagataaaaagcgtatttggcccaaaatccatcaaatgcgtaaaaaagatttgatcgatgaagtttattgggatgatccaatcgaaccgcctaacaaacgttacagtcagcaagaagataaaaaaataatttctatgtatcagtcaggttgtccagtaacaataatagcgcaggaattgaatagaactgagaacgcgattcgctgtcgtcttaatatcatgaagaaaaatggacaattagaaagcaatcgaaaacgcaggtacacaaaaagagaagttgagttattaatatcagaaattaaattcgataaaaatggttacgtattaaatattgattatttaactagactactgcatagaccaaagcacgagcttttcagaaaaatttgtctattaaggaaacaaggagaaataactataaaacccgatcgtacaaaggctagtcagaactggtatgacgtaatgaaaaaacaaattgataatcatcacaaactgatagctgctcgatatagctatcaaaaaaagacacgaccgccggcaagcaaaatcgtgtcatgaaaaatactaattacaaggagagtttatcacaatgaatgaaaaaatccaaaatttaattaaagagttagcagctgaatgtgcgaatgatgatctaggaatgtcagttagtgtagtcgatgaaaaaggggaagtcgctcttggacaagctggaaacgatagcttggttgcgtggagtgtttaccaacagtatgagaaaacaaaacgtgatttgcagaataataaatgcaattgtgaaactcacggtactttaaaacaattgtttggtattgaatatgaagatccagagtttgaggaatggtatcaggactttctacggtttgccgaaaaaatagatcgcaagaaaggtggtataaaattctgatgatctcagtcaaagggttaggcgatgaaatattcgaagcaatgatgcacaaagcacaacaagatgtacaagaaaagattttgactgctgctagttatggtcaaacgagttgcacgattcgctcaaaagggctaacaccttcatttttagcggcattggaaacagaaggcgtatctagcattgaacaagacaatgacacattaaaactattttgggaattttaggaggctgtgatgaaagactttgattctttaggcgcaagacagcaaccaccaaatgaagctagtcctgttggagtcgattggcaaggaaattctttgtatcaaggcgattcttgctatttaacagaagaaggctatgtgccagtagacgacattctagagtatgcgcaacaacattatccaaaaattgaattaggaggaatttagaaatggcaaatgatttaacacaaacaacacaacgttcattagacgagcaggtgatcagtaatcttgggcggttacaagaacaaggcttagaaatgccaccaggatatagtccacaaaatgcgttaaaaagtgcttttttcgaactcactaacaatacaggaggaaatttgttgcagatggctgcaaacaatcaagaaatgaaaacctccatttctaatgcacttttagacatggttattcaagggttatctccagcaaaaaaacaatgctatttcattaaatacggaaacaaggttcagctaatgcgttcatattttggaacaatggcggtccttgatcgtgtaactggaggggcagatattacgcctgtagtcgttcgacaaggtgatgagtttgaagttgcaatggatggaccgaacatggttgtcaaaaagcatgaaacaaaattcgagaatttagacaatgaaatcattgcagcctatgtagttatcaagttagcgaatggtaaagagaccacaacagtcatgacgaaaaagcaaatcgatcagagttgggcgaagtcaaaaatgaaaggttctggaccacaaaaggaatttccagaagaaatggctaaacggacagtaatcaatcgtgcagctaaaacattgatcaacacaagcaacgacaacgatttattagttcaagctgcaaaagatacgttagaaaatgaatttgacaatgatcggaaagatgtaacgccacaaacagaaaaagtggctactctcgaacaaaaattcttttcaaacaaaaagattactgaaccaatacaaaaagaaccagatccgattgtgattccagatgatatccaagatgaagtaactcgagttgctgacgtacctggccattcagaaatagaacaagcacatttaatcgaaaatgaggataccgatccgattcaagaagaattattagatattccggactttggacgtgaggaaggtgtagacgatgtctcagaatttgaagacgatgagtaccctttctgatgaaaattattactccaatgaagctgactggcagtacatgtcgacatcacaatataagtcctttttaaaatgtgaagccgcagccttagcaaagttgaaaggcgattggtcaccgacgtcggatcccaaagccttactcgtcggaaactacgtacattcttattttgaatcaaaagaagtacatgaagcgttcaaagaagaaaataaatccagaatgttttctagtaggaagccgtatggattgttgaaagatttccaaattgctgaacaaatgattgaacgacttaaacaagaagaagtgttcatgaacatctatcaaggtgagaaagaaatgattgtgactggggaactatttggaacgacatggaaaggcaagattgattgcttgaatgttgaggatgagtattttgttgatatcaaaacaacaaaagacatgcatgaacggaaatggaacgaaaactatggatcaagagaaacgttcattgtcaattttggttacgtgcttcagatggcgatttaccagaaattacttttccaacaatacggaaaaagttttatgccgatcatcgctgcagtgtccaagcagacaccaagtgaagcaagactgatcacgattgaccaggacaatatggattatgagctggttatgttaaaagaaaaaatcgaaagaattgtcagagtgaagaacggagaagagaagccgaaccattgcggtttatgtgagtactgcagaggtaatcttccaattactggattcactagcatggacgatttatagaacggtggtgattatatggctgaaggatgggtcaagcttcaccgttctataactgaaaattggatatgggacaatccgcaatatctaaagtggtggcttgatttaattctaatggccaaccacaaagaaaagaaaattctttttaatggttcatttaaaaaagttgatgttgggcaaagaattacttcagaacaaaaattggctgaacgttggggagtaagtagaaatactgtcagaaaatttttaagtctacttgttgaagatgacatgataagcattgaaaaaagcaggaaaaatggaacaacgtataaagtcaataactacgccatttatcaagggttttcggaagaaaaaaaacaacagactgaacaacgagctgaacatcaaaaggacaacgaactgaacataaacaagaatgaaaagaatgagaagaatgataagaataataataatcttcgcaactctcgaaaaaaacgagagtatgcagatgacgatccaaataaaaaattggccattcttttattaaaactcattcgaaaaaatcaaaacatcaaagaacctgatttggacaactgggcgaatacgattcgtttaacaattgaatctgacaaacgaactggtagagaagttcaagacatgattgtgtgggccactagtaatgatttctggtctggagtgattttatcaccgactagcttaagaaagcatttcgataaaatggctatccaaaaaaataaaagaaagcaacaaaatatttctaatgatgagttaccagaaacaggtgaggattggtaatgaataaaaaactaagtgcaatggctgcaccttacggcggattaaaaacagcagatcataattgcccgaaatgtggtgatccattgtatatctggaaaacaaaaaataaagatggtactgatcgctgtggtcccacatgcatcaataagatttgtggttatcgagaaatggtgactaaaaatcaaaaagaagctatcaaaaaagcgaatgaagctagaaagaaagacgcgattaatcgaatgcttaatagctcaatgattacagatgatgcaatatgggccttcgattttgatggatacaaagtagttgatcaggaaacagcgcaaataaaagcgatggctcaagaatgggctaaaaaaattgtaaatggtagcacgattcatgcagtgataaccggtagaacaggagccggaaaaactcatctaggcgctgcagtgattaaagaagtcatgagggcatctaattataaaattgcttgttcatttatcagttatcgagaacttttagaacagttgaaatttgcaatgaatgatccagaagcaagaaaagctgtgacaggttcacttatggctgagataaagaaatctgatttcgtggtaatcgacgatctaggtgcggagctaggaagaatggaagaaaacaatcaagcaacgccatacgatgtcgatgttctcacatcactcacagaagctcgtctaaacaaagctacgatattcacgaccaatttatcatcaaagcaattaaaacacgcatacggcgagcgagtgttttctcgtgtaatgaatgggacaaaaggaaacatagccgtattcaaaacaacgacagacaaaaggaggaatccagtttgacctttgtagtgaaaaaaatgtgctacttagatagccgagggcgaggagaagccagtgtcgagtttgctaaacaccacacgactaaagaagaggctgaccttgttgcaagtgtttgtggcggcgaagtagtcgaagttattaaacccaaaagacgattttcaaaacctaagacaaagccagtgaaaaaagagtgttgttgtccgaaaagtaaccaagcatggatgagaggtgcaaaatgacttgtttaaaatgcaacgatgaaacagttatttggtataagacatcgcttggatggtcaacttgtgaaccttgtccaatatgcaatgaaaatggacgacgttcgaaagaacgactcgaaagactaaagaaggagtatagcaaatggcaacaagaagcaaatacggaaacaaaaagcacgaagtagacggcatcacttttgattctaaagcagaagctcgttattacatgaagttaaaacgaaacggtatgagttttatgcctttatctgaaacctactgtgccatgcaagaaaatgttctgctgcaagaagggtatctatgcaacgatcgtaagattgcaccgatttattaccgagctgattttgtgatttatgagaatggccaagtgaaaaaagtgattgatgtcaaaggttatcaagatgcgatctctatgctgaaaatgaagatgtttgctcatcgatacggctttccagtgacatttgctaagttcgattcaaaaatcaataaattcattgaaatggattgttttgaatcagcaagacagcagcggaaaagacaaacggaacgaagaaaaaagaaattaatggagggaaaataaaatgacaaaacaagtgaatttcagaccagaattaaagaaagtaacatcaaaatcaaatgggaacacagaagtattactagttgttagcaacggatcattgagaggtagcactgaaaatctaactgagtttcttggatcaacagtgactgtagtaattcaaccagaaacaatcgaatacacagtgccagtaaacaaacaaacgaagaaaccaaatattgaatacgttgtgaattcagatggcacaatcgaaatgctcaaagaagaacagacttcacttgatgtcggcgatggtgtagaagaagttgaaaatgtaacaatcttagtatcgaaagaaactgttgatgattttattaaaacagcaacgacattacaactaccagaaaatgtcaccgtaaatattcgagacgttcttatccgtttagatgaaggcgatagtatgagtgaaattgctgcagatcatgaattatcagagactgctttaattgatcaaatcgaactagctagacaatactttgctccatatgcagatagctggtccaaacataaggaagacatcatttttccagaggaacaatgagatcaactgatccagtaattatccttgaggaagccaaatttatttggactcacgaagagatagagcaagcacgcttgctcttttctcaaggagttaagccgagcaaagtagctgaaataatggatcaaaagattcttgatgtcggattacttttgctccatttagcagaaaaaaatctaatttgaggtggaaatgatgattcaacttgcaggcatccaaacagggaaaatttatttttccggtgaaagcaaaagtgaagcaagtcaatggttgcttaaaacatatacgaataataagaagctaagaaaaaaatatcctgatgcgttgctaaaggatgatcagattatgccggaaccaatgatttttaccaaatgggataaataaaaaaagaatatcgcgtaacgaataatagttgctcggctaaatagttagaaatgttaaaaaaagcaaaaaagccgacgtgtaaggtcggctgggaaacaattattgtctattttctagcctcattaatcagaccttgaattctttcgtggccatttaataaaccgcttgctgcttcaaagaaatctactaaacgcttaaattctatatcactccattgatggctgtggttggttcgtacattatttaagaattctgtattaaattcagtgaactgatgtaatatgttgtcaaattcttgacgaccaccaagaagttcatcgttaagagcaataaaggtgtaggcatttgtgaagctggcgtgagcctgatttaaatacgttaaggcgcacattaagtctttttgcttatcaaattctttttcatcatctagctcgcttttaaataaaagtttatgtgaatagtttgcgttatcaaaaccatcaattaataaatttgataaaatctgttttttttgttcaaaattttcaatttccattattatcacctcgatttaatttacaagtaaaataccttgtgaagatattatatcaaataaaaaagctgatttagggggtcttacaaaaatactaaaattttttcaaagagatgattcaaagcgaacaataaaatttggccatctcttgttaaacagtaaaaatcgaacgatatatattccagaaaggatgtttgtatgggaaaaacaaaatcgaaaatcaagaagaaaaaacgtcgtttggaacaaaaggcaatccagaatggaacggctaagaaaaaataaaaaaagccacctctttcgagatagcagcgcaatactattttatcatataaggggtggcgtttgtgagatttcagtggttaaaagattaccaagaacttgatgagcagattctttacttaaagtggaatcttaataaaagtaagcttgaattgaatcgatgggtcaatggagatttagcagacgtccgcatcgaaaaaaactctagatcagcttctttagaagaaaacatcaaaaagatagaaaatgaattgagactattaaatgatcaaaaggaagaaatgctattactaatagatagcttttctggtattgataatcaaatcataaagatgaaatatattgacggaatgaagctggaagacatcgcagaggaaatcgactacgctccatcgtatgttagacagcgacatgcagaaataagaaaaactctgaattttatagacgagtatgagcaaagacgtgctgatcgatgtaaaaaagaaagtgaaatcgagttttacaatagcgagaagtacaaagaacagctgtctttattctaaaattacaatgttcactaaatgttcgaacattgtagctatgtaaacattgtttgcagcatgatattctattagtgtcaaaaaaatatgaaagagccaagatatcccaactattttattaattggtatctgtggctcttttctattgctttgattagacagcaataaacaaaaataaactaaaaggaaatggaaaagtttcttttaaattttcgtgtttatctattctatcaatggctactgtttattattgttttacaatgagcaaaatgaattgtttaaatggtataattcatttatgaaaaggaggctattcataaatgataaaagaaaaccaaaaaatacgatatgccattttaaaagaaattgaaaatggaaattacgaaaatcttgattttggtatattgggaatttcagaagaacaatttaatgaccagttaaattttttgaaaaatgaaagttacattgttggtggaacttacggtagcaatgttttattacctgctacttatagatttttaaaactgactgaaaaaggcgaaatttttttagcagagaactcaacattttctaaaacatataaaatggcaaaagaaattagagattggataaaataggtgtgagaagtctgatgtatatcaggcttctcttcttttattttgaaaggagttttatctatgaatgattttcatgaggctgtacttacttttgatgttccagcgggtatggggcaagtttataaaaaagcgattgaagatgacaacagtagacattggattaaaaatgaaataaaagatgccaatggaaatattgtgattagcgatatcaagccaagctggaatggcaaccactgtagtgtcagtattgataatagcctgactattgaaaaatattctggagcaatagttgatcgaacagaacgcaaaactcagctgaccatagcattgatctctaggaccttacctaacttaaaagaacaggttgaatggtatgagcgaatgggtgcaaaagtaattagcacaaattacaaaggagagaatcaaaatggtaatgatcaaaattagaacatccatcacaggaacagagtattgggattcagaaaagaaaaagactgtcgtagttccaaaaggtcaagaacctgattttgaagtaacggaagaaaaaggaatcttaagtgatggtaaaacgtttgtggcggttaatggtgaacttattactgatagcagtgaaattcttgatagcgatggaaacaccgctgctgattttgatggagacgaagctactaatgatcagtccgctgaagaaacggatgaactggacaacatgactgcaaaagaattgcgtgcatatgctaagaaacatggtattgatattcctggtgctgtccgtgcaaaaggagacatcatccatcttattcgtgaagcagaatgaagtactgtcagtttgacggatgcacgaacaagatagcaaagggtatctactgtactgaacacaagagatcaagcagatcacgcaagaagaagcagcaagcaaagtctgtttatcatcatgagaacaaaccattctatcgaacgcaagcatggaaagatatgcgccaatttatttacgaaagagaaggtggccactgtcagcgatgtggtcagttcatctttggaaagagggcacacgtccatcacattgtaccaatcaaagacaatgaactgcttaagcttgatccaaacaatctcatgcttttatgttcaaaatgtcatccaattgttgaaaatgaaacggaagataagaaagttttcccttcgtatttcaattgaagcccccctatccattttaaaaattttttcgcgtggggagatagggtagcggggagtcacgcgcatcgttaggtcaaatttttcaaaaaacaaaggggggtgtatacaagtatgacgactaaagcgcaacgtaaagcgattgttgatgaaaaagtaagtgctgaaaaagctcgtattttaaaaataatgaatttgtctgatttgtacaccatcactcttgatccattaatcgaatcatatttggatatttttgaaatttaccaacacaaatatcttttgtggaaggaaaaaggctttccggagacgcaaaaattcacgaataaatcaggtgccactaatcaatcgaagcatccattggcgcagcaagtagaaacttggtcagataagaaaatgaaagctctagatttgttggggctaacgaataaggctaaaactggtagacaaataactggcggatcgactgcaagaaaagatgaagaaattacacgtccagaagaaaagccagtagatgaactagcagcgcacagaaacaaatggcgtaagaaggcaggtgctgaaaaatgatcgaacctggtgtaaattatgccgatttatttgcaaaagaagtaagaaagaaacctgggaaatatcctaaaactgttcgtttggcagtggatcgttggtatcggtggaaaaaacgtaaagatatttggtttgatgtagatcgtgcgaatgaaatgatggactgggttgagtcgtttattgttcacacaaaaggtgagatggttggaaagccattcattttagaaccttgggaaaaatttatttactcgtggatgtatggatgggttaaagaaaatgaaaaagggcaaattgtccgcgttactcgagaggcttatgtccaaattccaaaaaagaatggtaaaacattgattgctgtcggttcattaggatatgcaatgtacggagaaggtgctttatcagttgactgctatgcatgcgcttctgattttgctcaagcacaatatgctgccaaaccttttgcagttacaatcttaaataatccaatactacttgaaggaacaaaaatatttagaggaccaaaaggaactgtttctagtattacttatgactatattcatgaagatatggcttactcgaataaatttattgttcaaacgaagaatattgataatatcgagggatcgaatccttattttgtgttgaatgatgaattgcataagcaagagaagatggaacagtatgacaattttaaatctgctcaaatctctttaccacaaccattgatgtttaatatttcaactgctgggaaaggttcatcgtctgttggaatgcgcgtatatcgtgaagcaaaagaagtgttgaaacgtgatgataatgattcgaacttcgttctaatctatgaaccaaataaaaactatgattggacggatagaaaagtttgggaaatgtgcaatcctaactggggaatatcagtcgatctttccgctttagagtccgcatttaaaacagcacaacggtcagcccattcaaaagccgaatttctaacgaagcacttggatgtatttgtaaacggcgcggataatttctttgaacgggatcaagtagagccatgtttagttaccacacaagaacttggtgatttaagtggcgaaccatgttatatcggtttagacttatcacgaacaaaagatttaacctgtgtatcgctgaattttccaacgtgggatgaagatggcaaagcaattctgaaagtgaaacagctttattttattccaaatgaaaatttagactttcgcgaaaaagaagataacgttccatatcgtgaattatccgaacaaggatttgttgaattctgcgacggaaaacaaattgatcaagaacaaattttacaatatatcgaggactgcatggatttatacgatattcaacagataaactatgatccagcgatgagcgaaaagctagttgaaaaatttgaaaatcttggacttgaatgtgtagaagtttcgcagtatccaagagtgttaaattcaccgcttgatgatgtcgaacggttgttttatgagaaacgaattcaatttgataatccattgttcctttattgcaccttgaacgttgtagcaatcactaacatcaacggacaaaaagcgccaagtaaacgtcaatcaaagaaaaagattgatggtttcgtggcgtttttgtgtggtcataaggaaacgatgaatcagatgacagatattgattcggatgaattagatgattaccttagttccatctatagataaatagaaaggcggtgagaaatattgaaattacgtgatcggttatcgaatgcagtctattcctttatggaaaagcgtgggtacatcgaggatatgtttggccactatacgcgttacggtcaaagatatgtaacagattcctctatcatggaatcttctgatgtttatgaattggtccaggatatctcaaaccaggtagcgttgtcctcacctgttgtcataggtccagacggtaatgaagtgaaggaccaccacttgctaaaaattttgaagaatcccaatgattatttgaccggattcgaatttaccaaattggaaacaaataccctactgatcaatggtgagacattcccattaacagatcgggaccagcttcatttggcatacggtgtaaccactaaaattaatgaacgacttcaagaagaatttgaaatgaatggacaaaaaatacctggtcaaatgattcgacatattaagaacatcggaactgattcattaaaaggtgctggaataattgaccttgcaagaaacactctggaaggcgttctgagcgctgaaaaagttttgacggacaaatatactaaaggtggtttactcgcgttcatgcttaaactggacgcccacatcaatccaaataatagcgcccaaacgaaaattgtcaaagctatattggatcaactggaaggaacgcaaaatgacagtgatcattctgttaagatgattcctctgggaaaaggatattccatcgagacgttaaaaagtcctgttgatgacgcggctattttgaactatttaggtgtttataaaaaagacttaggtaaatttttaggaatcaatgttgatacgtatcaatcgttgatgaaaacagacattgaaaaagcgatgatgtatctgcataacaaagcaatcaaaccaatattgaagaacaagagcgaacattacaccgctcttttttttatgccaaattctggctatcgggtggaatggaaaatcaacatcttggattttgttccttactcaacaaaaacaaatattggctacaacattgttcgtactgggattacaagtccagataatgtggcagaaatgcttggttttcctaaacagaacactccagaaacacaagctatctatatttcaaatgacttgtctaggattggccagaaaaatgcaacagatgattccttaccaacgaatgatcaaaacttgaaaggaggtgatggaaatgaagaagaaggaaattcgcacgattgacatcaccaacctttcaacgcgttctgatgaagaaactcatacgaggaccattagtggatatgctgctgtattcaatagcccaacactattatgggacgatttgagtgaagtcattgcaccaggcgcttttgctagaacgattagtaactccgatgtacgttgcttatttaaccacgattggtctaatgtactagggcgaaccaaaagcggaacccttcgattgtcagaagacgatcatggtttgaaattcgaagtcgatttgccagacacaacggtagcaagagacttggttaaatctatggaacgcggagacattaatcaatgtagttttggatttgtaccaactgaagaaacatgggactacaattcagaacctatgcttcgaacaattagcgaagtggaattatatgaggtttctattgttcctttgccggcttatgaagatacagaggcagcattaagaagtcgtgatgaattagaaaaaaacgtcgaagaaagaaaaaaattaatcaaaaaaattaatcaagcgctagaagcgtaggaggaaaaatacatggatacagaattattgaaaaaaatgaaggcacgtcgtgaacaacgattgactgaattacgtgaaaaagttgaatcaggagaattacgcgaagctgatttagaagctattacaaaagaaattgatgccgttgttgatgaattgaacggaatcaaaagtgaactaagtgaagccgatggatcagatgaaggttcagatgctgacgaaggaacaggtggatcagacggctcgactggaagcgatgaaaatcgttctggtgaagacaacgatcaagaagaagattcagacagtgaagatagttcagaaaatcgttctggaatgattactcaacagcaacgagatggattacttggatcaattaagaacggattggaggcacgtgcaaaaatgaccaataaacaaaaagatcaacaactacgaaaagcatttgctaattttgtagttggaaatatttctgaagcagaagctcgagctttagggattgaagctggcaacggttcagttactgtcccagaagtaattgcatctgaagttattacttatgctcaagaagaaaatttacttcgtaaatacggaacagtggtgcgaacatcaggagatgtcaaatatccaattcttgtgaagaaagcagatgcgaatgtaaacaagaaagagcgttcaactgatattgctgaaacagctattcagtttgatgaaattttgcttgatcctgccgaattcgatgctttggcaacagtaactaaaaaattactaaaaatgtctggtgttccagttgaagatattgttgtggaagaattgaaaaaagcttatgtgcgtaaagaaatcaattatatgttcaatggtgatgacgctggaaatgaaaatcctggtgcattagccaaaaaggctgtagcatttgaaaaacctttagatctaactgctgcaggtgctgggcaaaaattatatgatgcattaatcgaatttaaaaatacaccagtgacagaagtgatgaaaaagggacgctttattattaatcgagctgctttgactgctattgaaaaaatgaaaacagatgatggatttcctttgttgcgtccatttacacaagcagaaggtggaataggttaccaattagttggctatcctgtggattggacagatgcagcagataaaaagggtgaaccagacacaccagttttatattttggcgatttttctgcatttaaaattcaagaagttattggtgccttggaaattcaaaaacttgttgaaaaattctctggtaaaaatcaaattggattccaaatttacaacttgctagatggtcaattggtttattctccatttgaaccggcagtatatcgctacgaaattacaaaaccagttggtggttaagatggaagagcaaactaaagaattgtctttagaggaaaaattcaaatcacatattcattttgaagagggcatggatgattctttgctctctttttatttaaatatggcaaaagattatgtcaaaacagcaactggtggccaacaagaatatcttattttgatggttgccggcattgcctatgaatatagagtttcagaggatgaactcgacaaagctatgaatgccatgacgccatttatcgtgcaaggagcgattcaaaatgccgaagagacagactaataatctcagatggaaagccgaattgctagacatcaaaacaggaacagacggaaacgatcgtccaactacaatttacgaatttaagcgtctaatattctatgaagaactcggtgtgacttctcaagaaaaatatttatcacagcaagccaagacagacgttgtcagacgaattaaagtcagatgggataaatccatcacagagaaattaagtgcgctcaaaattgattctgtaacgtataacattactcgcatttatacgaatcccgatgcaagagaaatggagttgagtttagcttatgtcgattagctttgataaattgaaaacagcgctgaaatcaacaaagttaccagtgttcagagacaaagccagattagggacaatgtatccatacattgtgtactcaaatgtgagtaacagcaaaaaaatggcatccggtaaagtctataaaaaattaccttattaccaagtctctttttttacacttggaacagaacaggatttagttgttattgaacaagcgctgcaaaatgctggcattccatattcagactttacaggtatacaaggtgatgagaatgacgataccgtgaccaactattacacatatgtgaggtgtgtggaaaatgccaagtaataagaatgggttttctgaaatatcggattatttgggtaatctttcgcgagtagatcccaaaaaaatatcattggaatctttagaagatgcagcaaatttttatcttaaacagctatttcctaatattcctaagtctctgcttaagaaaaaacacatgaacgaacaaataaaagtagtagttgaaaacgatcaagtgaaagttcaatttgaagagactgccttttactggcgctttgccgaaaatggcacaacaaatcaacgtgcccaacattttgcaagtggtacgtatgaacaaaacaaagaaaaaattgaagaaattatgactagaaaaatacttgatttatgggaagggtgattttaattgggaaaacaagatactttttattttgaaggattggacgacattttaatcgcgatgatggcaacgccagattctgttggaactgctccgacttatagtgaagttgtccggttgcctatcgctacaaaaattggagtcaaaggcaatggtacagcgttggaaaaatgggcatcaagcaaaatgttccgacgcgtgtcccgagaaacaaaacatgaaattgcgttggatcatgtaggtattccaattgcggtaatggatgaaatcaaagggatgattgcaaaaagcggagtaacatttagtaaaaataccgcacgagaatttccttaccttgcatttggattcattggaaatattgaaggcggaggtaaaaaagctgtatggtatccaaacacgcaactatctaatgtaattgatgaagaatacgctactgctgaagatgaaacaaaaatcgatgatgtaactgcaaactttgtttctacaggactgaaatacaataatgtgatgtatgcaagttttgattcgaatcgtgaagaagcgacaatggatttatttgaaaaattcattgctcaacctgtatacgatgaagaacagtggaaaacattggctaaagttggaggtgcaggctaatggctcggttatctgattatggaattaacgttgaagacttaaaaaattctgctactgtcactattcaaggtgtagaattccctatctcatttactatgcaaacaatggaatttatagcagatgtatatggtggagattattcgcaattcgaatctgatatgaacgccatgctatctaaaaaagaaggacaaatttcttctgctaacttatcgcctagtgatctaaaaatcatgcgtgccttgatttatgccatgctgcgtactggtggtttagaggaagatccagaaactattttcaaatttttgggaatgagtggagaggtgttgtctgcttatagtacctgtatggaaatttttgctagccagacatttcaggtggaagacctaaaaaaatccaagaagccacaagactttcaaaaaacgcaagcaaaaagaaaggtaaacaaaaagaatcggaagagataggaactccttggagtttttatatttacgttgctctcactctattgaattggagtgagagtttctttttgaagtctacacctaacttgtggctcaaatcttatttacagtggttacaacaaaacaccgattttgaaccacctcaatctgtaactatggataaatcgccttggtggtagaaaggagcgctaagataaatggctggtaaagaatctgatgtcgttcttaattttaaaacgaatggcgaagtcagttattcgaaaacaatcaaagaaatcaacaaagaaatgaacttagccgctgccgagtacaaaaaccaagtgtctgcgatggacaaggatgcaactcaaacagaaaaattgcgagcggctaaacaaaagttagaaaaacaactggggttagctgaacaacgatctcaaatgttgagagaagaatatgaaaaatctgtcaaagagacaggcgaatattctgctgaatcagaaaaattatataagcaattgcttaattcggaaactggagaaaataagcttcgtacagcattggaacagacaaacgatgcattaaaagaacaaggtgatgtttctgtagatacagcgaaaaagcttcaaaaaatagaagaaaccggtgaaaagataaaaggcgttggtgaaaaaatgtctgtcggtgtgacggcgccaattgtagcagcaggtgcagctggtcttgccgcatttggtgaagtagacgaagctctcgatactatcatcactaaaacaggagcgacaggcgagcaagcagataggctttctcaatctttcaaaaacgttggttcaaatactcatttacctttacaaacggttggggaagctattggtgaggtaaatacacaatttggattcatggataaaaaactggaagattcaaccaattatctcctacagtacgctgaaatcaatgatacagatgtttcgcaatcagcaatatctgctcgacaagctattgatgcttatggactagaatatgatgatttgaattctgtccttgatgtaacaacgaaaacatcgcagaatactggtcaatctgtagacgacttgatgcaaaaagcaattgatggcgcaccacaaattaaacaactaggattgagcttcggagaaggagtcactttgcttggacaatttgaacaaagcggtgttgactcaagtgcagctttgagtagtttatctaaagcgacagtagcttatgcaaaagatggaaaatctctaagtcagggtctcggggaattgcaagacaaggtaaaaaatgcaggttctgaaacagaagccatcaatgcagcagcagaagtattcgggactaaaggcggtcctagaatggccgatgcaattcgtagaggtactttgaacctggaagatttagcaaaaactgctggagaaagtgggggagctgtaggagacacattcgatgctactctcgacccaattgatcaagccgatcaagctatgaacaatgcaaaattagcaatggctgacgtaggtgaagcagtccaagtaagccttttgcctttttttgaaaaagcaacttccttattacaggaattctctaaatggtgggggtctctagatcaagatacaaagaattggatcataacaattgctggtatagcggcagcagttggaccagtactaatcgttcttggttcacttatgggatctgttacaaaaatcgttgggggagttaaaagttttataggagtttggcaagcaatggctgggtttttagcggctaatccattcgttttagtgattgcaggcatcgcagtgttaatcgctggttttgttttagcatataacaaagtcaaatggtttcgtgatggcgtgaatgctttcttcaaaggtgtatcagatgtagctgttgaagtattcaattttttaggcggatttattggcggagtgtttggcggaatcatagcaaacttcaataattattttaatgctggcaaaagaatatttaacggttttctcgattttgtaactggtgtatttacgggtaattggtcaaaagcttgggacggtgttgtcaatatctttggtgggatatttgatggaatcgtagcactagcaaaagcaccaattaatggattaataggtttaattaacgatttcataggtctagctaataaaataaaagtacctaaaggtgttccaattgtaggtggaaaaggtattcactttgataagataccttatctagcacaaggcggtcatctaatcaatggtcaagcaatcgttggtgaagctggtccagagttactgactgcaaaaaatggaaaaacaacagttaccccattatctgacgaagaaaaacgcaaaggaatcagcggaagagtttccggaggtagcattgaacagcatatacacattggtaaagtcgatgcaaacaatccatctgagttagatcgtatgaatcgtaaatttgctaaagcaaaccaacaggctatttatgatttggggggtgttcctatttgagtcgacaatttatgaatccagatgaaccaaattttatttggaaaaatcggaatgcagtaattgatatggattgcatcattgaggtagagcttccagatattatgccgaacaagcgatacgaaacttacacggttcagggccgaagcggagaattgacggagacgtttgatgattatgaaccttttgatttagaaatagaagggatcactatcccacattccaaactgagggaagtcaaaagatggcttactggtaaaagccaattaatcactcataatgatccagacaagtatctagatgctatctgcagcatggataaagaagtcccattcgaaaacgagtggggcttcttttatacattcgatgttacttttcgttgtcagccactcaaaagaaaaatcggtgaagcgcctaaaatttttcattctagtgttatggatatttttgatcatggtgacgaaattgcacatccctatctggaaatagaatcgaacggaggagatattacgattgctatcggcgataaaagcctaacaatacttaatacgttagctgcaacaatcgtggttgatactcagcttggaaaagcaatacaagaaggtttgaatttatttacgcgtggtgattggccagtattgcagcctgaatggaatcaggtaaaaatatccggaaaatttaaagaagtgcggttttggaataggagtgtgtatctgtgacgcaagaatttatttatgcttataaaaaaatgccagatgatttgagcgtgaacggagcgtcgttagttgactgggaagatttgccagaaatcaatcgtgtgttgaatggccaatatcgtttttatggtaactattcaagaagcggacagtatcggtcttacttaaaaaaaggaaatttcataaaagcgaaggtgccagatggatcatggcaatacttcgaaatttacaatatcaaaaagaatttgacgtctgtttctgtaactgctcgtcatattggatttatggccaataaaaactttatcgttaagtcattcacggataacggcaacggttctcagatcatgaccaatcttaaaaacagtttggcatttgatcaaaaattcaactatctgtcgaatgtaggcacaacacaccaatttacagcaagacaagttgctccaattgaagcgattatcggctcaaataacggtaatcaaaatttgactggcgtgactagcgcggaacttgatatggataactatgatttgaaactggtaaaacagattggatcagataatggttttcggattgattttggcatcaatttagaagcaatcgaagaagaaatagatgaagaatccatcgtaaatagcctgtatttgattggcggggttcctgataacgattatgatgaagacaaagaacctattgaatatggatatttagaaattgatggagtgaccaacgagaatcgacgtatcgccaaacgtgaaaacggagattgtaaaacagttgatgaattgatcaaatggggtaaaaccttatttgacaatgatcgtatccacgagccaaaagctactcatacagtcagtatggtggcgttggaacacacactcgaatacggtgacatgtatcaagagctagcgtctttacactttggtgatgtcgctcatgttagggcgaaagagctagatatcgagataaaagagcgtatggtcgaatacacttatttcccaacgcttgggaaatataaggatattgttttaggtaatgatttatcactgtacacttcggcagtaaatactcaagcacaagaattgaaaaagaaaatcgacaatcgaacagaaacgttagttcaaaatgtgttgaatgcgacggcatggatcactggtaattctggtgggcatgtcgtttttcgtccagaaaaagctccatcagagattcttatcatggatactccaaatgtagcgaatgcaaagcgagtgtggcgttggaatttaaatggcttaggttattcagacaacggagtaaatggcccgtttggcatcgcaatgacgtcgaagggtgaaatcgtagctaacttcattaaagttgggattattaatgccgaagttcttgaaagctcaattaatgatctaggcgatgtgttaaaaattgtcaaaggtacattacaaatttggaatgataataaaaaaatcatggaaatgaccaaaaaagggatggaattttggaattctaaagaatcgattggcacaattggcacaactgattctgctggtaatccttttcctggagcatctacgccaacgcccttagaaaataattcattagttattcggacaaacggtgatgggaaatatattctgatttcaccgaaagaaggaaaaggcttagttatgcttggaaacggtacttctatattgtacggaagtctaaatttgcaagaaaagctgaatgcttttggcgatgtggagtttatgaaaaatgtcaatatacgcggaaaacttacaattaatgggcaagaagtatttcctggacaagggggaagtgggaataacggcggaggaagttggaatggaatgtatccaccagagttaactagtcaagcggacaaatttgcttgggagctatgggttatgcttctttctaggggttactccaaagcgtcaatcgccggaattctcggaaatgttcaaggagaagctggggttgcgatgaatccggatatcgcacaaattggtggccctgcatacggaattgttcagtgggatggttcggcatatcctttagtacctccggccacatgggatggtaggacttatgtccagaatttaatgagagctgcaggaataacagaagactatcgaacgatgtcagcgcaaggaaagttattagattggacaatgtataacggtcaatggttaggaattgttcaaccaacaagtgtttctggatttaaagcaatgactgatccagcagctgctgcttatacatttgaacgaaactatgaaagaccagccacaactcatccagaaagacaaggatgggcagttaattggtataacaaattcaaagatcttcaagtcccgtctgctggcagtattctcagtacagccaaaagcttgatgggttatttccattactcgcaaccgttacgttggaattttggtagcgtcgagaatcctgatcgtaatgggtatgctgactgctcttcttttgtgtggttggctttgacaaaagcaggatataaaaccgcaacacgtgggactctgtggtacacaggttcaatggccgcagatgcaagagggccacgtcagtatctgactgaaatatctccaaatgaagcgaaagccggagatatcatcattgttaatttaggtgctggtgctggtaatgatggacataccgctattttagcagaggattggaagggatatagcacgtctatcgttgaaatgggcggcatgaattccaatggtgtaggtatcggtcgcgtcgattggtccttcgggtatttattaaacggtggcgatgtttgtctcgccagagcgaagaaatagaggtgattttgtgatcgaagaaaaaggattaaatcatttgaaaagtttgttgaatcaacctatcggaaatcatcaatgttatgcattatctgcggaatatgccggtgtgatgattggacctgacatgggggctggtactaaatatgagattaaagtacgtcatggcaatgtattttctgctgctgaaattggacgagcctacccatgggcattgtatttatggacggttattgttcatcctgagtatgaccaactagttgttggctcaattatcaattgggaaagaaacgcaaaaatcagtgatacatttgaaagccatgaatattacggccacacaggtgtaatcaaaggtctagaaaatgggcgtattcaaacctatgaacaaaatgcagaatcaggtggcattgtagcggaatatgatcgtgaatttttcggatctggtcagatagcctctatctgtatcccgcctgattttgagaaaggagtggtaattaatggcaaagtggaacgtagtactcagcacaactgaaccttataactatgtcggtatgattcaggtacggcaaggtaataagaattcagaagttatggaagcaaccatcactgaaaatggaatgccctatgatctaactggttgtaaagtctattttgaatcagttgtcggagacaaatacccagttcaattaggtactaaagtcattgatgcaaaaaaaggaaaaattcagtacacatttgatcaatattcgatgcaatgcctacatcgccaaacagcagattttatcatttataaagaggatgagttaattgctacgacgcaagatttctcttattttgtgattaaagctgtctcaaaaacagagggtgaaatgggatcgtattggcagacagtcgaagatttaattgcggatatgtcagcttttatcaatgaaaacaaaggtgacttcacagattggatgaatgcacgtaaaaaggaatttgaacaatggcgacaagaccaacaaaatacatttgaggcatggagagaaggacaagaaaccgattatttaaaatggtttgaatcaatcaaagatattttgaagtctatcgatccaggtggagtaatgttagccgaattaatggatgcacgtgttgatattcaaggagttcgtcatgcgtctatttcagagcgcttgctggcagatatggattatctatatcagaaattacgagcaacacttttcacgattgaatacggggagattgaagtgactgatattttgcaggatgatctcttttcagataatcacgaagtcgaaaaagttggaactgtagaattcccgattgaagaaggagccttgatcatcgcaaccgttgatgatccaaagcaaaatgtgttcactcttgagaaagttggggtgatctaatggctaaaactaaacgaatgatggaaacggatgaaaaaacaggtgtacaacgccaattctttccaatcacacatgcttccgcagttcttgggttagaagaaataatagcaggagaagcaacagttttatctgttaatggcaaaattggagccgtcgtcattactaaagaagatttgggattagagaatgttctcacagaattaccctatgcaagtgaagaagatgacggcattatcacgtcagaaatgtatcaaaaaattttaaacagtggagaaggtgactacgtgttgccagttgccactatcgaccgtttgggtggcataaaaattggtgaattattgacgattgatgagacaggaaaagtctctgcagtcagacaatctgatgtcaatttttcgctggagttaaaagaaaaactcgattcactgaaaaactatactgcaggagaaaacatcactattgatgaagatggaaaaataaatgcagaagtgactggtttttacgttttacccactgcctccgaatttgtaaaaggtggtattcgtgtcggtgaaggtttaacgatgactgatgatgttttatcggccgataagcaattcaactatactgccggagctaatatcagtatttcaaacacaggattaatctctgcaacaggtggtggagaaggtggcggcgtcactcaagaatatgttgatcaaaaaatgagtgaagcttatcaaaatgcacaagcttatacagattccaaaataccaaatgtatcgtttgaaaaagtaggggaggtatagacaaatgacagatattgtaaaagtaaaacagaatgatgttcaggtttaccctcaaacccattgggatgctgttgagggtaaacccgaaactatcaagggagataaaggagaccctggacaggctgccacaattactgtagggacagtaacgagtggtacaacagctagtgtcacaaatgctggtactgcaagtgcagcaaagtttaattttgtattgccaaaaggtgataaaggggacaaaggcgatcctggagccaatgcaacaacgacagctgtggctacgacgacagcaaatggtttgatgtccaaagaagataaagtgaaactcgatggattagccaatattacatttgagaaagtggggacggtttaatggctgatattgtgcaattaaaagaagacggagttgctaagtatttgaaaactcatgccaaaggaattgatggtgtggagggtgttttagtaaaagccacaggtaatgaaacggtcttaggaacgaaaaattttaaagacggattgcaattcaatggattgcctgtgcaagcaggtatgatcgagcgagctatcacactagctgatcgaagtgatacaacaaacgtaactgatgtgaatggaaaaataatcagaatcggaaacatcgtatttcttacttttaattttaaatgtggcacatggcccgaaggatcagaaactcgttggattttaaaaatcccggacggtttcaaacgtgatcaaggctatccagcgcaaaccgcgctttcactagttagaaatgcaagtcagccagcggatgcacgtgcattcattgatcaaagtagcatcatacaagccaaatcaggttcaggtagttcatatatttcaggtatgtggatcactcaagatccttggccggcttaacagattactaattggaggaagagtaaaatgaaaacaatttataaagtattgtatccaatgggatatgaagaacatcaagtagaagataactttccaacatctttaccatttgtcgaagttccacctattttgtttgaaaagaaggaagatgaaacggatgaaggtttcggaagaagacaacagtcgcaattttttaacttcactgaaaataagtgggaagaagcagttacacaagattattctaaaaaattagaactactagaaaatttatctataggtttacaggtagataatgctgcattgaaaaaagcaaatgaagagcttactacaaaagcagaatcactagcacaaattaattcgaaaaccatgctgacatcccttcaaaacacaaaagacattgctactatcaaagaacaacttgacggaggaaaataatatgtattcttatgatgatatcaagatgatgtatgactggaattgttttactgctgaccaagttcgacaattcgttccattatgtattacggacgaagaagcacaaaaaattattaataaaactaaagtgttgtgataacaacatagttaatataaataaactttttctttatacgcatcgtattttagacgtgttgtgctatattactatcgaagaagaaaggaggggataaaagtgttagcattcaaaccaagttggttattagaaacagaagaaaattcaaaaattacaagaatttatcttgtaacaaaatttaatggtaataaggtttcaaaacgagcaattgtaaacatccacaagtgagttagtcactatagcgtactcgaacgagtgcgctttttgtatggccaaaaatagaaagtgaagggtggaaacatggtgatcattgataatttagttttgttatcagagtttaaaaatctagtaagcaacgtttatattcaaatttttgtttggattgtcattgcggatatcattacaggagtttgtaagggacttgctggaaaagaaacaaatagtactaaaggactaatgggggtagtaaaacatttgctggtcgtggcgcttgtactgattgcttacccctatcttaaaatcatgaactttgaaggagtcgcaacagcttttgtgctttcgtacattgctgtttatggaatctcggtgattgagaatttaggtcagctagggatcccgattccagattttgtgaaagatcgattcagcaagctaaaagattcaactgaaaaacaagggaaaaacaaaaaagaaggaggacaataaaaatgagtaaagagtcaatgattaaatggatgcaggatcgactaggtaaagtgacgtattcaatgacccatcggcttggacctaattcttacgattgcagctctgcagttttcttctcaatgattgctggaggctttctaccttctggatcaatgggaaatactgaaacgttgttcggtatggttggaacgaaactgaaaaagattagtcgatcagaagtacaaagaggggatatctttatttcaggtactcctggtggttcaaatggatcagctgggcatacaggtatttttctaagtaacagctcatttatccattgctcttatacgcataacgggatcgcagtagatactaatgatgcatacatgagtacaaaactgcaacataatttctaccgtattctcgatggaggaactgctaatacagacaataaaccacagatgattcaattagctcttgatggtcagtttggcaatgcaacagctagacgtttacaagaatactttgacacagctggcaaagatggtgtgatcagtcatcagttcaaacaaacatttaatcaaaatatttacgctgctcaatttgacaatacattaactgggtcgaatgtcattagagctttacaaggtttcttaggcattgctcaagacggattgtgtggccaaaatacaataaaagcattacaaagatatttaggcacaacacaagacggtgtgattagtcctgtatctaatgcagtgaaagaattacagcgtcgattaaatacgaataagctataaaaatgactccccttttgactcccccaagcagtatatggatgtctctaaaagttgtttttttagattataaaaagctgataataagcgaaaaacacttaaaatcagccttaaaccctattctcgaaatccggcgaaccggctaataccggcgcgcaggttcaaatcctgtaccttccttatatcaacgattagaggttgtaaagaagctgtcctgcatcaagtaataagaacggccaaacaaaaatagcttttcctattttttcgtttggttggacttattaccgcagatgcaagcttttgaataccgtttgttcggaataaggggctgtgacaaggcttttgtcacagccccttatttttgttgtacttttagcctacaatattttttgattccccctgagtactattttttataaatgctagtaaatcaatcttctttggccttttttttgataaaacaaaatactagatgtaagataaaagtgtaaaaacgatttgttttaggaggggaaacgatgtgtaccgcaatcacttatgcaacgaaagaccattattttggaaggaattttgattatgagatgtcttataatgaagtagtcactattactccaagaaattatcgtttcgattttagaaaggtaaaaaatttagataaacattatgcaatgattgggatagcagctggggtagccaactatccactctattatgaggctacaaatgaaaaagggttgagtatggcaggactgaattttcctggcaatgctgattataaagaattacaagaaggaaaagataacgttgcaccatttgagtttattccatggatactagggcaatgctcaaccatagacgaagctaaagaattattggctactatcaatctagtcaatatcgattttagtgaaaaactacccttgtcacctttacactggttattagctgataaagaaaaatcgatagtaattgaaagtatgaaagatggacttcatttatatgataatcctgtcggtgtgttgacaaataatccgccatttgattatcaattatttaatctgaacaattatcgctcgctatcaaatggaacaccagaaaatcatttttcaaaccagatcagcttgaatgtttatagtcgtgggatgggaggattgggcttacctggagatctctcttctgtttctcgatttgtaaaagccacatttactaaaatgaatgctgcatcaggtgattcagaatctgaaagtatcagtcaattttttcatatactaggctcagtcgagcaacaaaaaggagtatgcgatactggagaaggaaaatacgaatatacgatttattcttcttgctgtaacgttgataaagggatttattattatcgtacgtatgaagacagtcagattactgctgtaaatatgaataaagaagacttggatcgtcatgaattggtcagttatccagtcataaaagagcaacagataaactatgtcaattaattcatgaatagatccgtttggtatcatattttctgatacagtcataattagacacgatctttaggtcgtgtctttttttgctggtttttttggaaatagcatccactaatatttttttaacacgaagagaataagatagcctcaaaaaagaaaacatggtaaattagatattgggactttattttctgtaaaaacagaaactttcatctttttttttcacgtgacgaaactgtaagagagaaaatattcgtccgctatttattctatgataagatgcatatgaatgaaataaacagtaattttatattaggatgtgaaagttaaatgtgcggtattgtaggttttgttaacgacaaggacaacaaaaaaacaattattaatacaatgatggatcgaatcgttcaccgtggacctaatagttcaggagaatatatcgataaacatgttgctttaggattcagaagattaagtattattgacttagagggcggtactcagcctatttacaatgaagatcggacaaagatcattatttttaatggcgaaatctataattaccagcctttgagagaagaattgattgcagctggccacgtttttcaaacacatgcagatacagaagtccttttgcatggttacgaagaatggggaacagaattattgcaaaagatccgcggaatgtttgcttttgctatttgggataatgaaaagaatgagttattcggtgcaagagaccactttgggatcaaaccatattattatgcagaaatgaacggaacatttatgtttggttcagaaatcaaaagttttctgcctcatcctgattttaacaaagaattgaacaaagaagcgttgaaaccttatatgactttccaatattctccattaaacggcgaaacattcttcaaagatgtctatcgtttgcctgaaggccattattatacgtataaagatggaaaactagacattcagcaatattgggatgcagattttgaaacaaaagaaacgcattcccgacaagaatggatcgaaaaaatcgacgaaaccgttcaagcttctattgaagcacatacggtcagtgatgtagaagttggttctttcttatccagcggggttgattccagttatgtaacctctgtattgaaaccagatcattctttctcaatcgggtttgatgataaaacctataatgaagcgattgaagccagaaaactaaccgaactattggacttagataatacagcagcagtgatcgacggagacatgtcgttcaaagcattccctttgatccagtatcacttagatgaacctgattcaaatccttcttgcgtacctttgtactttttagcaaatcttgcttcacaaagcgtgcgggtagtccaatctggagaaggggcggatgaactgtttgcgggataccaaacgtatggattccatacgaattcaaaattcatccgtgtgattgctcaaggattgaaaaaattaccaaaaggaacacgctataatttaggacgtaaaatcggaaaaatgaaaaatttccatggacggatccatttatatgaatcacttgctcctgcaaaagaatattttatcggtcatgctcgagtgttcgaagaatcagaagcatcagaagtgttgacaccaaaatatcaaacagcaccatctgtggatgaaatcatgactgttcattacgagaaaacagaaggaatcaaagatgaagtcaataagatgcaatatgtcgatcttcatcaatggatgccaaaagatatcttgttgaaggcagataaactttctatggcaagttctttggaagtccgagtacctttattggatatcgaagtcatgaaattggctcaacaaataccaagtaagttcttattgaatcaaaacaacacaaaagatattttcagacaagctgcgaacaaacatcttccggaagaatggtcgaatcgtgtgaaattaggattccctgtgccaatcaaagcttggttgaaagaagaacacggctacgaacaagtcaaagcattattcgaagcagattttgcaaaagaattttttgatcaagaaaaaatcatgaagttgctagatgaccatcacgaaggacgtaaagaagagcaaagaaaaatctggacaatcttcagtttcttgacatggtataaagtctactttgtagatgaaacgattccgcaagcagaagcaatcgactatgtgactgtttgatgaaaatcaaatatcaataaaaaataggttttctcctaccgtttaacaccgagtgataagaaacaatttcaaaaaacagctcttcccgttttatagatattatgacttgtggttcggagttggcagaggaacaccattgtttcgaacataaggggttgtgacacgattttcgtcacaacccctttacatatgttcaataatcgatttctttttcttttgtcccatcttttttataaatgaccaaagttgattctttgttttgtgctacttgctttcctttttcgatcgcttctttctttgtatcaaaatggttgctagccttttttgctcctttagatttcacgatccattgttcttcggcatattctacgatcacatctgaatcaagcaattttccggcacgaggattcgtatcatgtttatccgacttacttggatttttttctttttcgaatgttcgtctttctgattcactagcattttcataccactcttttgcttgatcaatggcaattgggatcgcacggctatcagggtaaccctcgtctaatagagcatttgcgatgtcgatcgccttttttcttgtcagtttatctaagtttttcattgatgcaggaaagtccttcatgttccatggcatattagtatccccctttatttaaaaaaacatagtctctataaacaagtgtaagggtatttatacaaaaagaaaaagattttgtctgagaagtaaaaccgttgtatttatcgtcaagtagttttacttaacaaaatcgtgaaaaacactagcaatctggaaaaaatcatggtaagataatcaagtctgagagtcatcttagaggattcttgtaaaaatgggagggaaaatcatgcgcgtaaacatcactttagagtgtacttcttgtaaagaacgtaactatctaacaagcaaaaacaaacgtaacaatcctgatcgtttggaaaaacaaaaatattgcccacgcgaacgcaaagttactttgcaccgtgaaacaaaataatgtttttaaagttctcaattccttgctggtcaaagaattgagactttttttatctcaaaacatctaaaatcataaggagcggataatatgtttatttccatgtgggcacaagataaaaatggtctgatcggcaaaaatggtttgttaccatggcgattgccaaatgatatgcgtttctttcgcgaacatacaatggatcgaattttagtgatgggaagaaagacctatgaaggaatgggggatctttcacttccttatcgccatatcatcgtgttgacaacgcaaccaaattttcgcacgaaagaaaatgcggaagtaatgcattcgatcgatgaacttttgtcgtatagtcaaacaatctcagaagatatctatgtttcgggtggtagtcggatttttcaagaacttcttccttacactggtcggatctggcgaacattgatcgatagcacgtttgaaggcgatacgtatattgggaatattgatttttcagacttcacccttatagaggagtatgaggggataacggatcaagaaaatctatatgcccatcgttttcaaaaatgggaaagagtaaaaaatagggttgcttcaaaagaagaataaaatctatgcgtctagtttgttaataagaacaaaagcatcttacgactaatcgtgaagatgctttttttagttaaaatcaatttagtttttctttgatatcattgaccatttcctgactggcaataggtccgttatatagccagctagattcaggtccgaattgcagtacatgattgtctgtcactgctttaagattcttccagcttggttcattgaacatggcagcatctttgtcactgttcacaaggatgatgtagtcagcatctaattcagctagcttttcagaggaaacagcagaccagtcagaagtggcttttttggagacctcttccactagatcaggaacaccaaattccagatcgtcgtatacgattcttccacttgaccgatttttgctgaccataaaggctgagttgttggtcacccacaacactgcagctgtcttgttctcgattttatctgctagttcttctcgagttttcttgatggatttttgataatcggaaatgattttttctgcctctttttcttttgccaaagctttgccgacatcttttagttgttcttcccatgtgacatctgttccgttttttacaacataagttggcgcgattttgctatattgttcgtatttcccgccttcgacagtagcggaagaagaaatcaacagcaaatcaggttcaaagcttaacactttctcataaggaaggtcataagaaatcgttgggacatcctttaaatcattttgcagataatcttgaatggaaccactgccaacagtccactgggcgataggtttttcccctagtgcaatcagatagtcttctaagtaactgccgatgatccgtttgggcgcgtttggaatctctactttatgtccaagtgtatctgtgactgtatgagtactattggatgaagtcgtcgaattggcagtcgtagctgtttctttatctgaagagggggagcaagcgctcagtactccagccagcagcaatatgctagataatgtgaatacttttgtttttaatttcatttctttcctcctgacataattgagaatctttctcattggttattattcctgatatttcgaacgctgtcaaccgcttcatttggctatagatatgaaagtagcgcttgacgaaatgttgaaacagcgtcataattgagaatgattttcagcgaaaggatgggtgaaatgacgagattaagagcagctgacattgcagccggctacgaaaacaaaaaaatcattgaaaacatgtctgttacgattcctgaagggaaaatcactagtttgattgggccaaatggaagtggaaaatctactttattgaaaagttttacccgtatactacctgtgaaatcaggaaagatcattgtcaataactctgatatctctacatacagttcaaaagaacttgcaaaaaaaattgcattattagcacaaactagtgaacaccctacaggtatgacagtagaagaagtagtatcttacggacgatacccttatcaaaaactgttcagtggcatggacacgcaagatcatgaagcaatcgagtgggcgttggatgctacaggtctagctggatttcgtatgcgggatatcgcaacgctgtctggtggacaaacccagcgtgtctggatcgctatggcgcttgctcaggaaacagatatcttgatcttggatgaaccgacaacatttttagatccggcacaccaattagagatcctacagttattgactgaaatcaatcaaatgaaacaaacaacgatcttgatgtcgattcatgacattaatcatgcttcacgtttttcagattatttattagcaatgaaaaacggtaagttgatcacagaaggtacacctgaagaagtgatcacaaaagagtgtatgaaaaaaatatttgagattgatgcaacgattgtcacgcttccaagaacaaataaaccagtttttctaacctatgatttgttgccaaaagagcaggaggatcaattatgaggactatgaagaaaaatagactcctgcttttggtctgttttgttcttttgattattttttttgttgctctttcaaatggcgcagcgactgtgggaaaagcagatttttggcaggcattgtttgattttgatagatcaaaacaaagtcaccaaatcatacgaaatattcgtttgcctcgtgtggcgggagcatttcttgtagggagttgttttgcattgagcggtgcattgatgcaaggagtgacaagaaatcctttagcagattcaggcttactaggaatcaacgcgggtgcttcgttggcaatggcccttagttttgctttttggcctaaagcttctgatttttctgtgtttctaatgtcattggcaggttcttttgctgtaactttgctcgtatttggttttttgcagttttcgaaaatgggcatgaatcctttacagctgattttagctggcgtagctattagttctttttttactgctatcagccaagcgcttacccaattctttaatctgcagcaggatcttgctttttggtttgtaggcggagctgccaatatcacatggaaacaattagcagtattgtttcctttatatatacttgctgttttggtttctttttcattaggaaaagcaatatctttgattcatttgagtgaaacacatgcattagctcttggaagtcatcctaaacgaacgcggttgattgttttctgtctagtcgcagtgttggcagccatagcagtttcgttagtcggtccagtctcctttattggactgttggttccgccagttgttcgcggaatggttggaacggactatcgttatgttctacctgtctcttttttagttggcggtggattggttatgttggcggattttacagcgaggatgattaatcccccttttgaaacaccttttggattagtcattgcattgattggcgttccgtttttactgatacaagtaaggagggaacaacggtgaaaaaaatatattggacgttttatttcttgctttttgtacttgtcatcctgtctataggtagtttaatgattggtacgccttttatttacctggatcagctttttgccacgttcatagggaaagaatcatcttctttggcgctgattgttagagaatttcgagttcctcgattactgatcagtttattagcaggagcttgtcttggcgtttctggttatatcttgcaaggagtaacaagaaatgaattggcagattctagtatattgggcattaatgccggagcaggatttttagtgatgctttatttaggtttcttttcgcactattcgctgccgtttctattgctagttgtagcctttctaggtggtgttttagctgcttgctgtgtctatcttgcggcctatgatcgaaatggctttttgggtatgaatcgaatcttattgtccggtattgccgttaatgccggcctttctgcattaacattgctatgcacgattcaattatctaaggaaaattatggatttgtgaatgcatggttagcgggatcaatctggggtgcgagctggccttatgtttgggcattgcttccatgggcggttatcttaattccgctaggaggactttatgcacagaggattggattgctatcatttggtcaagaacgcgcgcaaggattaggccttaacgtggctaaaagtcaaaaaatccttttgttgttagctgttgctttggcaagcggtagtgtagcggtgacaggtagtttatcttttgtaggactactagctcctcatgctgcgaagctagtcgtacgtaaagaaaataactggacctttgttctgagcggtttgttcggttccatttttgtgcttagtgcagatatggttgctagagtgattctaccaagtggggaagtacctacaggaattttgattgccctttttggtgcgccatattttctgtatgcactttttatcagacaaaaacacgcgctgaacagttgaaattcattaaaaaaggaaggccaatcatttctaggtcttctttttattctatttatgcatttatttgaaagttcgattgctatttttctttttttcctataccattttatgagagaaggaagggtgagtttttggaccaattgaaagtaagattacgccggaaaggaatcgaaaagctgaaaaatctggccaaaagtggcaagaaaaaggaaaaagaacagcgaatctataaacagctattcgccagcgagtactggaagtcagcaaaagtgatagggacgactttatcgaatgaatttgaactggatacacagccggttatccaacgagcagaaaaagaacaaaagaaaatagttgtacctaaaactttgccgaaacgtcagatggcgttttatgaaatggatgaacagtccgttcttgtacgttcgagttttggtgttcttgagccacaatcagagaagctctatttgccggagatgatcgatctcctcattgtaccaggtattatctacaatagagccggttatcgaatcggttttggcggtggttattacgaccggtatttaaataattttcataaaaaaacatgtagccttgtttttcgtgaacaattgaatgaacaatggcaaccggagagctttgatcagaagatccaacaattgtttattgactaaaatgaaatgggaggttttcatgaattatcaacagcaaataaaattgcgtgcatggttaagacgaccgttatggacctatgcttttttagggatacagacagcggtcttcctcatgatggaattatttccgcgacttgagatcccttattatgccggaatgtatggtccttatcttgttcacttcaatgaatggtggcgtttagtgacaccaatcttcatccattttggactgatgcatttcgtaatgaactcactgatactgtattttatggggcagcaaatcgaggcaatctatggccattggcgttttttcttgatttatatgttcagcgggataatgggaaatacagcaagctttgcttttaacgaagcgaatgttctgtctggtggtgcgagtacttcgatattcggtttgttcggtgcgttgtttatcttagggtttcattttaaacataacccagcgatccagcagctagtcagacattttcttttatttattgtgttgacatttgtttttggtcttctggatacctctgtagatgtttggggacatgtcggtgggctaattggcggattagtgttagggaatgttttgggtctaccgaaacaacagacaagctattcgatacaccaaaggattctttttacactagtttttgtatttctttttgtaatatgtattttactgggtttaaaaaaatatggtttacttgtataatatgaaggaagtgcttaaagatggagagcttatatgatgtacagcagctgttcaaaaaatttggcatctttatctatgtgggtgcacgcatctatgacattgaattaatgactatcgaattgcgtaatctgtatgatagccgtttgattgatcatgatacatacatgacagcgtggcgcatattaaaaagagagcaccgaattgaagaaagccgaaagaaaggaaatttgtaatggacaagaagattattgggattgatttaggtggaacaacagcaaaatttgcaattttaacaccagaaggagagattcaacaaaaatggagcatcgataccaatattttggatgatggtaagcatatcgttcctgaaatcattgaatcaatcaaccatcgtttgaatttatataatatgaaagccgaagactttatcggaatcggcatgggtaccccaggaagcgtggacagcgaagctggaacggttattggtgcgtataacttaaactggacagaagttcaatttgtgaaaaaactgatcgaggcaggaacaggaatcaaattcgctatcgataatgatgcgaatgttgctgctttaggtgaacgatggaaaggtgctggagaaaacgatccagacgttgtattcgttactctaggaacaggtgttggcggtggtatcgttgctggcggaaatttgattcacggcgtgagcggagcaggcggagagatcggccatatcactgtggatcctgaagggttcgaatgtacttgcggtaaacgcggatgtttagaaactgtgtctagcgctactggtgtggtacgtctaggtcgttacttggcagaagaatacgcaggagattcaaaactgaaagcaatgttagacaacggtgaagaagtaacaagtaaagatatctttgaaatggctcaagaagacgatccgtttgcattgatggttgttgatcgcgtatgcttctacttaggtttagcttgcgccaacttggggaatacattgaatccgtcaagtattgtgttaggtggaggagtatcggcagcaggagaatttttacgtagccgtgtagagaaatattttaaagaatttactttcccgcaagtaagagaatcaacaaaaatcaaattagcagagcttggtaatgaagctggtgtcattggtgctgcctcattagccttgaaatttgcttaaaaaaacggaggcattacatggttttatgggtaattaatatcattttgctattgattgtgcttgcaatcatcttttgggaagtctatctacgagtaatggccaaacgttcagcaacgactttgacagaagaagaatttcgagaaggaatgagaaaagcacaagtaatcgatgttcgcgaaaaagatgtgtttgatgctgggcatattttaggtgcaagaaacatcccttacactgttttgaaagattcattaggatctattcgaaaagaccagcctgtctatatttacgatcaaaagaaaagtttgagcatccgtacagcaaataaattacgtaaagcaggttatcaagagatttatttacttaagggtggatatgacggatggtctggaaaaatcaaaagtaaaaaagtataaaacagatgattgtatgacagctttaaaaaccgaatcaatcattagattttgaccaagatcacatgaacggcgcaatggatagttgtgccgttcattttttttattttgtgctattatctacatatataagctaagcgaaaaggcagaaagaaggaaacaactatgatcaaattaaaacgtgtttaccttgatgctgaaaaagaggatggctatagaatactcgtggataggttctggccacgaggaatttcaaaagaaaaagcgcagttagatctgtggttgaaagaaattgcacctagtaatgaagcacgcaaaacttttgaccatgtaccagaacgatttgcttcatttgcaaagaaataccagcaagaattgattttcgaagaagaaaagaagcaagctatttttaaactcagtcaacttatgaaagaacatccagtcattacttttgtttatggtgcaaaaaatgaacatcagaaccatgctgttttattgaaaaaatttatcgaaatggaggcatgcaaatgaaaatagggatcattggtgccggacctagaggattaagtgtagcagaaaggattctccataataatcaggacagacattctcttgaactttttcttttcgatcccaatggtcctggaggtcgagtttggcggttgaatcagccaccggagttattaatgaattctgtttctcaacaagtgacgctttttacagatgaaacattgtccagtggaggattggtaacacagggacccaacttgtttcaatggagtaaaggacctgctacagattatatcgaacagacggtaactaaaaataagcaactaattatagaagaaatcaatcgtctggaaaaagatcagcaatctactcgatgtttatacggactctatcaacgctggtttttctcaaagttgcaagaagaatttccagcttctattcagtttgtttattctttagtaaaaaaagtcagcaaaagaaaagatggttatcttttacagacagatcagcaaagctattctatcgatcagcttgttttagcaagcggtcactgggaaaatgatgagacagaagaagaaagagtgtgggtagactacgcaaagaaaaatgatttactgtatcagcttccttctaatcctgcagatgtcgatctttcgaagataccgcctaaagaaaatgtctttttaagaggtctaggcttaagtttttttgattatgtcggattgtttacagtatcaagaggagggcgcttcgagaacgaaaagggaaaacttgtctatcatccatcaggcaaggaaccgattgtatacagtggatcaagaagggggctcccttattaccctcgaggaagaaaccaaaagcaaggcggagcaatggcatggccacggttactaacaaaagaaaacctggagcaatggcatcagtcgggatttttgactggcgaaacattttttgactatctgaaaaaagacgttgagttgttttattacaagaaaatcatcgaagaatatcatttgccgattccaaagaaaaattttgagcatgattttctctccctctcttcagaggagtgtctcggaaagcatccagcactaatcccttatagatgggattggtcgtatttagaaattcctcttacctatcaggatgagtcctttgcagaagctagccgagcatttattgaagggcagataaaagaagcggaaaaaggcaattgcacaggagcatttgcttcaacatttgatgcattaaaagactggcgtgatccaatccggcaggctattgaatggcacgttttttctgcaaaggaatacaaagaaatactatggggatggtttactcatctaaatagctttttaacgatcggtccgccagtcattcggacgaaagaattagcagcactgatagatgcgggtatttttcatttgatcgaaccgccacttgatattcagcaaaagcacaaccgctatgttatttctctacaagataaagaaatcagcagtcgctatttgattgaagctcgattgccacaaacaagcttttctcgttcaagtaatcctgtcataaaaaatttgaaggaaaacaaacttgttcgccttttttcattttcagataatacaggaagttatcattcagaagctatagatgttgagcgaggtacgaatcgcgtgattgatgcttcaggggaaatccagtctgacttttattgctatggaatacctgttgaaggtgtggattggctaactgcagcagcagctagaccttatacagatccatggaatctgagacaggcagataaaatagcacaacttatattgactgacaaataaaaatacgcatgatgacttatctgttctttcaaaagtcttcatgcgtatttttaaataattattaacgagaaacgcgtttgcgcattgcttttttacggttttcttcgatcattgcttctttttcgtcaattggatcgatcactgtttttttcacagaagcgaccaaaccagcaacggcagcggctgttgccagacttcctactaatattccagatacaaattttttcattgaatccacctcatttattatttgttatatccattatggaacaaaagagaaaaaaaggctagttttacgtttgtttgtaaacctttgcaaaaaatccttgaaaatgtttactaaatgttttattataaatttaccatatgaatttacgaaattttactttgtttgttttcaccataaaagtaaacttcgtttttttaaattatatataatcaacaaacacaattttactaatcaaaggagtgttttttatgacaattttagtactaggcggagccggttatatcggttcgcacgctgtagaccagctagttcaaaaggggtatcaagtagctgtggtagataatttgctcacaggtcacaaacaagcagtacatccagatgctcatttttatgaaggagacatccgggataaagaatttctacgttccgtatttgaaaaggaaccgattgaaggagtaatccattttgctgcaagctctttagtaggagaatctgtcgaaaaaccattgatgtatttcaacaacaacgtatacggtatgcaaatcttacttgaagtcatgcacgagttcaatgtgaataaaatcgtgttctcttctactgcagcaacttacggagaaccaaaagagtctccaatcacagaagatacaccagctaatcctaaaaatccgtatggtgaaagtaaattgatgatggaaaaaatgatgaagtggtgtgaccaagcatatggcatgcgctatgtcgctttgcgctacttcaatgtagccggagcaaaagcagatgcatctatcggagaagatcatacaccagaaacgcatcttgtcccaatcattttacaagtagctcttggtcaaagaaaagcattggctgtttatggagacgattatgatacaccagatggaacatgtatcagagattatgttcaagtagaagatttgattgctgcacatattttagctttggaatacttgaaagaaggaaatgaaagcaacttcttcaatttaggcagcagcaaaggatactcagtcaaggaaatgctagaagcagctagagaagtgacaggaaaagaaattccagcagaaatagcaccaagaagagctggagatcctagccgattagtcgcttcaagtgaaaaagcgagagaggttctgggctggaaacctgaatacacagatatcaaagcaattatcaaaacagcatgggattggcatgtcagtcatccaaatggttatgaagaataggggaatgagatatgtcaatcagtcaaacgatttgtgattttgccacacttgcgatcgaagctggcggatggatggaaatggaccgcttatatttacagaatcgtcttttagggatggtaggagaagatgctttagaaagcattgaagtaagaccagttaaggaagaatctgtagacttattggatcagcttgtcgctaaggcaagagaaaatggtgttctttcagaattgccagcagaacaagagatttttgaagcgcaattaatggattttctcacaccgccaccttcagtcgtcaatgcattctttgcacagcactattcgaaaagcccagaggaagcaactgagtatttctttaatttaagtaagaaaaatgactacatcaaaacaagagccatcgcaaaaaacatcaaatttccggcagagtcggagtatggtgaactggaaatcacaatcaatttatctaagccagaaaaagatccaaaacaaatcgcagcagaacgcgaggcggtaaaagtagactatcctacctgcatgctttgcatggaaaacgaaggatatagaggtcgcttgaactatccagcccgcaccaatcaccggattattcgaatgaatctagacggtgaaagctggggattccaatattctccttatgcttattacaatgaacattcgatcattttatcagaacaacaccgcccgatgaaaatcacaaaggaaacatttgctagactgcttcggattactgaagtcttgcctcattactttgttggttcgaatgctgacttgccgattgttggaggatcgattctttctcatgatcattatcaggcaggacgtcatgaatttcctatggcaaaagcaccgatagaaaaacttatcaaactagcagattatccgcaagtcatcgcaggagtcgtgaaatggccgatgtctgtgatccgtttgcaatcaacagagaaaaacttgctgattgaagcagctaactcagtattggaaaagtggaaagcatattcggatgaaacagtatctatcagagctttttcagcagatggtacaccacaccatacgattacgccaattgcacgaagaagggacaattactttgagttggaccttgtccttcgagacaacaatgtttcagaagaacatcctgatgggatttttcatccacataaagatgtccaacatatcaaaaaggagaacattgggttgatcgaagtaatggggcttgctgttttaccacctcgtttgaaaccagaactagtagaagtagagcatttcttattaggagaagaaaaccagatggctgaatatcatcgtccgtgggcagaacaattaaaaaaagaacatcctgatttgacgaaagatacggtcaccgatgtcgtacaaaaatctgtaggtcaggtttttgcacgtgtactggaagacgctggagtattcaagcgagatgaaaaaggacaggcagcgtttgaacgatttactgcaattttataaacgtaaaaaaggaggagagacaaatggcaacaattaaagacattgcgcagttggcaggagtttctcctgctactgtttcaagagttctcaactatgatcctgatctttccgttggcttagccacaaagcaaaaaatttttgaagcagcagaacgcttaaattatacgaaacatcgtaaaaatgcagcaaatactaagcaaacgcttcgcctgatccagtggtacgacgatacggaagagcttgaagatctttattatttatctattcgtctaggaatcgaaaaaaaggcagaagaagcaaacgttactttattgaaagaaacgtgggattccattagtgatcttccgacagatggaacgatcgcactaggaaaattcgacgaagctcagttattagaaatgaaaggatcccaaaatgccttgcttttggtagattctgatggcacttctcaaggaatcgactctctagttgtcgactttaagtcaagtgttcaaaaagtcattgaacattttgtctcccataaagcgcaacatatcgctatgcttgctggaacagaatatacgaagaaaaaccatcagcggctaaaagatcccagaattatggcatttcaacaagttttggcagaaaaaggctacgacgaaggtccaattatcgaagcagatttttctgtcgagtcaggatatcaagcagtgaagcagtatttaaaaacgaatccgcatgttcctgatgcgctttttgcagctaatgatgcattagcgattggcgcactgaaagcgattcaagaaaaaggtttagtggtaccagaagatatttctgtgatgggtttcaatgatgtcagtgtagcgaaatatgtaacgccctctctttctactgtaaaagtttataccgaatggatgggagagctagcagtggagacgattcttcaattaagtaattccaaagcaccggtttcaagaaagattattgtggaaacagagttgattattcgagaatcaacgaaataaaagatggaaaagctgtggggaaatggagtgataccgcagcttttttgtgtttcaggaaggggcaaaatttgcccgccagcagataatcatgtatcattgtactagttttgcctttggtattttcatcctcagaataaaaaagtatgctacaatggaaggcgagaatgtcatagcagaaaggatcaaatatatgattacattaggaatagatactgcaaaccaaactttggcgatcggtgtggtagaagacgaacaaattcttggacaaatacaaacaaatatcaaacgcaaccacagtgtaacactgatgcctgcaatcgaccaattgtttgcagatcttcaaataagtccaaaagacattgaccgaatcgcggtttctgatggtcccggttcttatacagggcttcgtataggtgtaacgacagcaaaaacgattgcttatacattagataaagagctagtaggagtatctagtctgaaaaccatcgcggctaattgcatcggtgtggataatattattgtgcccatgtttgatgctcgaagaaaaaatgtatacgctggggcataccgctggaaagaaaatagattagaaactgtacttgaagatgtacatatttctgcttctgatttgttcacacaactacaaaagctgaatgaagctatttatttcgtcgggagtgattgtcacaaattcttctctgaaataaaggaaatattgcctagtgcgatgattaatacagttccagcatgggatattccaagtggtgtaactgtggctcaattaggtgctttagctgaaccagttgcagagaaacaagcttttcttcctcgctatttaaaacgggtagaagcagaagaaaaatggttggagacgcacacacctggagacgaaagttatgttgaaaaaatttagagcgtatgtcagaagcttttttcaagataaaatgatttatacagaaaaaacaatcgaacaaatcgatcgtcgttacgtactaagagaattgactacagaagatatcaaagagctgctggatgtcgaacgagaagtctataatggcgaattgccatggacaaaaagtgcctttatatcagaattgaagtcaccgcttcctcatctatatctaggtatctttgataatggaagaatgattggttttatcggttcaagagcgttcggtttagattgccatatcacgaatattgccgttcgaccggcatatcagcgtaaacgaatcggttcgctgcttattgacgaaatcgagaactttgctataatgaatcgctgtgagacgatgtcattagaagtgcgtatgagtaatcaagatgcacaaagactttatcggaagttaggttttcaagcaacgacgatcaaaaaaagatattacactgaaacaaaagaagatgcattggatatgataaaacttttagaaaatgagtgagattagttgatttgcagaaaaaaagattttgatgaagcgtacttggcagaatgcgtatgggtgattagcgaaaatgcttatccacatggttcaccttggacgaaaatgcagtttttggcagacatccaacagcctcactctgattatctgcttttagttgaagataaccagatctgtggctttattggatactcgaaagtaatagatgaagtcgagatcacaaatattgctgttgcagtttcagaacaaggaaaagggcatgcacggcatttgttacaattactgattacggaacaaataaaagattcgctgcatgtttttttagaagtacgtctatctaatgaagcagcaagaaaactttatgaatcagaaaagtttcgtatattaggtaaacggaaatcatattatcgcaatccgacggaagatgcgatcattatgagcagaaagttaaaaacggagacgatgaaatgaatgaagaattgattctggcgattgaatcaagttgtgatgaaacgagtgtagcggtcgttagaaatggaacagagatcttatctaacatcgttgcttctcaaataaacagtcataaacgttttggtggcgtagttcctgaagtagctagccgccatcacgtagaacaaatcaccttatgcttggaagatgcactggtagaagctggtgtgtcggcagaagatttatcggcagtcgctgtcacttatggaccaggacttgtcggctcgttgctgattggtatttctgcagctaaggcttttgcttgggcacaccaattgccgcttattcctgtaaatcatatggcagggcatatctatgcagcccgtctggttaagccattccagtttccattgatggcacttcttgttagcggaggacatacagaattagtctatatgcaagaagatggatcatatgaaatcattggggagacaagagatgacgcagcaggagaagcttatgacaaagttggaagagtattaggtctttcttacccaagcggaaaagaaatcgatcagctagctcatcagggaaaagataattaccattttccacgagcgatgatccatgaagataattatgatttcagttttagcggattaaaaagtgcatttatcaatttggtgcataatgcacaacagcgtggagaagatctagacaaaaatgatttagcagctagttttcaagcaagtgtgatcgatgtattgattactaaaacacttcgagcttgtcaaaattatccagtcaagcaactgattgtagctggaggtgtagcggccaatcaagggttgcgtaaaggattgcaggatgctttggcaactaaactccctgaggtagaactagtgattccccctcttcgactttgtggagataatgctgcaatgattggagcagcagcacatgtggaaatgcaaaaaagaaattttgctagctatcagttgaatgctgatccaagcttggttttatctgaataaagaggttgtgaaaaatctgccctgcatcaagtaataagaacagcccaggaaaaacggcttctcatgtttttgacctggctgttcttgttaccgcgtatgcaagcttttgaacgccgtttaatcaagagttcgtaagcctgtcgtttaactctgattcacaaggaacaatttcaaaaaacagctcctcatgtttatgaacattatgacttgtgaccgaagagttgacaggtacacaccgtttaatcgaaataagggctgtgacacgcttttgtcaaagccctattttttacagcttattcatcattatccgttcctctgattgccctcactgattaatcgtttattgtcgaggaatatcgaataatctaggtcggatgaggacaagacgcttcctctagttaatctatcagtattttttgcaaacagtgaatattacataactgaaacacacatagaaaatctttgagtcttgcccagtgatctaaaactgccggatctttcagaagttttagggaggaaattaagcagtgaccctgataaatatcagggtcactgcttatttttgttcgcgttattctctcatagctggagtagtagctgtcttacagaaagtaaaacgctttttgtcataatctaacagtccggaatcacgtagttgtttgattacttgtccagcagtttcacgtgtcgtgccgctattcactgctaattcttttaaggtgatcggataaggaatggtgatatgaccatcttttgttggtacgcccaattcttctttcaaaatgaataaattttgttttacccggtcaaaggcgctagaggtcaatccgatttggatacgcaattcatgtatttcaactactttagaaattttttgtatcatatagatcaactgttcgggattttttcgtgctaatttttcatagtaggaaacaggaaggtagaatgtttcaatatcagtcatcgcttgagctgtataagtgtaggtctcttctccaaacattcctgacataggaaaaaggttatttgtattcacatagtcatagtagtaataagttgcactttcatcataacgttctaaacgaacgagtcctttggtcaagatatacaaccgttgtctgggatcaccatcgtcgaaaaggatctgtccttttttataagaacgaagaacagtatgttccttgatctgttggaactcttcatccgagaaatgttcaaaatcaggttgatatctgagttttgaaaagtgaaaatcgattttattaacacgcattaaaaagtcctctccttattgttcactatatttattgtcactttttttaaagaatttgtaaagttttaacataccaacattagaaacaagttttaatactttacaaatataatttgttattatgtaaaaaatatacaatggtattgaataatttgttttgaagcgaatgatttgtgtataaaaaacaacaataatacatatagtaaacgctaacaatgctaatataatttatttttttaatttattcaaaaaaattttttcaatgaataaatatttttttgaaagtgtatacagaataaaaaatgaataaattacgcttaaaaatagaaaaacgtttaattatttaattatcgaatattaatgtgaggaatgtctcattttgaatgagacaaaattatgaaagtgattacaaaaggaggatatcctatacatgtaatcaaaaagaaggaggcaacacaacatggataaacctattcacgttttctctgaaatagggaaattaaagacagttttactgaaaaggcctggacaagaagtggaaaatttgacaccagatattatggatcgtctgttgttcgatgatattccatatcttccgattgctcaagaagaacatgacaactttgcaaagacattgcaaaatgaaggcgtcgagactctttacttggaaaaattagcggcagaagcgattgacgcaggcaatgtcaaagaacaattcttgaataaaatgttggatgaatctcatattgcatcgaatgctgtaagagagggtcttcatgagttccttctatcaatggaaacgcaagaaatggtagataaaatcatggctggggttcgtacaaaagatatcgaagtacgttctagcagtctatacgatctgtcagcagacgatgactatccattttacatggacccaatgccaaacttgtactttacacgcgacccttccgcatcaatgggaaatgggatgacagtcaataagatgacttttgaagcacgtcgtcgtgaatcgatgtttacagaatatattttgaaacatcatccaagatttgcaaataaaggaatcgaagtatggttggatcgtgaaaatccagatcatatcgaaggcggagacgaattgatcttaagcgataaagtagtagctgttgggatttctcaacgaactaatgcgaaagctttagaaaaattagcacgccacctattcgcaaaaaattcaggatttgaaaaagtgttagcaatcaaaattccaaacaaccgtgcaatgatgcatttggataccgtatttacaatggtagatcacgataaattcactatccatccagcaattcaaagtaaagacggtaagatggatgtctttacaatcgaaccagatggtgatgatatcaagattactcattcagataacttacacgaaacgatgaaagctgctcttggattagatgatcttgtactgatcccaactggtaatggagatgagatcgttgcacctcgagaacaatggaatgatggatcaaacacattggcaatcgctccaggtgttgtagtcacttataaccgaaattatgtatcgaacgaattgcttcgtagctatggcatcaaagtgttagaaatcaattcaagtgaattgtcacgaggccgtggtggtccacgctgcatgagccaaccacttgtccgtgaagacttgaagtaatttgtttcctgacggcggtcttactgtcagctgccgtcgggatttcctctttaatcttaaataaaaacaatctaaaggagaatgtttaatatgaaagaatcagtattccaaggaagaagcttattagcagaaaaagactttacaaaagaagaattacaatatttgatcgatttttcagaacacttgaaagacttgaaaaaacgtggtatcccacatcactatctagaaggaaaaaatattgcgcttttatttgaaaaaacatctacacgtactcgttctgcatttactactgcagcgatcgatctaggtgcacatcctgaatatttaggtgcaaatgatatccaattaggtaaaaaagaatccacagaagatacagctaaagtactaggacgtatgtttgacggaatcgaattccgtggattcagtcaaaaaatggtagaggaactagcagaattctctggtgttccagtttggaatggcttgactgatgaatggcatccaacacaaatgatcgctgactttttaactatccaagaaaactttggaacagtagaaggtatcactgttgcttactgcggagatggtcgaaacaatatggctaactctttattagtcacaggtgcaattttaggagcgaatatgcgtatcgttgcaccaaaagaattacaacctgaagaagaaatcgtcaaaatggcagaaggctttgctgaaaaatccggtgcacaattgatgattaccgacgatgttgataaaggtgtagacggagcagacgtcctttattctgatgtatgggtatcaatgggtgaagaagataaattcgaagaacgtatcaaattgttgaaaccttaccaaatcaatatggaaatggtagaaaaaacacacaacacagatcgtttgatcttcttgcactgcttgccagctttccatgatacaaacactgtttacggtgaacaaatgaaagaacgctttggcatcactgaaatggaagtaacagatgaagtcttccgcagcaaatatgctcgtcaatttgaccaagcagaaaatcgtatgcactcaatcaaagcgatcatggcagcaacattaggtaacttgtttatccctcgcgtttaagcataaccacattcatctcacgaaaaaacgagtcagcattgagggaaaatcacaaaacgctggctcgttttgttatctagaaaattcggtagaactgaagaaaggacgaatgaaatggccaaacgaaaagtagttgtcgctttagggggtaatgcaatcttgtctacggatgcaagtgcaaaagcccaacaagaagcgttaatggaaacagcaaagtatttagtgaaatttatcgaacaaggagatgaattgatcatctcccacggaaatggtccgcaagtcggtaacctattgattcagcagcaagctgctgattctgagaaaacaccggcaatgcctttagatacatgtgttgcaatgacagaaggatctatcggttactggttacaaaacgccatgggcgaagtactgaaggaaaaagggatcgataaagatgtggtttctttagtcactcaagttattgtggatgaaaatgatccttcattcaaaaatccaagtaaaccagtcggtccattctacacggaagaagaagccaaagaacaaatgaatgctgactccactgtgacattcaaagaagatgctggacgtggatggagaaaagtagtcgcttcccctaaacccatctcgattaaagaagcacgtgtcatcgaaacgctggtcgatcaaggagttatcacagtctctgttggtggcggtgggattcctgttgtagaaacagctactggattagaaggacgagaagccgtaatcgataaagattttgcttcagaaaaattagccgaaatcatcgatgcggatttgctgatcgtattgacaggagtagacaatgtgtatgtcaattaccaaaaaccagatcaaaagaaattagaaactgttactgtttcagaaatgaaacaatacattgatgaaaagcaatttgctccaggaagcatgcttccgaaagtagaggcagctattgcatttgttgaagcaaaaccaaacgctaaggcaatcatcacttctttagaaaatatcgagaatcttttagcttctgaagaaggaacgattatcgtagctgattaatttgttaagtctttcgtatttacgaaatgatttatagctatccaggtggtatttcttctcctttaggccatctggattgtttttttatcagaaacgactagcctttcgtttttttttctgatataattcaagaaagtttaataagactaagatttgttgaacaagagagtacttgtatcattcttggctagcgaattcggaagtggtggaagccgaatgaagaagatacaacgaagcgcacttggagaattctgttttaaacagacggtcgtctaccgatatcagatggagctggtccttttttaggacaattggagtggtaccgcgggaaatctcgtctctagtgatggcatactaagtatgccgtcgctagagattttttttgtttaacaatcaagggagcactttaggaggaataaagatgaataataaagatcttgtcgcaaaagctgtctatgacgctgtcaaagatgatttaacactggaacaggtcgaacaattactagaaaatccaaaatcagctgaacacggagatgttgcatttccagccttttcattagcaaaagtttaccgaaaagcgccacagcaaatcgctgcagatttagcagaaaaaatcgattctgccaactttgaaaaaatcgaagttgtcggaccttacttgaactttttcatgaataaagaacttatcagcaaaaaagttttgcaaacagtagtgaaagaaaaagaacattatggggatagcaatatcgggaatcaaggaacagtaccaatcgacatgtcttctcctaatattgccaaaccaatctcaatgggacatttgcgttcgacagttatcggtaattcgatcggtttcattatggaaaaaatcggttatcagccaatccgcatcaaccatttaggtgactggggaacacagtttggaaaactgatcgtcgcttacaaaaaatggggtacagaagaagctgttaaagcagaaccaatcaatgaattgcttcgtttatatgtccaattccatgaagtagctgaaacagaaccagaattaaatgaagaagctcgtgcttggttcaaacgtctggaagaaggcgatgaagaggctattcaattatggcaatggttccgtgatgaatcgatgaaagaattcaataaaatctatgatctgctggaagtacgtttcgattcgttgaacggtgaagctttctacaatgacaagatggatgaaatcgtcaaacttttagaagaaaaacatttgctgaacgaggataaaggtgcagagatcgttgacctatctgcttatgacctgaatccagcgttgattaagaagtcagacggtgcgacactatacattacacgtgacttagctgctgcattgtaccgtaaacgtacttacgacttcaaacaatctctatatgtagtagggaatgaacaaagctatcattttaaacagttgaaagctgtcttgaaggaaatgggctttgactggtctgacgacatgcaccatattccatttggtttgatcacacaaggtggtaaaaaattatcaactcgtaaaggaaagatcgtcttattagaagaagtattaaatgaagcaatccaatctgctaaagaacaaatcagcgagaaaaaccctgatttggaaaacaaagatgctgtagctaaacaagtaggggttggggcagtcattttccacgatttgaaaaacgatcgactgaatacatttgactttaacctggaagaagttgttcgatttgaaggagaaactgggccttatgtgcaatatacacatgctcgtgcagtcagcctgttggaaaaagcaggatttgtcccttcagaaacagcagactatgcattgaatgacgataccagctgggaagtggttaaattagttcaaaaataccctgaaacggtcttgtctgctggggaaaaatacgaaccgtcagtgattgcgaaacatgcaatcaaattagcacaagcattcaacaaatactatgctcatacgaagattttagctgatgatgaacaaaaagaagcacgcttagctctagtttatgcagtgactgtattattgaaagaagaccttcgtttgctaggacttcatgcaccagataagatgtaagaaaaagagaatgtgaaatcagcgttctgatccgagtattagagaaacaaaagagaaaatagcttttcaaattttatcgttttttgagcaaataccgagagtcagctgaatgaacacccgtttagtggagaggttgtctcttaaacactgtttgtttgcaaataaggggactgtgacaaaagtcgtgtcacagctcccttttttttcgaataaacggtgttcaaaagcttgcatctgcggtaataagcctaaccaaacgaaaaatatgaggagctatttttgtttggctgttcttattacttgatgcaggacagctttttcacgacctctgattcacggtgttcaaaagcttgcatctgcggtaataagcccaatcaaacgaaaaatatgaggagctatttttgtttggctgtttttattacttgatgcaggacagctttttcacgacctctgattcacggtgttcaaaagcttgcatctgcggtaataagcctaaccaaacgaaaaatatgaggagctatttttgtttggctgttcttattacttgatgcaggacagctttttcacaacctcttattttgtataaaagtcattctggattcttgtcagcgtacaaaatgtattctgttaactcttttaaattgtttacacaaatatcagcgccaacttgttggaatctaagagcaacagactgttttaaacgatcttttttccccatctctaatttttggtactcatcataagaaatccccattagcgaactaccttcaattacacctactgtcaacactccggcatttttcccttcctggatatctgagaccgtatctccgactttgattacttcatcaaccgacttgtttttgaagtactgcatgtttttatggatcatataaggaaacggtcgaccatacccttcgacgtcttcagaagttgctatgaagtctggtgaatacccttctttttttgcggtttctgctacgattgccatcataggagcagtaaatccagtcgtggaaccaatattgatcccagcgtttctcaaccgttcgatcgtttccaatgtgtcgggtttcaaggtagaatgctgggccaaatctttaaacagataatgttcaaattgttgatacaattcctccacctctttttcctgaggtagttgtccataaatagctatccattgttctttgacagaagggagggaaagaagctgttggatatgatcccatttttaattttcccatcggttcgcggatttctttgtcagtcagttggattcctttttctagaaaagcatttctaaaagcgtggacaggagccatacagccaaagtccacagttgttcctgcccaatcaaaaattacagttttaatcattaacgttctccttatagtctttgataattgctgtcagttccaaaatatcttccggatagatctcgccaatatttccgatacgaaaacattcatgatcgctgattttcccgggatagatcacaaatccgttttgctttaaatactgataaaaatgattaaaatcaaatcgccagtccttagggtaaagaaaagaggtgatgaatggcccttgatattcttgaatgaaaggctggaaccccatctctgtcattttttgtcgtagtacatgattattggcgagataacgtgaatatcgagtttcgattcctccttctgcctctagttccttcagcgcttgttgaaaagccaaaaccgtatgggtaggggaagtgaaacgccatttgccattctcgttttccatcacgcggtactggtcatatagatcaagtgacaaacttcggctaacattttttcgtttttccagttccgctttattagcaagtacaaaagaaaagcccggaacaccttgaatacatttgtttgagctggaaatcaaaaaatcaatccctagttcggctacacgaatcggtatcccaccaaagcttgacatcgcgtccactataaacaaaagatctctttcttgtgtgacagcagcaatctcttccaaattattcaaaataccggaagtagtctcgctatggaccattgctagtgcggagatagacggattctcttcaatcagctgtgtaatcacatgagcttggaggatttgatgttccgatacctcataaacggtatagttcagtttcagacattcgcacatgttgatcattcgttgtccatatgcgccgtttgaacaaatcagtacagtatcttctggcctgatcacagaacttaataccgattctaccccgaaggagccgctaccttgcattaagaccgttgtgtatattccttccgatacttgagcaagatccagtaatttttttcttatccattgtgtaatttctttgtattcttgatcccaagtacaatgatcgatcagcatagcatttttcactgtttcagaagtcgtcaatggtccaggagttaataatttatacatatgatttcctttcatttcttttttgaaatacacaaagagcaagaagctgctcttgttaacatccaatataaatgatgattattgtgattaaatcaaggtgttgaaaaatttgaataaaaaatgatgtatttttgtaaagagtgtaaaggtttatttaataaggaaaatattgaaaataaaaaaacacgcattccatattaggaatacgtgctctgattaaaaaagtgatacttcagttggatggtgaagaaattcttctactcgttttgcgtcctcctcattttccgagatgaccatgatcgtatcgaatccagcaattgtactgacaatagagggaggtttgatctcatctaaaacagatgcaaataaatgagcattgtctggcaaggtattgacgatcgtcaaaaagtggactcgttcgactttcaatacaatgtcttcaatcatttgaaccagccgatcctcttcctcagtcctagtctcaggagttcctttttcgcgaaacaatacgaagcgggaaacgccattttcatcaggtgccttcacgatttttagatcacggatatctcgagaaatcgttgcctgcgtggcggtaacgccataatgcccaagtttgtttaatagttcttcttgcgtacggatcgggaattcttcaatgacttgtttaatcagcaaatgtctttgagctttgcgcattttctttctcctttacgaaagatttcacatgtatcataacaaaaaaaagaaggattgcccaataatattcgtcttttatacctaaaattattttatggaaaaaggataataaagaaacaaagagaaatctactgtttttcttgaattctttttatctttcaggtaaactattgaatgttgagcagaaaagtatatttgctcttgcgatacggatcttttgtctgtataatagctgagggtgctttatgcatcagcaaatccacattcttattggattgtcggtaggtgcttgaaaaagtttgccggcaaggtagaagataagaagaggaaaaataaaaccaaatcggaggaaacaaacatggcagtaatttctatgaaacaattactagaagccggcgtacactttggtcaccaaactcgtcgctggaatccaaaaatgaagaaatatatcttcacagaaagaaacggaatctacatcattgacttgcaaaaaacagttaaattagtagatgcagcttatgattacatgaagagcgttgctgaagaaggcggcgtagcattattcgtaggtacaaaaaaacaagcacaagaagcaatcaaagaagaagcaactcgtgcaggacaatacttcgttaaccatcgttggttaggcggaacattgacaaactgggatactatccaaaaacgtatcagccgtttgaaacaaatcaatgcaatggaagaagatggaacttttgaagttctacctaaaaaagaagttgctggtttgaacaaagaacgtgaacgtcttgaaaaattcttaggcggtatcgctgatatgccaagaatcccagatgtaatgtacatcgttgacccacgtaaagaacgtattgctgttcaagaagcacacaaattaaatatcccaatcgtagctatggttgatacaaactgcgatccagatgaaatcgacgtagtaatcccttcaaacgacgatgcaattcgtgccgttaaattgattacttcaaaaatggctgatgctttcatcgaaggaaaccaaggtgaagatcaagtagttgaagaagatttcacagaagaaaacacagcaacatcaatcgaagaaatcgtagatgttgttgaaggcgacaattcttcagcagaataattttgaatgatggagctgtttcaaaggctgggcgacaagcctcactctcctttgaagcagctttttttaaaaagaaaaacacacaggaggagttaaacatggcagacgttacagctaaaatggtaaaagaactacgcgaaatgactggcgtaggaatgatggatgcgaaaaaagcattagttgaagtagaaggcgacatggaaaaagcagttgatcttttacgtgaaaaaggaatggcaaaggctgcgaagaaaaatgaccgcattgcagctgaaggattggcttcagttgctgtgaaaggtaacactgcagcaatcgttgaagtaaactcagaaacagactttgtttctaaaaacgaaatgttccaagatttagtaaaagaaattgcagaacttgttgctgaaaacaaaccagcagacatggaagctgcaatgaaaatcaaaacagataaaggtacaattgaatctgacttgatcgaagcaactcaagttatcggagaaaaaatcagcttccgtcgctttgaagttgtagaaaaagacgacaatgctgcatttggtggatacttgcatatgggcggacgtattgccgtattgactgttctagatggaacaactgacgaaacagttgcaagagacgtagctatgcacgtagcagctatcaatcctcgttatgtaaacgaatcacaaattccagaagctgaattagaacatgaaaaaactgttcttacagaacaagcattgaacgaaggcaaaccagcgaatatcgttgaaaaaatggtagaaggacgcttgaagaaattcaaagcagaaatcgctttggtggaccaaccattcgttaaagatcctgatatgactgttgaaaaatacgttgcatcaaaaggcgcaactgttaaaacattcgtacgtttcgaagttggcgaaggtatcgaaaaacgcgaagataactttgtagaagaagttatgagccaagtgaaaaaataattctgttgaataacagacgggaacgcacggtttgtgcgctccctttttttaagcaaaacaagaaaaaccagtcttagagtgtcgaaatcatctaagtatggtaaaatggcaatagaaaatattggaggaatgaacatggtcacaccgaaatatcagcgtgtagtcttaaaattgagtggagaagctttagctggggatgcaggatttggaatcaaaccaccagtaatcaaagaaatcatccaagaaatcaaagaagttcacgagctgggcgttgaaatggcaatcgttgtgggcggcggaaatatctggcgcggacaaatcggagcacaaatgggcatggaacgtgctcaagctgattacatgggtatgttagctacagttatgaatgccttagctttacaggatacgttggaaaacgtgggtgtaccgacacgcgtgcaaacttcgattgaaatgcgtcaaatcgcagagccatatattcgccgtaaagcagaacgtcatttagaaaaaggacggatcgttatctttgcaggcggtaccggcaacccgtacttctcgacagacacaacagcagcattacgcgcggcagaaatcggcgcagatgttatcctgatggctaaaaacaatgtagacggtgtttattctgctgatccgaaagtagatgcaaatgcagtgaaatttgaagaactgactcatctggaagttattgccaaaggattacaagtcatggattcaactgcaagttcactaagcatggataatgatattccactgcttgtcttcaatttaaatgaacacggaaatattcgccgtgcaatcttaggcgaaaatatcggaacaactgtaagggggaaataaaaatggcagatgcaattatgacagaagcaaaagaaaaaatgaaaaaagcagcacaaaatcttcaacgtgaacttgggcaaatccgcgcaggccgtgcgaacgctagccttttggaccgtattactgtgaactactacggtgcgccaacaccattgaaccaaatggcatcaatccaaattccagaagcacgtgttttaatgatcacaccttttgacaagagcattcttcaagatgttgaaaaagctattatggcaagtgatatcggaatcagtccaaccaatgatggaaatgtcattcgcttagttatcccgcaactgacagaagaacgcagaaaagaattagctaaagatgttaaaaaagaagcagaaaatgcaaaaatcgcgattcgtaacatccgtcgtgatgcgatcgatgaatataaaaaacaacaaaaaaatggtgatattaccgaagatgatttgcgcggattagaaaaagacgtacaaacattgacagataacagcatcaaagaagtagataagatcgctgctgataaagaaaaagaattattggaagtttaataaaatcataaaaacagaggggcggatcattccgcttcctctgtttttatttatatttcttttatttaaaaattaaaaaaagaaaaaattattcagtttttaaataaaaaaacaatgatttcataggaaaaacagttagatattgctataatacttaagatagtgggaatcttttaagtataggaggaaaaagaatgttacgtttttttccgcaaaaaaacaaatatattcaagaaaaaagcgaatttcaatttaataccgatggaccaattcctcagcacattgccatcatcatggacggcaatggtcgttgggcgcaaaaccgtcgtttgccacgagttgctggccataaagaaggcatggaaacagtaaagaaagtcacaaaaaaagcatcaaggcttggagtgaaagtgttgacgctttatgccttttcgactgaaaactggaagcgaccaaaagatgaagtaagttttctcatgcaactacctgtcgacttctttgatacgttcgtaccagaattgattaaagaaaatgtcaaagttcatgtcatgggttatgaaaacgtattgccagaacatacgcaagatgctgtaagacgtgcaattgagcaaacaaaaaacaatactggaatggtattgaattttgctttgaattatggaagtagagcagagatcgtgactgctgtccaagaaattgccgaagaagtagcaaaaggagaaatacacgcagaagaaatcgatgatgaattgattgctaagcatttaatgacaggtttcttgcctaaagagttacaagatcctgagctgatgatccgtacaagtggagaagagcgaattagtaattttctgttatggcagatcgcatatagtgagctgtattttacaaaagcgctttggcctgattttgatggtgcgcatcttgaagaagcaatcgcctcttatcaaaatcgagaccgtcgattcggcggtgtaaaaaaaacagaagatgagaaaggggatcagtcatgaaacaacgtgtgatcacagcagctgtggcgctagtcttgtttattccgattatatggatcggaggcatagcggttgagcttacagcagcaatcttagcggtagtaggagtttacgagctgttccggatgaaaggattgacactcttaagttttgaaggagttttatccgccgttggtgcagtgttacttgttttgccaaaagaaagatggtttttctttcttccagagaatgtaagtacatttatgttattttatcttatagttatgattcttttaggaacatcagttatttctaaaaatacgtatacgattgatgaagcaggttttcctgtgcttgtcagcttgtatgtgggaataggtttccagaattttgtcaatgcacgaacagaaagcttggctgttttgatatttggtctatttattgtttgggcaactgatatcggagcatatatggttggtcgacgttatggtcagcataagttaagtcctgatatttcgcccaacaaaacgattgaaggtgcgctcggtggtatcggtagtgctgttgtagtcgcatttctttatttattgctatacccagcaaaagaactattcaatcatggtatgtttgtcatgcttctgatgacgattattttttcagcagtcggacaatttggtgatttggtcgaatctgcaatcaaacgtcattatgatgtgaaagactcgggaaatatcttaccaggccatggtggaatcttagaccgtttcgacagtttgctgtttgtatttcctatcatgcatttatttggcattatttagtaagtatacctgcgtttctttgtgaatttcataaaagacgcaggtttttatttttcattatattgatactattggtgtctttggtatactatggtaaaattatagtgttttatcgttgttttataaaaaacacaaaaaacaagtaaaggagaaaaaagctatgaaaacgattctgacatttatcatcgtttttggtatattagtgattgttcatgagtttggtcatttcttctttgcgaaacgatcaggaatcctcgttcgcgaatttgctatcggtatgggtccgaaaatttatgggcatcaagcaaaagacgggacaacatatacgcttcgcctattacctattggcggttatgttcgaatggcaggcaatggggatgatgaaacagaaatggcaccaggaatgcctctttctcttttactaaattctgacggcatcgtagagaagataaatttaagtaagaaaatccaattgacaaatgctatcccgatggaattgagccgttatgatttagaagatgagctgactatcactggttatgtgaatggagacgaaacagaagtagtaacctaccctgttgatcacgatgcgacgattattgaaaacgacggaacagaaatcagaattgcgccaaaagacgtacagttccaatcggctaaattgtggcagcgtatgctgaccaactttgctggacccatgaataactttattttggcaatcgtgttattcatcattctggcatttatgcaaggtggtgttcaagtgacgaacactaatcgcgtaggagagatcatgcctaatggagctgcggcagaagcaggcttaaaagaaaatgatgaggtagtcagtgtggacggaaaagaaatccattcatggaatgatctgacaacagtcattaagaaaaatccaggtaaaacattagactttaagatcgaacgagaaggtcaggtgcaatctgtcgacgtgacaccgaaatctgtagagtcaaatggcgaaaaagttggccaacttggtataaaagccccaatgaatacaggttttatggataagatcattggagggacgcgtcaagctttcagcggttcattggaaattttcaaagccttaggatcactatttacaggtttcagtttagataaattaggcggacctgtcatgatgtaccaattgtcttcagaagcagcaaatcaaggtgtaacaactgttattagtttgatggcgcttctttcaatgaatctcggaatcgtcaatctgcttccgattcctgccttagatggcgggaaattagtcttgaatatttttgaagggattcgcgggaaaccattaagtcaagaaaaagaaggaatattgacattagctggctttggatttttaatgttgttgatggtgctagttacatggaacgatattcaacgattctttttctagaaaaagttgacaaatagggtataataacaaacgataactattttgaggaaataaaggagtatatagaatgagacaatcaaaaatgttgattccaacattacgcgaagttccaaatgatgcagaagtattaagccatcaaatcttgctaagagctggatatatccgccaagtatcagcgggtatttattcatatctgccattagcaaatcgtgtattggaaaaactgaaacgcattatgcgggaagaatttgaaaaaatcggagcggtagaaatgctgatgcctgccatcttgccagcagaactttgggaagaatccgggcgttacgaaacatatggaccaaacttgtatcgtttcaaagaccgcaatgatcgaaaaatgatccttggaccaactcacgaagaaacttttactgatttgatgcgtaatgaaatcaattcatataagaaattacctttaaatctttatcaaatccaacctaaatatcgtgacgaaaaacgacctcgcttcggtttgcttcgcggaagagagtttatcatgaaagatgcatattctttccatgcaacggaagaaagtttggacgagacatataaagattacgaaaaagcctataccgaagtattcaagcgttgtggcttagaatttcgctcgatcatcggagacggcggcgcaatgggcgggaaagactcaaaagaattcatggcgatctcagaaatcggggaggatacgatctgttattcgactgaaagtgattatgctgcaaacttggagatggctacaagctactatgtatcaaaaaaatcgcatgaaacacagcttgaattggagaaagtagctacacctaacgtaaaatcaattgacgaagtagcagatttcttttctgttgaacctcaaaaaatcatcaagtctgtattgttcattgcggatgaacaacctgtccttgttttggtacgcggagaccatgaagtcaatgacgtaaaactgaaaaactttttatctgctgactttttagaagaagcaacagaagaagaagcacaaaaatatctaggtgctgagtttggttctgtcggaccagtcggtgtttcagatgacgtaaaagtatatgcagaccgttatgtccaagatttagcgaatgccattactggagcgaacgaaacaggattccactataaaaatgtgaatccagaacgcgatttcactgtactttcttatgaagatcttcgttttgtacaagaaggagatccttcaccagacaacaatggtgttcttgcctttactcgaggaatcgaaatcggacatatcttcaaaatcggcactcgttacagtgaatctatgggagcaactgtactagacgaaaatggacgagaaaaatttgtgattatgggctgttatggtatcggtgtaagtcgtttattatcagcaatcgtagaacaacattcagatgaacaaggaatcaattggccaaaaggaattgcgccatttgatctgcatatcgtccaaatgaatctaaaagacgaataccaaacaaacctgacgaatgaactagaagaagcgatgacaaaagctggctatgaagtactggttgatgacagaaatgaacgcgcaggagtgaaattcgcggattctgatttgattggctgtccaatcagaatcactgtcggtaaaaaagcagtggatggaatcgtagaagtgaaaatcaagaaaactggcgaaatggttgaagtacgtaaagaagaattggcgaatactttaccaatcctcttgaaccaaggcgaataataagcgttaaaacacagaaaataaaaatagctgaatcagctgtttttgacaatctgatgattcgcttttaaaattggaactgcgatttgaatcgcagttccaattttttaatgtaaaactcagaaaaaacgagtatactaaaaggtactgaaaaagaagaggataagatgcgatcaattgcattgtttctcatcagaaagggcgtatatctttgtcagaaaaacgagatttatttgaaaaactgttggaacaaatccaactagaggaagcagaaagaaatcatccactgcttactgctggtgaaatggatagtgtagtggtccatcgtaaatcgcgtttatgggaatttacgctgcatttttccaaaattttgcctattatgctatatcggtcattgactcagcatctgactatcgcttttaaagatattgcacaagtcaaactgaatatcttagcagatgaccagacattcgatgaacagctcttgcaagattactgggcccaagctttggaaaatcagcaatgcgatacaccactagcacagcaagtattgaaaacgcaggtacctgtgataaaagatcgtaaagtcatcttgccaatcgacagtacaggagctatttcttatttgaagcaacaatacttgccattagtagaagagttgttcgtcagttacggtttcccaaaatttcgtatcgaaccagaagtggatgagcagcaagcggaacgtgtattgaaactttttgaagaacgcaaacaagaacaggcagaagcctttatgaagcaagcagctgaaagtctagttgtccacgaacaaaagaaaaaggaaagaaaagagcaatcgccagctcttgaaggacccatccagctaggacgaaatattccagccgatgaaccaacgacaccaatgatcagtatcgttgaagaagaacgaagagtcacacttgaggggtacgtattcgacaaagaagtcagagaactacgttcaaaacgcaagatcttgactttgaaaatcacagattatacttcatcatttatcgtcaaaaaattctcgaacggcgaaaaagatgaacaagtatttgatgcgatcagtgtcggtagctggttaaaggtacgaggaagtattcaagaagatacgtttgtccgtgatttggtcatgaatgcgcaagatatcatagaagtcaaacatacacctcgcaaagattatgctcctgaaggggaaaaacgagtagagcttcatgttcatagcaatatgagtacgatggatgcaacaaacagcatctctgatcttgtggcacaagcagggaaatggggacaccgagctatcgccattacagaccacggtggtgcgcaagcctttccggaagcacatagtgctggaaaaaaagcaggtgtgaaaatcttatacggcgtggaagcgaatgtcgtagatgatggtgtcccaattgcttataatgatgcacatgaagcattgagtgaagccacatatgtcgtatttgacgtggaaacgacaggattgtctgcagtatatgacacgatcatcgagctagccgcagtcaaaatgtataaaggaaatgtgatcgaaagctttgatgaatttatcgatccaggacatcctttgtcacgaacaacggtagatctgactggtatcacggatgaaatggttcgaggatcaaagtcggaagaagaagtattgcggatgttccttgaattttcaaaagatacaattttggtagcccacaacgcggcttttgatatggggttcttgaatactagctacgcaaggtatggtattcctgaagcggccaatccagtcattgatacgttggaattagctagatatctgtatcctcaattcaaacgtttcggattaggtgtgttatctaaaaaatttggtgtcagcttggaacagcatcaccgagcaatctatgatgctgaagcaactggtcacttagcatggatctttgtgaaagaggcaatggacaatcataacatgctttatcatgatcagctaaatgagcatatcggagaaggagattcttacaaaagggctcgaccttttcatgtaacgattttagcaaaaaatcaggcaggactgaaagatttgttcaaactgatttcaatgtcgaatgtcgaatacttcgaacgcgtcccacgaataccacgctcccaattgaaaaagatgcgtgaaaatctattgatcggctcagcttgtgataagggagaaatattcgaagccatgatgcaaaaaggggtagaagaggcaagaaaccgagcaaaattctacgattatattgaagttatgccaaaagcggtctatgcgcctttgatcgagcaagaattggtaaaaaatgaacatgatttggaagaaattatccaaaatttggtagaaatcggaaaaagtttggataaaatcgttgttgcaacaggtaatgtacattatctgaacgaagaagatgccatttatcgaaaaattttgatcaattctatgggcggagcgaatccgttgaatcgtcatagtttaccggatgtccatttccgaacaaccgatgagatgctaactgcatttcactttttaggggaagaaacagcgaaagagatcgtagtagaaaatacgaataaaatcgcagatatctgcgaagaagtgattccagtcaaagatgaactttatacaccgaagattccaggttcagaagatgaaatatcagaattgagttacaccaaagcaaaacaaatgtacggagatccgttacctgagatcattcaaaaacgattagaaaaagagttgaattctattaatggtaatggcttctcggttatttatctgatcgcccaaaaattagtgcataaaagtaatgaagatggctatctagtaggttcacgtggctctgttggctctagctttgttgcgacgatgacaggaatcactgaagttaatccattagcccctcattattattgtccagagtgccaatattccgagttttttgaagatggcacgtatggttctggatttgacatgccagaaaaacaatgtccaaaatgtggtgcacgcttaaacaaagacggtcatgatattccatttgagacatttttaggattccatggagacaaagtgcccgatattgatttgaacttctcaggtgattatcaagcagaagcccataactatacgaaagtattgtttggcgaagactatgtttaccgtgccggaacgattggtacagtcgccgacaaaacagcatatggctatgtaaaaggatacgaaagggacaataatctgcagtttcgaagtgcagaagtcgacagattagcaaaaggcgctactggagtcaaacggacaaccggccagcatccaggggggatcatcgttattcccgattatatggatgtctatgattttacgccgatccaatatccagcagacgatcaaaattcagaatggaaaacgactcattttgatttccactcgattcacgataatgtattgaaattggatattctagggcatgatgacccaactgttattcggatgcttcaagatttatcagggatcgatccacaaacgatccctacggatgacccggaagtgatgcggatatttgccggtcctgaagtacttggagtaactcaggaacaaatttattccaaaacagggacattaggtattccagaattcggcactcgttttgttcgaggaatgttagaagaaacgcatcctacaacttttgcagaactactgcaaatttccggactatctcatggtacagacgtatggttaggaaatgcggaagaattgattcgacgaggagatgcgacactggcggaagtaatcggctgtcgtgatgatattatggtttatttgatccatgctggattagatagcgggatggcatttaaaatcatggaaactgttcgtaaaggacaatggaacaagatccctgatgaattgcgagaaacctatctatcggctatgaaagaaaataatgtgcccgactggtatatcgattcttgttcaaaaatcaaatatatgtttccgaaagcccatgctgcagcttacgtattgatggctcttcgtgtcgcttatttcaaggtttatttccctattttgtattactgtgcatacttttctgtacgtgcagacgactttgatctagtctccatgtgcaaaggaaaagatgctgtgaaacaagcaatgaaagaaatcacggacaaaggattagatgcttccgtaaaagaaaagaatcaactgacagtgctggagttagccaatgaaatgctggaacgaggattcaaatttggaatgattgatttgtataaatcggatgccgttaactttgttattgaaggtgatacgttgatcgcaccatttagagctgtcccaagtttgggaaccaacgtggcaaaacaaatcgttgaagcaagaaaagacggtccatttttatccaaagaagatcttgccacccgcggtaaagtttcaaaaacattgatcgaatatatgaacgacaatggcgtattgaaagatctaccagatgaaaatcaattatcgttattcgatatgctataagcatctgttttcctgtctgcttgtaattttaagcagagtatggtatagttcttataggtaatgatactaactgtgagtgagcggatttttcgctcactctttttaatggaattacgcacttaatttttaaggaggcgaaacttttgagtagcgtcgttgaaacagtcacagaaatggtgacaccgattttagatgaacaaaattttgaacttgtcgaagtcgaatttataaaagaaggaaaaagctggttcttacgagtatttattgacaaagaaggcggtatcgatatcgaagaatgcgcctttgtcagtgagaaactgagtgaaaaacttgatgcagcagatccagatccgattcctcaagcttatttcctggaggtatcctccccgggagcagagcggccattgaaaaaagaaagcgactatgaaaaggcacttggtgattatgtccatgtctccttataccaaccagtagatggcgaaaaacaatatgaaggatttcttcaatcatttgatgctgaacagcttacattgaaaatacgcataaaaacacgagaaaaagaattgacttttgaccgaaaaaatattgcaaaagctcgcttagctatccaattttaatcacggagaggaatcagaaaaaaatgagtaaagaaatgttaaatgcgttagacgctttagaagctgaaaaagggatctcaaaagaaatcgtgatcgatgctttagaagcagcattggtttctgcatacaaacgtcactatggccaagcacaaaacgtcgaagtggaatttgatcagaaaaaaggaaagatccatgtctatgcggtaaaagaagtaacggaagaagtgatggattcacagttggaagtctcattgaaagatgcacttttaatcaatccagcatatgagatcggtgatacgatccgttttgaagtaacaccaaaagattttggacggatcgctgcgcaaacggctaaacaagttattttacagcgtgtacgtgaagcagaaagaacgattatttataacgaattcagtgcttatgaaaaagacatcatgcaaggaatcgtcgaacgccaggataaacgttatatttatgtcaatcttggtaaaattgaggcagttctttctaaacaagatcaaatgccaaatgaattttatcaaccacatgatcgaatcaaagtttatgtttcccgagtagaaaatacgtctaaaggtccgcaagtatttgttagccgcagccatccagacctattgcgtcgcttatttgaacaagaagtaccagaagtctatgatggaatcgttgaaattgtcagcatcgcccgtgaagctggcgatcgttcaaaagtggcagttcgctcaaatgatccaaatatcgatgcagtcggtacatgtgtcgggccaaagggacaacgagttcaagcaatcgtcaatgaattaaaaggcgaaaacatggatatcgtcgaatggaatgaagatccagctgtattcatcgcaaatgcattgaatcctgcacaagtcatggatgtgatcttcgatgagacaaatccaaaggcctgcacagttgtcgttccagactaccaattatcgctagcaatcggtaaacgcggacaaaatgcacgtttagctgctaaattgactaaccataaaatcgatatcaaatcagaatctgacatgacggaattttatgaaaatcaagaacaacaaaaagaaacagaagaactgcatgatgaagcaatcgttcagtcagatttaacagacgatgaatatgaaacaattgcattcaacaatgaaacggtcgaagaaaaaccagaagcttaactttagtaaggaggcaaagagatgaaacaaaggaaaattcctttacgcaaatccgtggtttcaggtgaaatgaaacctaaaaaagagatggtccgaatcacccgttcaaaagaaggggaagtatcgatcgatccaactggaaaaatgcctggacgaggagcgtatgtctcacttgagccggaagaagtacaacaagcttgggataaaaaaattctcgatcgagtactcgaaacaacattaacagatgagttttatcaagaacttcttgactatgtcactcaccaaaaagcacgtaaagagttatttggaaaatgaatacagttaatcggcaaaaagccatgaatctcatcggtctagcgatgcgcgcgggaaaactaatcacgggtgaagaactgaccattgctgaaatccgcaaacaaaaagcaaaattggtgtttgtggcaaccgatgcaagtgagaatacaagaaaaaagataaaagataagagttcatattatgaagttccttgctttgagctattttctgaagcagaaatcacgcagatgatcggaaaacctcgcaaggtattcggaataatggatgccggatttgcgaagaagaccaaggagctaattgaaggttaggaaggtgattgcatgggcaacaaaagaatctatgaattagcaaaagaactcaaaaaatctagtaaagacgtcgtggaaaaagcacaacaacttggcatcgatgtgaaaaaccatatgggtacgattactagcagtgatgagaagaaattgcaacaagcgttcaaaaacccaagcacgaaacaacaagctgcacaacaagcaagcagaaaaccagccaatcaacagccgaacgatcaacgtaaaaaagaaacaacgaacaatcaacaaaaaaataaaaataaccgcagttatcaagatcgcggtcaagggagcggtcaagtgaatcaaggaaaaaaaccaacaacaaaccaaaataatacgggaaataccagcagccaaaatcgtcaaggaacgagccaaggcggcaatcaaaaccgtactaacaataacaacaaaccaaacaataacaatcgcggcaaatttaataataataaccgtaatcgttataataaaaaaggtaaaaaaggcaaacagcaacaatcaactaaaccagctgtaccaccacgcaaattccgtgaattgccagatgtattagagtatactgaaggtatgaacgtagcagatattgcgaaaaaaattcatcgtgagccagcagaaatcattaaaaaattatttatgcttggtgtcatggtcaatcaaaaccaagcactggataaagatacgattgaactgttagcgacggactatggcatggaaccacaagaaaaagtccaagttgacattgctgatatcgataaattcttcgaggcagaagaagtcgatccagataaattagtctcacgtccgccagtagtaacgattatgggacacgtagaccacgggaaaacaaccttattggatacattgcgccattcacgtgtaacaagcggcgaagccggcggaatcacacagcatatcggtgcctaccagatcgatattgatggtaaaccaatcactttcttggatacaccaggacatgcggcctttacaagtatgcgtgcacgtggagcaagtatcacagatatcacgatcttagttgttgctgcagatgatggcgtcatgccacaaacagttgaagcaatcaaccatgccaaagctgcaggcgttccaatcatcgtcgctgtaaataaaattgataaaccaggtgcaaatcctcagcatgttatgcaagaattaagtgagtatgaattaattcctgaagcatggggtggagaaacgatttttgttgagatctcagcgaaattcggccaaaacatcgaagaattgctggaaatgatcctgttagtcgcagaagtagaagatttaaaagcagatccaacacaacgcgcaatcggaacagtgatcgaagcacgtcttgataaaggtaaaggtcctgtgtcaaccttacttgtccaagaaggaacacttcacgttggtgacccaatcgttgtcggtaatacttacggacgtgtccgtgtaatgacaaacgatcttggccgtcgcgataaagaagcaggacctgcaacgccagtagaaatcactggcttgaatgatgtacctcaagcaggtgaccgtttcgtagtcttcgaagacgaaaagacagcacgtgcagcgggtgaagaacgcgcaaaacgtgcattattggaaaaccgtgctgccacaagccgtgtgactttggacaacttatttgaaagcctgaaagaaggcgaattgaaagaagttaacgtaatcatcaaagcagatgtacaaggttcagcagaagcactggctgcatcattgaagaagattgatgtggaaggtgtccgtgtaaaaatcgtccattcagctgtcggagcaatcaatgaaagtgatgtaaccttagcagcagccagcaacgctattatcatcggtttcaacgttcgtcctacaccgcaggcaaaagtgcaagctgatactgaagaagtcgatattcgtcttcaccgtatcatctataaagccatcgaagaaatcgaaactgcgatgaaagggatgctagaccctgaatttgaagaaaaaatcaccggtcaaatgatcgttcgtgaaaccttcaaagtttctaaagttggtacgattgcaggtgcctatgtaacagaaggatatattcgtagagatagcggtgtccgtgtaatccgtgacggaatcgtaatctatgaaggccaacttgcaagtctgaaacgattcaaagatgacgtgaaagaagtcaaaatgggttatgaatgtggtgcgatgattgaaaaattcaatgacatcaaagtagatgacgtaattgaaggatttatcatggaagaagtcaaaaatgactaaaaactgataaaaggaggccaatcattatggctaactaccgtgatcgccgagtcggtcaagaaatcttaaaagaagtcaatgatattttgcgcaaaaaggtccgtgaccctcgtgtggagaacgtaacgatcacagatgtgaaagttacgggggacttacagcaagcaacgatctattacagcattttatctgacttagcatcagataagaaaaaagcacaagatggattgaataaagcatcaggattgattcgtcgagagttagggcacaatctaagtatttataagacacctgaattgttctttgaacttgatgaatcagttgtctatgggaaccatatcgatgaattgcttcgcgacttgaacaaagactaatcaaaaaatcccgcaaatcctgtgaaatcaggggttgcgggatttttttgttttcattaagacgtattacctaagagttccatgactttagtctggtagcgtgtcagctaaccaaaaaagagaaaaagaaaagtaaaaaattcgactttcttttttctatagtatataaatttttgcatatagataaagatcaagataccgataacggaagctagattgtaatctattttagtgacagtcaggtatagccaagtaactagaagatcagtggaacctgcaccataaaagtttgagtttgtcggtccgttgacagttaaaagaaaaatcacgttgaagttattgatatttccgattacgccgcttcgatttggtcacgatccaaattttggataatccctgtagaaattagcatagtagctgggataccaattcacatattgacaaagataacagagacttttacataaaacggatcaatcaggaaaggaattgctcgatccagccccagttttccaacaatgtgttaactggcctagcgtcattcagcaaattatgcatgatgaggagcgaaatgaactgcggaacagccattgtgataacgacaagttttttggatcaatgtaaaaaacgtcagcgaaaggaaaaatttcgtggttttttatacctgttcatttggctagatataaaatccaaacaaatgaacagaagtgcttattaggtttcaattgggagtatctgcgctagaataagagtaataatgaaaaggagtgttatgtatggattattctagtaaagaatactttgataaaatgacggcttggtggcgtgctgctaattatctttctgttgggcaactttatcttaaagataaccccttactgagacgtacactgaaaccagaagatgtcaaaaaacatccaatcggtcattggggaacgattcctggccaaaattttatttatgtccatttgaaccgagtcatcaataaatatgatttgaacatgttttatatcgaagggccaggacacggcggacaagtcatggtatcgaatgcttatttagatggaagttacacagagatctatccagaagtaacggaagatgagacaggaatgcaaaaattattcaagcgattttcatttcctggaggcattgcttctcatgcagcaccagaaacaccaggttctatccatgaaggcggagagcttggatactctctttcacatgcagtcggagctgtattagacaatcctgaagtaatctctgctgtcgtgattggtgatggtgaagcagaaaccggtcctttagctggaagctggttctcaaatgtctttatcaatccagtgatagatggagctgttttaccgatccttcatttaaatggtgcaaaaatagccaacccaacgatcttggcacgtaaatcagatggagaattagcaaattactttaacggacttggctgggagcctttctttattgaaggaaatgatccagaaaaattaaatcctgttatggctgaaaaaatggatcaagcaatcgagaaaatcaaatccatccaaaaagaagctcgcctgaagacagcaacagatgtcgtgatgccaaaatggccagtattgatcgtacgcacaccaaaaggatggaccggtccaaaagaatgggacggggaaccaattgaaggaaccttccgagcacaccaagtaccgattcctgtagatcaagaacatatggatcatgcagatgctttactccgttggctgaaatcctatgaaccagaaaaattatttgatgcacaaggacgtattttagaagaaatcagagaaattgcgcctactggtgaccaaagaatggcaaaaaatcctatcaccaatggtggaatcgatccaagaccgcttattatgccagattggaaaaaatatactttgcaatttgaaaaaccaggctccgttaaagcagaagatatgaccgaacttggtaaattcgttcgcgagatcattgagaaaaatccagaaaatttccgtatatttggaccagatgaaacaaaatcaaaccgattgaatcaagttttcaaaacgacaaatcgccaatggatggaaaaaatcgaaccagaaaatgatgaatggctttcgccatctggtcgcgtcatcgacagtcaattatcggaacaccaagatgaagggttcttagaagggtacgttctgactggacggcatggtttttttgcaagttacgaatcattcttgcgagtggttgactctatgttgactcagcacttcaaatggatacggaaatcacatgacctttcttggcgaaaagattatccttcgctgaatctcattgcaagctcaacagtcttccagcaagatcacaatggatatagccaccaagatccaggaatattgacacatttggcagaaaagaaggcggagttcatccgtgaatatctgcctgcggatgcaaatacattgctcgcagtcatggataaagcattccgctcgtcagaaaaaatcaatttgatcatctcttccaaacatccgcgtgctcaattttactcagcagaagaagcagccgtcttagtgaatgaaggcttgaaaatcattgattgggcttcgacagcaaaagaggaggaacctgaattggtcattgctgctgcaggaacggaatctaacttagaagcattagcagctgtaactttgctgctggaagaattcccaaaactaaaaattcggttcatcaatgtcgtagatttattgaaattacgtcatccaagtcaagatccgcgtgggttgagcgatgaagaatttgatcaatattttacaaaagacaaaccgatcttatttgctttccacggttatgaaacattggtccgcacgattttctttgatcgtcataaccatcatttaatgattcatggctacaaagaaaatggagatatcacgacaccatttgacatgcgtgtagtaaatgaacttgatcgttatcatttggcaaaagacgcagctttaaaaatcaaaggaagtcaagcagaagattttgcgaaaaaaatggatcagaaattacaagaacatcaaaactatattcgtgaaaatggtattgatctgccagaagtattggattggaaatggaaaaatcttgaccaataaaatgataaaatcgatcccgcaaaacagaattttttacattgattaagaaactgaaaaaataaataaaaaaaacggaaaaaagactggaagaatggacagtcttttttttcgtttttgggaagtgaaaaccaaactatttacctgtaagccacccataaatccaatcaaatggtgcaaagaaaaaatcttccattctattccctcctttaaaaaaagcataacatgatttctatttacgtgagcatgaattttgttacgtttttattgccgaaaaataaaaaccgttcattatgatgtcaaattcgtcagtaattgatgcaatgtgttataataattcagttaaatcaaaaatgaaatggagaaaagacatggacgggttattacctttatggaaagaacgcggaatgacaagtcatgattgcgtattcaaattaagaaaaatcttacatacgaaaaaaatcggacatgggggtacgcttgacccagacgtagacggtgtgttgcccatttgtattggaaaagccacaaaagttatcgaatatttgacagattctgggaaaatctatgtaggcgagatgactctaggtttcagtacaacgacggaagatcgatccggagaacgggtagaaacaaaaccagtagatatgtctttatctgaagaaaaaatagatgaagtgatggcttcatttattggtgagatcacccagataccaccaatgtactcagcggtaaaagtcaacggtaagcggttatatgaatatgcccgcaataatgaaacagtggagcgtcctgttagaaaggctcagatttaccgttttatccggacaagtgaattgacaagagacgaagtgacaggaaccatttcttggcgcttcgaagtagaatgcgggaaaggaacctatgtccgcacattagctgtagatacaggcaagaaacttggttaccctgcgcacatgtctgatctgacccgaacagcaagtgccggtatgtcccagaaggatgctctgacattagaagaagtagctcaagctgtgaaaaatgggacaatcgatgattgtttgctgccaatagaaaaaggagtggaacggttcaaacgagtagatattactgatgaagtatggcagaaagtaaaaaacggtatgagacttaattatactgtatttgcgctcccagaaatgccgtcagaagaaattgctttgttttataaaggcaaagttgtcagtatctatcagccaaacccgaaagaaaaaaacaaattaaaacctagtaaagtattgagaaatgaggaataacgaatgaatatcatcaagatcagacatccttaccaatcagaacaaattccagaagacgatgtcgttttagtactgggattttttgacggcgtgcatattggacaccagaaagtcataaagacaggtatggaaattgcacaaaaagaaggattgaaattagcattgatgactttcaatcagcatccatcgattgtctttaaaaagatcgatcctagcagcgtgaaatatttgactagccttaagcaaaaagaagaaaaaatggccgctttgggtatagattatttatatgaagttgattttacttcttcttttgctcatttagcgccgcaggaatttgttgatcaatacatcgtagggttacatgcaaaatatgctgtttccggttttgattatacgtatggaccaaaagacattgcagatgttgctcattttcctgaatatgccaaaggaagattcaaaatcgtcacagtttctaaagaagaagaacaaggtgaaaaaatcagctctacccgtattcgaggattactagacagcggacaagtaaaagaagcagcaaaactattaggttgcacatatgaggtagaaggggtagttgtccatggcgatgcacgaggcagactactaggattccctacagcaaatgtcaaagtaaagagcacagttcatttgcctaaagaaggtgtttatgtatcggaaataaaaattggggaaacttggtatccagccatgggttcaattggacataatgatacattcggtgaaggacgggaactgactgtagagttgtacattttggactttaatcaagatatctatggtgaacatgtcgcagtacgctggaatcaatttttaagagatcaagtgaaattttctagtgtagaggaattgattgaacaactcaaagaggatgaacaagcaacagctgaatatttttctcagcaataaaacattatgcataaaatctcttgtttatgtataactagcaattacaataaaatgggtgataaataagcccaggaaaggggctgtgacaaaagtcttgtcacagccttttttttcgaataaacggtgttccagaagtagcttcttcggaaataagccgaaatttcacaaaaatttgagaagtaatttttgtaaattacttcttatttcttgaagctggccacttctgtcacaacctctttctttatagaaataaaaggacaatagcaatttatgaaaacgattgctagagcgtatcatttgctttagactatatatcttggtgtacactcactttaaggcggaaataaaagatatccgtaataacaggtttaggtataaaaaaggagtgggtactatgtataaggaattagaaaacaaagtcgcagtagtaactggtggctcaaaggggattggaacagcgattgctcaacgattcgggaaagaaaaaatgaatgtagtcgtcaactataattcggataaagaaggagcagaaaaagcagtcaaagcaatcgaagaggcaggcggaaaagcagtctctgtacaagcagatgtcagttctgaagaaggaatacagcgtttacttgatacggctttagaaaattttgggacactggacgtttgggttaataatgctgggatggaaaatcagcatccaacccatgaacttagccttgaagattgggaaagagtattaaaagtcaatttgactggcgtttttatcggaacgaaagcggctttaaattactttacagagaatgataaaaaaggaaatatcatcaatatgtcttctgttcatgaacaaatcccatggccaacgtttgctcattacgctgcttcaaaaggcggagtaaaactattcaccgaaacggtagcaatggagtacgcaccaaagggaatcagaatcaatagtataggacctggtgctatccgtacacctattaatgcggcaaaatttgatgatcctgcacaaaaagaactcttggaaagtatgatcccactaggacgcgtaggtgaaccaaaagaaatagcggcgacagctgcatggttggcttcagacgaatccagttatgttacaggtattacactatttgcagatggtgggatgactttatatccttctttccaaggtggaaaaggataagggtgaataaaaatgggtttattgattgcattgatcccggcagttgggtgggggatccagccactgattttgaaaaagattggtggcagaccaacaaatgagatattaggaactggtattggagccgtgctcgttggcttacttgttcaattattcgcttctccagctggtatttcagtgactacatttttgattagtttactttctggtgcattctgggtcatcggacaaacaggacagtatacatctttcaacttgattggtgtttctaaaacgatgcctatctcgactgcattacagttagtcggaacctcattgattggtgtcttcgcttttggagaatggtctggaagtatgggaaaaatcattggtgcagcagcaatcattcttcttgtatttggttctgctttaacggcaatcagtgatgatcctggaaaaaaaggcggtatcacaaaaggaatcagtctattagcatcaacaagtattggttattgggtttacagtgcattgcccaaactagtggatgcaagcggactttccattttctttccgcaaatgatcggtgtctttttaggggcagtgatttatgtgattttccgaaaaccaaccgcattttctgaagacaagagttggaaagcaacaatagttggagccatcttcagtgtgtcagcattggcttatattttttcagcaaatgaaaatggggttgctactgcatatatcattacacagctaaacgtagttatctctacattaggcggtatgtacatcctgcatgaaaataagacaccaaaagaaaaaaaattaacgattatcggattattgctgatcgtagtaggaagcatggtcacggtctttatttgaggagaaagatggtaaaatctcatttattaaaaaaatatttgtttgaaccaaacagtaagtacttataaaaaaatagcgctagaatttccaacatctctggaatttctagcgctttttaattgtttaagatacaagggaaatatctgtctgcatcaataatttttcattgatccattgactaaagtttacgacataattgaagttaccaccgattagtatctccgcatgattgtctttataaagatcgtattgtaaaagacggtcttttttatttgcgtaaacatcgttatggtactggactaattgttctcggaattgattgattgctgtaaaatcacgatactgaaggttgaaacgcatcgtgattggtgcatttagcatgaatcgctgcatttcttttgctgcttcctctgcttgatctccgtataggaactcaaaaagattacgttcagaaaatttccattgcccgccaacctttgttccttttagttttccttcatgaagataatttctgatagaacgtgtagtaacacctaattgttcggctaattcatttactgagtaaaaatctttcaatgttcaccctcctatgtgaatggttctactgacttagttgatatttgcttaatcacgaaatgtagaaagaacgattttaattaaggtcattgtaaaaatcaagtcagaaaattctaacttttctttctctaaagaaattcgttctctcctaaagtgatattatatttaaatatacctgaaaataatgggcagtattatgaaagatcactgatattttctcgtattttttccttattcaaaagttttgcaggaaaattgctgaaaaaataattttactaagtggaaaattcaaagccattcaatcagtgatttttttcagcacaagaaagactccttataaaaatagcagatactttgtcaattaagtgtttaaccagggatgataaaaaggataggattgaacaaaacctgtataagctgatgaatagtttcctcgccagtaaaaggtttattcgtataaagctttatcgccaaaatttatcatgaccttttttatcttcaatattaaatgaaatcaattgttcaatcaattcccagttgattacacttttccaaggaactttgatgacgttatccgtatatacgtagcctgcttcttggatatttttttcaagggcacgaatcgctgctttttccggtgcgatagaaaaatgatttttagcaaaactaaatgcaataataaaggtaccatggtcagtaaacataggttggttccattttacagttgtgtctagctggggatacgtttctgttatcttagcaaaaaggtctttgatcttttgttgatgttctttttctttgatctgattgatgatcggctgaaatttttccattctaaaacgcctccattaagtggtttgatttattttaccagaaaaacaatagttatgtataaaaaacgaacaaaacacaagtaatgttgtaaccgctatatttatatgataagatgtctcaaataataaaatagaaaagagacataaaaatgattgacttgacaaagaaattcttacacgaaaatatatattttgagttgtatcatcatcgagccatttatacaaatgaagatgctttggtaataaagaaagaacaaggatttacaggtacagagaccaaaagcttattcttaaaagataaaaaagataataactacgtatatctgacttttactacgaaacaaacggatttcaaagcattagggaagatcgtcggtaaaaggctttctattgtttcatcagaacgcatggaagaacaaacgggacaaaagcagggcgctgtttctccgtttggttatgaaaaacagattccgattattattgatgaagagctcttatcaaatgaaaaacttgtttttgcaccaggtagaccagatcaaacgatggtcatccaaacggttgacttaaacaaaatcatccagctacttgagatgccgatatttttgatgccggcaaacgaaaaaaacaattaaccaagtaaaatagtgcatacttggaggtgaagcaacatgataagttatccattattagaaagaaatgcaacgattggggttacttcaccatcctcaggcgtatcagaggaacaccattcgttactcgaatcagctttaaagagaatggaagaaaaatctttccacgtagttactggaaagacgctttggacgcaagataaggaaaaatcaggtccagcaagaaaacgagcagatgaattcaatcaaatgatgcaagatgaaaatatccaaatgatctttccgccttggggaggagaattattgattgagattctcgattttgtcgattttgatgctctacaaccaaaatggatagtaggttattcagatattagtacgttgctacttgctgtcacattaaaaacagggatagccactgcacatggaaccaaccttattgatttaagaggagagtacttggatgaaacgacagcaatgtgggaaagtgtactgaaaacaagaaaaggagaatcgattctacagcaaccttctgaaaagtatcaaaaagagtggccccatgagcattcatcatcttctgttttccatctcactgaaccaacaaattggcaatcagtcagcggagatgcagtaaggatgaagggacgattattaggtggctgtattgatacgatcagtcatttaatcggtaccccttatggagatgtccaatcttttaaaagaaagtataatgatggaaagccgatcttgtggtttctagaaaattgtgagctatcgtcagttgatttaagaagatcacttgttcagatgaaactggcaggatggtttgatggcagctcggggatcatgttcggtagaagtgcagcagaggatttgttagattataaaatgaaggatgtatacgaagatctgtcaaaggaattaaaactaccgatcttgtatgatattgattgtggtcatgtacccccacaactgacattgatcaatggtgcctatgcagaagtagcggtagaagatagaaaagcgactgttttgcaaacgtttatttaaaaaattttttcctgccttggagtttatcaaagaccaacaaatctaaatagaaaagaaaatgaaagaagctgacagtattttgccagcttctttttgtatgatctattagaaattttaattatccataactatcacattgatcagctgtttcacatcatttggattacctgtaggaatagctactacagatgcattatcaataatttcttgagttgtttctctaatgaacgctggataagatgtttgatctgcaggcatttgccaatgtgaaggaactggataactagtgattgtcccgtcatggttacttgaatacactaaaactccctggtaactgtatttcccagtgagcataaccacatctttcggatagactgcactccctgcatcataaggggcgataggtgttcctgcaggataatgaataacatgtagttcgaaatcacccgatgtatctctaaaagtattacctctaatagctagccaaacacgtgcgtactcaatttgtagatcagaatatcctgctaacggatctattgactgagaagactgtgaggaggttgtgtctattgttgaagaagaaatatttgtctcaactgtactactagatgtagaagaagtattgggctctgagactttactgcttgttgaagatgtattcgtttcagtagaagctgatttctgagtacttgatttttcagctgaactggtttgtctgattgaacttttgtctgtggtcgcagatggatcactattttctttactaggagacgtacatcctacaaggaataaagagaccaacaataaaataaaacctaactttttcatataaaatacctcattatttttttaataccagtatagcataatcctgaatttttgaatccgtaaaaccttgtctataaatataaatagagtgtatcttctttgataaatgtcagaaaaagtgtgacaaataatcatcagtaaaattacttgtcacactattgataaggagtatttaattgaagagaatgattaggagaaaggatctccgtactttttatagtaatcatagaatccaagtttgtatagacgaatcgttttttctcttatttcttctgtttcaaaatggactgcttgaagaatcaagtctgtgaattctataggagctgttccattcgcagtaatcaaattacgatctttcacagcttgttgttctataaaatcttctttattctgataattttccgattctaaccaaggaaattgcgcatttccggtgtgtttgtaaccttgcaataatccgctctgagctaaataatcaactgccccacaaatagcagctactggtacgtctgtttttaacaatttatcgattatttgatataaatgatgattttttatgtcccatgaattgccaccgatcataataaaaaggtcaactttttcaggtatttgttcgattaagtaatcgatttttgtttttaatcctccaatggaagtgacctctgattggatagaagcagttttgttttgccatccctctttttggtttagtgtgctagtaatataagcaccttcccaatcggcatattcctctaatagaaacgtaatcgcagttttcattttcaagctctcctttactatctatgacaaggacaacagttttaacatacagacattcattaaatttggatagcgacagcgaaaacaacaattcttaagttttaaacagagtatacagacagtcaacttaattaaatacgaactaaataaaaatgacaggtaatcatttttgtttaccagcattataacattttgcatacatggatgacaaaagaaccaattcccacttgcttgagtacaatcttaaaagaaactggaaggcaaaaagtaattatagaaaaaaaataaatcatatcgggcactcagacatgaaaacaaccctagagatatataactaggtaaccagtttaatgaaagaaaaaatcatccaagaagtcgattcttggattttttagtggatttgtttgccaaatacgtttagtatgcgtatatgagaggttgtaagcaaagcgttgtggtctgagcacttaaggaaaaatctgtgaaaatagcttttcatatttttgcagattttgacttaatgccgaaggtcagctttgcgattaccgtttatcgagaggctgtaaaagcaccgtgtagctccgatgacaataagcaagcatttttagagctaggtttccttgattctaaatatgcggcttatttcaatgagttggtgcttgaacgcgattttaagaaggtcgaaaacaggcacgacttttcgacgtaaggagaaagaatttcaatgatagaaacaataaatcccgcagaaaacaaggtttctgcgtacattcatatcccattttgcgagcatatctgctattactgtgactttaataaagtttttttagaagggcagccagtagatgagtatgtggaaatgctgctgaatgaaatgagattaatgctggaaagtcatcctacagcgaatttggaaacactttatgtaggaggcggaacaccaacttctttatctgctaaacaacttgatcgactattatcaggtgctagagagatcctgccttttcaaaatggtaatgagtttactgtagaagcgaatcctggtgatttgacccgtgaaaagcttcaagtgatgaaaaactatggcgtcaatcgtttatctatgggagtgcagacatttgacaatcgcttattgaaaaaaattggacgtaaacatactgcagaagatgtgtatcaaactatgcaatttttagaagcagaaaattttaccaatgtaagcatcgatttgatttatgcactaccgggacaaacactagaaggatatcgggatactttggaaaaagctttggctttggatctgcctcactattctttgtactcgttgatcctcgaaaacaaaacaatgttcatgaactgggtacgacaaggaagactcgaactgcctgatcaggaaacggaaaccagaatgtttgaagagacgattgaagcaatggaaaagcatggacgtcaccaatatgaaataagtaactttgggctctccggacatgaatctcaacataacctcatgtactggaacaatgaccactattttgggtttggagctggtgctagcggttatcttggagatattcgttaccgcaacaaaggaccaatccaacactatttacgcccattacgagcaaatgaacgcccggtattggaagaagaaaaattgacacgaaaaaatcaaatagaagaagaaatgttcttaggactaagaaaaaaaacagggattactaaaaaacatttctatgatcgctatcaaaaaacaattgaatcggtgtacggtgatgtgctaagggaattagagcaagaagggttacttgttaatgaagaagaccgtgtttatttgacaccaagagggacttttttggggaacaatgtgtttgagcgctttttatttgaaaaatagtttgaagaatatttgttttttatcgaatcttgaaaagaaaaagtttagaaaggttgacaatgaggtattgaagtattgatataactggatttacatcaattatttagaattagcactcttgtgtttagagtgctaaaaaatggagtctttctcttgacaggagaagggcttcttgctatatttataagtggattagcacttagaatatatgagtgctaatgagaggtgaggaagatgttaacaaagcgacaaaatgacattttacgtctgatcatccaacactatacgagtagtggcgtgcccgttggttccaaaacattgatgtctgagggagtcaaggccagctcagcaacgattcgcaatgatatgaaagcattagaagatgaaggattgctgttgaagactcactcttcttctgggcggattccatctgctttaggctatcgttattacgtggatcatttgttaaaacctgctcgcgtagcagaagatgatttgctgctgattcgtcagtctctaggcagagaatttcatgaaatcaatgagattattaagcaatctgctgagatattatctgagctgacaagctatacgactttttcattgggacctgaaataaaagaccgccgactgactggctttcgtatcgtacccttgaataatcgacagattattgctatcgtcgtaacagatatggggaatgtagaaagccaagtgttcactcttcccgaatatatgggaagtcaggaactagaaaaaatggtacagattgtaaacgaccgtctagtcggagatcctctgatgacggtgtaccataaacttcgtacggagattccgatgattcttcataaatatttccaaacgacagaagggatgtctcagttatttgacaccgttcttggtcatgtttttgaagaaaaggtttatgtcagtggacaaatgaatctcttggattatgagccccgtcaagatcttgatcagttcaaatcgatgttttcttttatgaaagactcagacggacttacacaaatgatcactccgatggatagcaatattcatatcaagattggtgctgaattaggcaatgatttattgcagaatatgagtatgattcaagcaagttacgagatagatggtcatggaagaggtacaatagccttgttagggcctactagtatgccttattctcggatgttcggtctagtcgatgtttatcgaagagaactagcagctaaacttgctgattactaccgctcgcttgacttgtcaaactcgtaatgtgaataacgaagctatttgcagctgatcgttctctctttcttagtaagagcaatcaaacagctgactgaataatgaaaggaagactgtatcgtgaaagaaaatcaagaagaactagataaagaaatgacagatgctcagccagaaccggaaatcgatgtcgaagctgcagaagattcgggtatttcagaagctgaagcggaagaattcgaaacagcgaaattaaaagctgagttagaagaaatggaagataaatacttgcgggctcgtgctgaaatcgcaaatatggcaaatcgaggaaaaaatgagcgtgagcaattacaaaaataccgttcacaagatttagccaaaaaattacttccatcaattgacaacctggaacgtgcattagccacagaagtgtcagatgatcaaggggcaggtttgaaaaaaggcgtggaaatggttttggaaagtttgcgtaacgcactggaagaagaaggaattgaaaaaatccctgctaaaggagaagcctttgatcctaatcttcatcaagcagtacaaactgttccagcgactgaagatacaccagccgatacgattgtagaagtactacaagaaggctacaaattacatgatcgcgtgttaagaccaactatggtcattgttgcacaataattgtgcggatataaaacttacactttcaattaaagaaggagacgttaattatgagtaaaattatcggtattgacttaggtacgactaactctgcagtagcagtattggaaggaaacgaagcaaaaatcatcgctaacccagaaggaaaccgtacaacaccttctgttgtatcattcaaaaatggagaaatccaagtaggggaagttgcaaaacgtcaagctgtgacaaacccaaatacgatttcatcaatcaaacgccatatcggtgaagcaggttacaaagtagatgtagaaggtaaatcatatacaccacaagaaatctcagcaatgatccttcaatatatcaaaggattcgcagaagactatttaggtgaaaaagtcgaaaaagcagttatcactgtgccagcttactttaatgatgcacaacgtcaagcaacaaaagatgctggtaagatcgctggtctagaagtagaacgtatcgtcaatgaaccaactgcagctgctcttgcctatggtttagataaaacagatcgcgacgaaaaaatcttagtattcgaccttggtggcggtacttttgacgtatctatccttgaactaggagacggtgtctttgatgtattgtcaacagctggcgacaaccatctaggtggggacgactttgataacaaaatcatcgactacatggtagcagaattcaaaaaagaaaacagcattgacttgtctcaagacaaaatggctttacaacgcttgaaagacgctgctgaaaaagcgaaaaaagatttatctggcgtatcaagcacacaaatcagcttgccatttatcacagcaggagaatctggaccattgcatttggaaatgacattgacacgtgcaaaatttgatgaattaacagctgacttagtagaacgtacaaaagtaccagtacgtcaagcgttaaaagatgcaggtctgtcacaatcagaaatcgacgaagttattttagtcggtggatctactcgtatccctgcagttgtagaagcagtacgtaaagaaacaggaaaagaaccaaacaaatcagttaaccctgatgaagtagttgctatgggtgctgctatccaaggtggcgtgatcactggtgatgtgaaagatgttgttttacttgacgttacaccattgtcattaggtatcgaaacaatgggtggagtgttcactaaattgattgaccgcaatacaacgattccaacaagtaaatcacaagtattctcaactgcggcagataatcaaccagcagtagacatccatgtattacaaggtgaacgcccaatggctgctgacaacaaaactctaggaagattccaattgacagatattccagcagctcctcgtggtattccacaaatcgaagtaacattcgatattgataaaaacgggattgtaaatgtatctgcgaaagatctaggtacacaaaaagaacaaaaaatcacgatcaaatcttcttcaggtctaacagacgaagaaatcgaacgtatggtaaaagatgcagaagcaaatgcagaagcagataaagctcgtaaagaggaagttgacctacgtaatgatgtagatgcattactattctctgtggacaaaacattgaaagaattagaaggcaaagtggacgaagaagaagtgaaaaaagcagaaacagctcgtgacgaattaaaagccgctgttgaagcaaacaacatcgaggaaatgaaaactaaacgcgatgcattgaacgaaatcgttcaaaacttgactgttaaactatacgaacaagctgcacaacaacaagctcaagaaaatccagaagcagctcaaggcggagcagatgatgtcgttgatgctgattttgaagaagtcgatggcgacgataaataatcagttcactgaatttcgagagaaggccaaagttgctactttggctttttcttttgaaaaatagtttgaagtatcggtttttgtttcaaacaaaatatgatatgataacaagcgacgtgaaaatgatgagaaccaataggaggaaagcctatggcaacaaaacgtgattattatgaagtcttagggctctcaaaaggagcatcagaagatgaaataaagaaagcttatcgtaagctttcgaaaaaataccatcctgacatcaataaagaacctgatgcggaagaaaaattcaaagaagtatcagaagcatatgagattttaagtgacccgcaaaaacgcgctgcatatgaccaatacgggcatgcaggcacagatccaaattacggtgctggtggagctggtggcggatttggtggattcggcggcttctctggtggcggcttcggtggttttgaagatatcttcgactctttctttggaggaggcggtcggtcagtcgatccaaatgcgcctcgtcaaggtgctgatttgcaatatacggtcgacttgtcttttgaagaagcgatttttggtgtagaaaaagaaatcaagtataatcgggaagaaatctgtcatacttgtggtgggaacggtgcaaaaccaggcacacaaccaactacttgtcataaatgtcatggtgcaggtacgatcaatgtagaacgccaaacaccacttggacgagtgatgagccgtcaaacttgtgatgtttgtcatggcacagggaaagaaatcaaagaaccttgtccaacctgtcatggctcaggacatgagaagaaagcacattcagttaaagtgaatgtaccagctggtgtagaagaaggacaacaaatgcgtttagctggtcaaggagaagctggagaaaacggcggaccatttggtgatttgtatgtgatcttccgtgtagaagaaagtgatatctttgatcgtgaaggttctgaaatttactatgaattgcctttaagttttgtacaagcagctttgggggatgaagtccaagtaccaactgtccatggagatgtgaaattgaagatccctgctggaacacagacaggtacgaacttccgtttacgtggaaaaggcgctccgaagttacgtggtggtgcaacaggcgaccaacatgtcaaagtaaaactgatcacaccgaaaaatctaaatgaacaacaaagagaagcattacgtgcattcgctgaagctggcggcatcaaagttgaagaacagcaagaagacggtttcttcgataagtttaaagatgcttttggcgggaaaaagcggaagtagtttttctagtaaaaatataaagtagacttgcccaaattttctatttctagtaaaaacgctaagtcattaataattaaaaaccagacgaacaatcatacgttcgcctggtttttttgtagttgtcatgtttgtaccaacaaaaaagccaactttagaataagataatcatcatagtttctgaaggtggtatcgactatgtacttgatatcgtcaatgaaccgatggtactttcttatgcgatggaacaggtagagcgattgcttgtttgtgcaggaaaacaagcgatgcggctgatgatacgattaggtgagaaaataagaagataaaaatacacggtcccttcatggcgaccgtgcatttttggtttttattaaatatttaatactttattcaagaaatcttttgtccgttcattttgcggattttcaaagatttgttgaggcgttccgtcttctaaaaagtttccgtcgtcaatgaacatgacgcgattggccacttctttagcgaaccccatttcgtgcgtaacgataaccatcgtcataccttgttctgctaactttttcatgacgttcaagacatcaccgaccatttcaggatcgagtgcagaagtaggctcatcaaaaagcatgatgtcagggttcatcgctagagcacgagcaatagccacacgctgtttttgtccaccagaaagcatttcaggatacatatcttttttatcttctagaccaactgtctgcagtaatttgattgcttttttctctgcttcttctctagattctttcttcaggtccatcggtgctaaaatgatgttttccaaaatagaaagatgagggaataggttaaagtgttggaataccattccgatatgttgtctcaccaagttgatatctgtgcttttatccatcaagtgggcgccgtcaataataatttcaccgtcagaaggttcttctaaacgattcaagcaacgcaaaaatgtactttttcctgaacctgaagggccaatgatacagacgacatctccttcgttgatggatacattgatgtcgtttaatactgtgttatcgccgtattttttgactaaatgctcaactaagattttttctgccatcttacttcaccttcttttctaaaacttttgctaattttgtcaatgctgtgatcaaaatcaagtacatgatcgcaatgatcaagtaaacatacgtactttgtgttgtacgtgcaacaatgatcttaccagtttgcagcaattcgactacaccgattgcggaaatgatcgttgtgtcttttaatgagataacgaactgattgacgaatgatgggatcatgatgcgtatcgcttgcggcaaaatgattttttgcattgtccgattataagaaagacctaaacttctggaagcttccatttgtccgacaggaacggcgttgatcccgcctcgaacaatctctgcgatataagcacttgcgttaagagtcaaggtgataacaccagcaaggaagtcaggaatcgtaaatccaacgataccaggcaacccaaagaaaataaagaacgcaagaaccatcattggaattcctcggatgatatcgacataaatactagcaattgtgcgaagagcgcgtattggtgctacactgaataatccaaaaatcacaccgattactatagccaaagcaaaggagatcaaagttaggagaattgttctccaaagtcctttcaacaatgcttgatagttgttttggataagtccaagaaatgttgattcatcagcagtggaagactcactggaagtttctgaaccatccgctacatattctttaataatcttatcgtattcgcctgttctttttaattctttcaatccttcattgaacatattaagaagctcaggattttgtccttttttaacggcaaatgcatattttccgccagattcttttttgatcggtgtttccaattcttgtccttgtttgatcgcataaccgattaccggataatcatccatcattgcatcgattgcgccaacttttaacccgtcgtacaattgatcagcagcatcaaaatatttgatagaatagccatattcagattcatggtcgcttaaaaattcagcactttcggtaccaacttttgctccgactgtttttcctttcaaatcttcataagacttgatcgaagtatctccttttttgacagctaattggatcccgctatcaaagtaagaatcagaaaaatcatagcttttctttcgttcatctgttacagtcattccggcaatcattccgtctgcttgtcctgattccaaagcttgcaaagcagcagagaaaccacggtagtccattcggatgttaaatccttgcagtttggcgatgttttccatcaattttacatcgatgccttcgtactcgccctttgcgttttgaaattcaaatggagcaaaagcagagtcactggcaattacgtatacgtcttttttgggctctattttttgcattgtctcgcttgtgcttgactctgccgttgtagtgttgtcagcttgtgcaacatgaccaaacgcaagtgtcacaagtcctgtcattaagaaaacaaatgagtgaaataaatgctttcttttcataatcaacctcctaaatttccaatattttattattataggcgaaaagtgctgaatcagacaagactgtaagctcgaaaaaatgaaaaaaatgcgagtttctaacattttatgttataaaacataacatgtataataagataaaaaagtggcgaaagtatgttcggtgtggtataattttttagtaaggaatgcctttgctttccttttctttttattggtcgtaaaatgaaaaggaatgaatgaaaaggaggacgaagaatgattgagagagatacctcccgacactttgagcttgtctcgaaataccaaccggctggtgatcagcctgaagcgattaaccaattagtggatggcgtagtcggcgggaaaaaagcacaaatcttattaggtgcgactggaacagggaaaacatatacgatttccaatcttattgagaaagtgaataaaccaacactgattattgctcataacaaaacattggctggtcagctgtacggggaattcaaggaatttttccctaacaatgctgttgaatattttgtttcttattatgattattatcagcctgaagcttatgtgccttcaagcgatacgtatatcgaaaaagattcaagtgtaaatgatgagatcgacaaattacgacattcggctactagttcattattagaaagaaatgatgtgatcgtcattgcatccgtttcatgtatttttggattaggctcgccttttgagtaccaaaaacaagtagtttcgattcgacagggagcagaactagatcgcaatcagctgattcgtgacttagtcagtatccaattcgaaagaaatgatatagattttcagcgcggtcgttttcgagtgcgcggtgatgtcgtggagatttttccggcttcaagagatgaacgtgccttacgtgtggagttttttggagatgaggtcgaacgtatccgagaagtcaatgcactgacaggtgaagttttgggagaaacggaacacgtagcaatcttcccggcgactcactttgtgacgaatgatgaacatatggagcatgccgtagcgaatatcaaagcggaattagaacagcgtttaactgtcttgcgaaatgaaaacaaacttctggaagctcaacgtttagaacagcgaaccaattacgatattgaaatgatgttagaaatgggctacacgtcgggaattgaaaattattctcggcatatggacggacgtaaagaaggtgaaccgccttatacgctattggatttctttcctgaagattttttgatcgtggcggacgaatcgcacgtaaccatgcctcaaatcagaggaatgtataatggtgaccgagcgagaaaacagatgctagtagattacggtttccgtttgccatctgctttagacaatcggccacttcggttagaagagtttgaaaaacatgtcaatcagatcatttatgtctctgcgacgccaggaccatatgaacatgaacaaacagataccgttatccaacaaatcatccgtccgacagggctgcttgacccagtgatcgaagttcgtccaatcatgggacaaatcgatgatctagtaggcgaaataaatgaacgagtcgaaaaagaccagcgggtgtttgtaacgacattgacgaaaaaaatggcagaagacctcacagattatttcaaagaattagggatcaaagtcaaatatttgcatagtgatatcaaaacgctggaacgaacagaaatcattcgagatcttcgattaggtgaatttgatgtgttagttggaatcaatttgcttcgtgaaggattagacgtacctgaagtttcccttgttgctatcttggatgcggataaagaaggctttttacgtagtgaacgttccttagtccaaacgattggacgagctgctcggaatgaagaaggtaaagtaatcatgtacgcagacaaagtaacagattctatgcgtctagcgatggatgaaacatcaagacgccgtacgattcagcagaagtacaatgaagaacatgggatcgttccaaaaacgatcattaaagaaatccgagatttgatttctattacgaaagaatcggaagatgatacaaaagaagcggtacaagtctcgtatgaagaaatgacgaaagaagaaaaagatacgttattgatgaaattagaaaaagaaatgaaagatgcggcgaaagcattggattttgaaacagccgctaatgtgcgagatatgattttagaattaaaagcttcaaagtaggaggacaacatggctaacgataaaattacgattcacggtgcacgtgcccataacttgaaaaatatagatgtaacgattccacgagataaattcgtggtcgttacaggtttgtccggttctggaaaaagttccctagcatttgatacgctgtacgctgaagggcagcggagatacgtagagagcctttctgcttatgctcgtcagtttttaggacaaatggataagccggacgtagatagcatcgacggattgagtccggcgatttctattgatcagaaaacaacaagtaaaaatcctcggtcgacagtaggtactgtgacggaaatcaatgactatttacgcttgttgtttgcacgtgtaggacatccgatttgtcccaacgatcatatcgagattaccagtcaatcagtagatcaaatggcagatcaagtaatggctttgcctgaacgcacaaagatccaagtgttggcaccgatcgtggtaaagaaaaaaggacaacataaaaaaatattcgaacgaatccaaaaagagggatacgtccgcgttcgagtcgatggggagatctatgatttaagtgaagtgcctgagctggagaaaaacaaaaaacatgatatcgcgatcgtcatcgaccggatcattgtgaaagaagggattcgttctcgtctatttgattctttagaggcggccctgcgattggcagacggctatgctctggttgacgtgatcggtgaagaagaaatgttgtttagcgaacactatgcctgtccttattgcggatttactgttggcgaactagaaccaagactgttctcattcaatgcgccttttggagcttgtccagactgtgatggtttaggtgtcaaattagaagtcgatcaagatttagtgattccagatagaacgaagacacttagtcaaggtgctatcgttccatggaatccaatcagctctcagtattatcctcaaatgttagcgcaggcttgtgaaagtttcggtatcgatttagatacaccattcgaagaattaccggaagagcatcaggagatcatcttgaatgggacagatgatcttttccatttccattatgaaaatgattttggtggcgttcgcgatgtagaaacgactttcgaaggggtattgaagaatatcgagcgtcgttatcatgatacgaacagtgatttcacgcgtgagcaaatgcgtctttatatgacagaattaacttgtcagacatgtaaaggttatcgattgaatccccaagctctatctgttcaaatcaatggaacgaatatcgggcaaacaaatgagttgtctattcaaaaagcagtagatttcttctcaaacttaacgttatctgaacaagagaaagtaattgccaaaccgattttaaaagaagtaaatgacagactttcattcttggaaaatgtgggactagactatctaactttgagtcgcgcttccggaacattatctgggggagaagcgcagcgaatcagattggctacacaaattggatcgaatctttctggagttttgtatattttagatgaaccatcgatcggattgcatcaacgcgacaacgatcgactgattggctcattaaagaaaatgcgtgatcttggcaacaccctcgttgtagtcgaacatgatgaagatacgatgtgggcagcagattatctgattgacgtcggacctggggccggagaacaaggcggacaaatcgtggctgcaggcactcctgaagaagtagctaatgatgaaaattctttgacagggaaatatctttcagggaaaaaatcaatccctgtaccaaaagaacgccgtaaaggtaatgggaaagcaatcaagatcactggtgcttcagaaaacaatctgaaaaatattagtgttgaatttccattaggagaatttgtagcagtcacaggtgtgtctggttctggaaagagtacattggtcaatagtatcttaaagaaatcgttagcgcaaaaattaaataagaattctgctaagccaggtaaattcaagacaatttccggctacgaaagtatcgaaaagatcatcgatatcgatcaaagcccaatcggccggacgccgagaagtaatccagcgacttatacaagtgtatttgatgatatccgtgggttatttgctcaaacgaatgaggcaaaaatgcggggttataagaaagggcgttttagtttcaacgtaaaaggcggtcgttgtgaagcttgtcgcggggatggaattattaagatcgaaatgcactttttgcctgatgtctatgttccttgtgaagtatgtcatggcaaacgatataactctgaaacattagaagtgcattacaaaggaaaaagcattgctgatattttggaaatgacagtagaagatgctgtagaattcttcaagcacattccaaagattcatcgcaaactgcaaacgattgttgatgttggcttaggttatgtgacgatggggcaaccagcaacgacattgtccggtggtgaggcacaacggatgaaacttgccagtgaattgcacaaaatctctaatggaaagaatttctatatactagatgaaccaacgacaggacttcatagcgatgacatcgcccgcttgttgcatgtattacaaagattagtagatgctggtaacacagttttagtgattgaacacaatctagatgtaatcaaaacagcagattatatcattgatttaggaccagaaggtggagaaggtggaggaacgatccttgcgactggaacaccagaagaaatcattaacgtaaaagaaagttatacaggtcactatttgaaaaaaataatggtataaagaggatagatagctgagatagttaaaaaaacataaaaaaatgaatttttgcttgttttattaatatcagtgttctagaatcattacatggtagttctttctacactgattggtatagataaaaacttcctataagttcaatccgttcaaaaaagaattgagcaatcggaggagtttcctttgattgcttttttctttatggtatgatattccttgtgtagttggaaaagaaaaacaagagattatgagtaagtgagagataatgatgaacagtattgaaaatgaagaatttatccctatattattaggaagcgacatgaacgtttatggtatggcacgttcttttaatgaagcatacggcaaaatctgccaagcatatgcttcggatcagttagcccctacccgctacagtaaaattgtcaatgtagaagttattccaggatttgataaagaccctgtatttatcgagacgatgcttcgtttggcaaaagaaagatattctgataagagtaaaaaatatcttttgattgcttgtggtgatggatatgcagaattgatctcccaacataaacaagagctgtcagaatattttatctgtccatatattgattattctttatttgaaagactgatcaataaagtaagcttttatgaagtttgtgaagaatatgatcttccgtatcctaaaacattgatcgtcagagaagaaatgttagtaaatggacatttggaacaggaattgccttttgaattcccagttgctttgaaacctgcaaacagtgtggagtatctttctgtccaatttgaaggaagaaaaaaagcttttattttagagactagagaagagttcgatttaatattaggccggatatacgaagccggttataaaagtgaaatgattgtacaagattttatcccgggtgatgatagtaatatgcgtgtgctaaatgcgtatgtagatgaagatcatcaagttcggatgatgtgtcttggtcatccactgttagaagatcctacaccagcatcgattggtaattacgttgtgatcatgccagattataacgaaaaaatctatcaaaccattaaggcatttttggaaaaaatcgaatatacaggctttgccaatttcgatatgaagtatgatcctagagatggagaatataaattatttgaaatcaatttgagacaaggtcgtagcagtttctttgtgacattgaacggcttgaatctggctcgttttgtcacagaagatcgagtgttcaacaaaccctttgttgaaacgacctatggaacgaatcaatcagataaagcaagattatggatgggtgtgcccaaaaaaatctttttagaatatgctagggaaaatgaagacaaaaaactagctgagcaaatgatcaaagaaaatcgttacggtactactgtgttttatgaaaaagaccggtcaatcaagcgctggttgttgatgaaatatatgttccataactatattccaagattcaaaaagtattttcatgtgaaagaaggctagttcatggagaattttttcagtattttaggcggaatgggcacgatggcgacagaaagttttgttcgcttgatcaaccaccgaacgaaagctacaaaagatcaagaatatttgaattatgtcttattcaatcatgcaacagttcctgatcgtacagcttatattttagatcgatcagaagaaaatccaatgccgtttctgctggatgatattgagaaacaaaatttattgcagccgaacttcattgtgttgacttgtaacaccgcacactacttttttgaagaattacaagcggcaacggatattcctatcctgcatatgccaagagaagcagcaaatgaacttgtccgtcagcatacgacagggagagtagcgattctaggaacagaaggaagtatgaaagctggaatctatgaacgcgaagtcaaaaatcttggattcgaaacagtgattcctgatactgttcttcaagaaaaaatcaattatctgatctatcatgagatcaaggaatcggattatttgaatcaagagctatattacgaaatcttagaagaagcggtagagcgcctaaactgtgaaaaagtcatcttaggttgcacagaattgtcattgatgcatgaatttgctgaagataaccattatccagtgatcgatgcccaatctattttagcagatcggacgattgaacgagcgctagctgaaagaagcaaggcattggatacagcatcggaaaagtaaaaaaattggatttggggcaaatatcctaaaagatatttggtccaaatctttttgtaaaagaaaaagaaaactggtaatgatacgcccggaatgatataattttactatgcacaatgtgagaggagttcgtaattatgacagataatttgcaattagtcatcataacaggtatgagcggtgcagggaaaacagtagctatccaaagttttgaagatatgggctatttttgtatcgataatatgccgcctcgattgattccaaaattctgggaattaatcaaagaatcaggcaaagtcacaaaaatggctttaggagtggatttacgttctcgttccttctttgaagaaatccaaaacatgctgatcgaaatcgaaaatacgaacttcatcgacacttctatcttatttttagatgcttcagacgaagaactagtggctcgctacaaagaaacaagacgagcacatccaatggcgatggacggtttgatcactgaagggatacgtaaagaacgggcgatactagacgacttgaaagcccaagcttccgtgatcattgatacgacgacattgacaccacgccaattacgtgaaaaaatcaatgagtcattcaaatcaaagggagaccaaggatttcggatcgaatttgtatcatttggttttaaatacgggttgccgatcgattcggatattgtgatggatgtgcgttttttgcccaaccctcattatatcccggaactaagaccattgaccggaaaagatcagccagtctatgattatgtgatgtcctttgatgaaacgcaatcattctaccataaatttttggatcttctggaaactgtattgcctggatacattaaagaaggaaaaagcagcttgacagttgcaatcggctgtacaggcggtcaacaccgttctgtggcattgactgaacgtttggcaaatgctttagggaaaaactataaagtcaatgtgacacatcgggacaaggataaaaggaaagagacggtgaaccggtcgtgaaaatgaaaacctaccggataagaaaaccaaagatcgtagtggtcggcggtggcactggtctgccagttatcctgaaaagtttgcgaaatcaaggagcagatatcacagcagtagtgactgttgcagatgatgggggaagcagcggtgcaatcagagaatcgatcgctatggctcctcctggtgacttgagaaatgtcttagtggcgttatcggatatgccacaattctatgaagatattttccaataccgtttcaaaaaggaagatcagtttttagccaatcatacgatcggtaatctgatcattgccgcagtttccgagatgcggggaagcacttatgaggcgattcaattattagcaaaaatgatgcatgtagatggacatgtttatccttcttcagaaactcctttgaccttgcatgctgtctttaaagacggaacgactgcagtaggagaatctaaaatcgcgatcgaccgtaaaaccattgaccgtgtgtatgtctgcaacacaaatgataaaagtgaagccaaagcggctcgaaaagtcgtttcagcaattatggacgccgacatggtcgttttgggacccggaagtttattcaccagtatccttccaaatttagtgataccagaaatcggcgaagcaatgctcaagacaactgctgaaaccgtctatatctgtaatatcatgacccaaaaaggggaaacggaacatttcacagatgccgatcatatacgtgttttacacaagcatttgaatcagccttttatcgatacagtattggtcaatacggaaaaagtgcctgaagattatatggacccagagatctatgatgagtatctagtacaagtcgcacacgacttcaacggattgagaaatgaaggatgtcgagtgatttccaccgactttttggaattgaaagatggtggtgtcttccacgatggagacaaagtagtagaagaattgttccgtttagttttcggttcaaaatattaagcaatttattgttggagaaaggaggagaataggatgtcatttgctgcagatgtgaagaaagaactaactggtttggaagttcatcgagaacatgcgaaagcggaattagctgctttgctgcgaatgaacggctctttaggtattgtgaaccagcagtttattttgaacgtccaaacagaaaatgctgcaattgccagacgtatctattctcttttgaaagatcattatcaggtacgaagtgagctactcgttcgtaaaaaaatgaaattaaaaaagaacaatgtctatatcgtccggttgaagcaaggcacaaaagatgtgttgatggatcttgatatcatggatggtatgatgttcaatggacacgtttcggacgagattatgggaaattcgcaaaaaatgcgttcttacttacgtggtgcttttatggcctcaggttcagtcaataatccggaaacgagccgttatcatttggaaatattttctatttatgaacagcataaccaagacatttgcgatatgttaaattattacggtctacatgctcgaacgcttgaacggcgcaatggctatatttcttatttaaaaggagcagaaaaaattgctgatttcttaacattgattggtgcaaccaactcaatgctccgatttgaagatgttcgaatcgtacgggatatgagaaattcggtcaatcgtctagtcaattgtgagacagcaaatctgaacaagacgattgatgcggcttctaaacaaatcgaaaacatcgaattgatcgaagcaaaggtcggtctacatgcccttcctgaaaaacttcaggaaatcgcagaacttcggcttcaacatccagaggtcagcttgaaagaattaggggaaatgattccctcaggtgcgatatcaaaatcgggaattaatcaccgaattcgcaaaataaatgaatttgcggaaaaactgcgtgaagaagcagtttaatccaaagaaaaaactgatacatgaagcaggagatgcgaatgtatcagttttttttaaaagttatacttgcttttcttccgtcaaactataattccatctttactggagtaacataatttggaaaggcttctattgtttttaatacaatcgtataaaaagcggggagacaactgaatgaagattttaatttgtacataaatttttgcttaatatagaagtcctgatatagataagatcaagtatttatctataactggcctgattaattaaaaaactggaaggaactgctcgatcatccttgagaactgctcttcttacttctggtcaagattctcgtggttggtggataaggatggttgataagttcattggattagctagtcgaaaacaaccaggtgtaattaatgtagaagttttaacaaggggatggagtgatttattcagtgataatcataagttcataaatagtaattgagatgtatggttggaatacgttatacctgaacttgaactaccaagatttggtttagaatttgagaatcgatgtttataaagggagggcaaaaatgcgtttttttacaacttttactatcattatgattgcagtactttttatttttctagatatagcaaagcgaaatacagcatttttattatatcgggttttacttcgagtaggtctcataacatttatatcgatcgttggattttttctattcacagttattgtatttatttggagaactccagcaccaccattgccagagattacatatggagaatttccttttagacttgagtatgaattgaatgaagaattacatgtgatagaagacacgttaatagttgaatttgatggatttggaatgaacgaaggcatagggagatatcgtagatggacaagtcgtttagccagcggagaagatttagtgttgctgttagaagttagtgataataagcaaatattttattttccaggacctgctaattattacatgggagataggttgaatggttataatcatacttttcctagtgcttctttcaatgaaagggaaagaggcattattagaagggatattttacatgacaaagaattattagaacaatttggtccgcttgatcaaaatacaataaatgaagaagaattgttaaatcaatataatataaggctagtgaattgggaaatatctgaaccgattgttaacaattttggtgattagaaaacaattacgataaatagaaacaagccaaatcatcagcaagtaaaagctgatgatttggcctttcttatacgagtagtaggaattcatagcgaatattattacgatcagtagatattttgatattaaaggagtattacgaactagtatgtgagaatgtagaggtgatttgcgaataatgagaaatttatcaaatagaaacaaaatattaatcattattgttgttatagctgtgtttcatctgggaacgaatgcggctttaagtagaataatattgggtcctaagccaccaaggccagaaattacccgaggggagtttgattttagattagaatatgaagtagatggggaaaggattgtgatagaagatacaattgttgcattatttgatggattttctgcagatgcaggtagcatggcatggtatcgcacgtggcgtctacatttagcaagtgatagacgatcacgaaatatcttattagatgaattagaggatggtcgaagaatatcttatgtcccagaaagtgctaactattttatgggagatgtacagaaagaaagagagcctaatcctaattggtatccatttaatggcgtaacaatagaatatccacgcaataaaacacctgaaataggtgcaaaatttataagtggtttagaagatctgtacgataggtttggaatccgtcttgttagttgggaacacgatccaccaatagaaaatcgttttgaataatcgaaatctgctaatccatttcatcagccagtgaatgttgtaatggaacaatttggtttagtgttcaaaaccattgaaatactaggctgtgatcagcaaaaatgtatctgaataaaaaagagagcaactattaaatgagaggagttaggagttgttagctttatacgaatcaaagtggcaaatatagatgcgtatgcatttgtgtttgccatcttgcatttggtagacgagataggtataagctaaagaaataacttgtttaaaataaacgacctagctcaacaaacgaccatctaatcaactaacagcatacataaaagcaactatttttgaagtagaattgaaatcgggataacttaaaaagtgattgggatactagtgtgaatcaccgtacataaatattactcgttaagggaatttgagaaattttgtatgaaaatttaagaattagttagtatgcgcaagtcaaaaatatgaataaattatttggtggagataatttgctcagcttgtcataagaaatgagataatctggcagatgcaagcttttggacaccatttattcggaataaggaggctgggacagaagcgtttaactccaagaaataagaaggagttgcttctgcttccgccgtttataggtgtttagagcgtgagacaaaagtgttctttacttttgtcccacgctccttatttttttattttgtttggatcaattcttttaattcctctattgaaatagattcatcaaagatttctttacccaagatgacagtcggaacaaatcgaatatgtgcttgctcagcttcgttgatgacagcttggctcagctgttcgtctttttgttctgtcagctttagtttatctactgcaaaatccgctacttcttggagagaaagatgtttccactcgtattgagtatcgaatatttgtttgatctctttgatcgctttttgaccatcgctgattgtgagataccggtgcatcacgtttcctcgctgcaagctttctttttctttatcgaacaatttgatcactcgctgcaattgcccgctttggactgcttcttctaatagctcataagattcttcaaaccattgtcggcaatacggacaagctaggttgatgaattcgaccatttttttaggagcattcgatgaaccataaaggattcctttttgtgtatttgttttcgttgcatcaatcactgatatatccatgttaaaacacctctttcacttatagtttatacatgtctgacaaaaaaaggcaacgatttagactgtttgtctaaaaattagatgaccaattcaaatagacatatgtgaaatatttttataaataaaagaaaaaaatggaatgttttacgttataatggaacagataataagagagaatatgaacaaggatgatgaatcatgcgaaaaatgaaaacaatggatggcaatacggcagccgcatatatttcttatgcatttaccgagattgctgcaatatatccaataacacccagttcgaccatggccgaattagtagatcaatggtcagcagcaggaaaagaaaatgtattcggtcaaccagtaaaagtagtagaaatgcaatccgaagcaggagcagctggtgtggtccatggatcattgaaaactggtgcactgacaactacatataccgcttctcaagggctgcttttgatgataccgaatatgtacaagattgctggggaactactgccaagtgttttccatgttgctagtcgggcagtgacgacaaatgcgttgaatattttcggagatcacggagacgtgatggctgcaagacaaacaggatttgctatgttagctgaaagcagtgtacaagaagtgatggatttagcacctgttgcccatcttgcttctattgaaggagaagtaccttttttgaatttctttgatggattccgtacgagtcacgagattcaaaaaatcgaagttttggaatatgaagaattagctcctctgatcaatcaggagaaattagcttcatttcgtaaacgagggatgaatcccaatcatccgactgttagtggtacgaaccagaatccagacatccattttcaacaacgggaaacgatcaacccctattatgataaattacctgaaatcgttcaaaaatatatgaaagagatcaaccgattacgaggaacttcttatgacttggtgacttattacggagcagacgatgcggaagaagtcattgtttctatgggatcagttgcacagacgattgaacaaacgattgattacttgaatgcaaacggacggaaaacaggttttttgaatatccatctttatcgtccttttccagtggaaacattcgtgcaaaagttgcctcatacagtaaaaacaattgctgttcttgatcgaagtaaagaaccaggggcaggtggagaacctctcttattagacgttcaaagtgcgttatatgattctgaacttcgcccggctgttattggtggtcgctacggattgggttctaaagatgtgactcctgaccaaatctcagcagtttttgatgaattgcaaaaagacccaagcatacgcaaaaaacgtttcaccataggtatcgttgatgatgtgacttatcaatctttggaaccaaaggaaagtctggatttgacagaaccgcaaacattccaggccaagttttgggggtttggatctgacggaacagtcggagcaaataaatcagctatcaagattattggagatcacaccgataaatatgcgcaaggctatttttattatgattcgaaaaaatctggtggtctgactgtctctcatcttcgttttggagatacgccgatacgttctgcgtatcttgtcgagcatgcggaccttgttgcctgtcacacaccagcttacctgcatagctataacttggtcaaaggattgaagccaggtggcatttttttattgaatactctttggagcgacgaacaattagaaacgcatctgcccttaaaattaaaacgttacttggctgaaaataacattagattctatacgatcaatgccatgagattggcccaagaagtcggtttgggacgccggatcaatacggcaatggaaacggcattttttaaattagctgacatcattccttttgatgaagtgattccgctgctaaaagaagaagccctgaaaagctatggacataaatcaatggctatcgtagaaaaaaacatacaagcaatcgaccggacgaccgaactgcttcatcaagtcgcgatcccagaacattggagaacgttggagatgcctgaaaaaatcaataaaaggaacactggttatgtacaagaaatacttgaaccagtgaatgcacaggaaggaaatcaactctctgttggtacacttgtagcaaatggaatgacaacaggagagatgcctttaggaacggcttctatggaaaagcggggcgtcgctttagaagtacctgagtggattagtgatcgctgtacgatgtgtaatgaatgtgcctttgtttgtcctcatgctgccatccgtccatttttagcagatgaagaggaaatggaagaagcgccagaaggatttatcgtgagagaaatgcgaggcgcagacggcgtaaaataccgtatccaagtttcagtggaagactgtacaggttgtggtctgtgtgtagaggcttgtcccgcaaaagaaaaagctttagtgatgaagccttatgaagaacagaaagaacaagctgtgaattgggcttttgcaatgacattaagacaaaaagcaaatccagtcaaaggaaagaatactgtcttgtctacacaattcaatcaaccgcttcttgaattctcgggcgcttgctcaggctgtggcgaaacaccttatgtaaaattattgacacaaatgttcggtgatcgaatgatgatcgcgaatgcgacaggctgttcttctatttggggcggtgcttctcctgcttctccttatacgacaaatgaatgtggtcaagggcctgcatggtcaaattctttattggaagataatgctgaatttggttatggtatgcttctagcggcacagactcgtcgcgaggctttggcaagttcaatcaaagaagtattgccaaaagtatcagaagaactacgagaattgatggaagactggttggtacacatgtttgagagtgaaggaacgcagcaaagagcagcaaaactgcaagctgcgatcgaaagcgaacgatcaattgtccctgaactggaggatatatacaagagaaaggatctattcgtaaaaaacagccaatggatgattggtggagacggatgggcttacgacattggttttggcgggatcgatcatgtacttgccagcggagcagacgtgaatatccttgttttggataacgaagtctattccaatactggcggtcaaacctcaaaagcaacaccagcttcggcaatcgctaaattttcggctagtggaaagtatgcttcaaagaaagatctaggaatgatggcgatgacatatggaaatgtttatgtggcgcaaattgcttcaggtgccaatcaaatgcaaacgatcaaggcatttgaagaagcagaaaagtatcctggtccttctttgatcattgcctatacgccttgtatcacacatggtttgcttggtggaatgaaagaatcgcttaaagaagcaaaagaagctgtttcttctggctattggtcattatatcgatataaccctgcaatggtcgaaaaaaacaagaacccaatgactttggactacaaaaaacctgatttttctactatgcctaatttcatgaggaaacaagttcgtttttcctcgctagaaaatgctaatccaagtcttgcgaaagctttatttgaaaagactgtcaaagatgctaaaactcgtttttacaattatgctgcactgacgggagaattagaaaaaatcaagaaacgacttgaaccagaggaatctatcgatgtacccgttaagactagaaaagaaaaaacgacggaccttgaagcagaagaaagaagagctgctagaagagctgccagagcagaacgacgtaaaaaaatggaacaagctacaaaagaaaaaaaggaaaaataacagaaaaaatataatgaataattctctgaagtttaaaaatatttattgcagagaaaaataaaacgcatacttgcaattttcttgaaaattatgcgtttttatcaataaaaaaacgagcagatcagcctctaaaattaaaacatatgatatactaaagaggaaatctcaaaagagaagagaggctttttatgtcatttcaaatcggggaacttttcaatttggactattggcagcaaatgttttccggtgacttgttctctctgaattttttggtgaacatacttgatattctggttgtctggtatcttgtatacaaactgatccaactgctacgtggcacaaaagcgattcagcttctgaaaggtgtagctatctttattgttatccgaatcgtagcggaaatcattggtctgcacactttgtcttggttgatgaaccaagtcatcacgtatggggtgatagctgctatcgtgatttttcagccggaaatccggagaggactagaacatcttggacgcagttcgcttttcaaacaatcaaaaagcgaacagcaggaagatgagaagatgatcttgtcttttgacaaagccatccaatatatgtccaagcgaaaaattggtgcgctaattactatcgaacggcatactggattagatgagtatattgagacaggaattgcattagatgcagatatcactggagagctgctgatcaatatctttattcctaatacaccgctgcatgacggtgcagttattgtaaaagaaggaaagatcgcagtagcaagcgcctatcttcctctatcagaaagtatgttgattcctaaagaattcgggactcgacaccgggcagctgtcggtataagcgaagtcagcgacgcgattaccatcgttgtctctgaagaaaccggggatgtcagcattacattagataatgaactgatggctggcttatcccagcaagaatatttggcaattttgcgtagagaactgattgctgaagagaaaacaaaaaacaagaaaaacgtgattcaatctttcctagacggtatgactaagggaggggatcgcaaatgatctcaaaagagaaacggacaagcattctttacagttttattgcattgctgttcagtattgcgctgtacttcaatgcaaatggccagtccgttccaaatacgctttctggaaatgaagcgtataatcaaacagttactggggtgcctatcaagatttcttatgattcaaagcgctactatatccatggatatgaaaatgcagtgactgtcaaactttccagtgcaaaccgagttcagttgaatgcagaggcaaacgaagatacacgtatgttccgcgtcacagcagatatcactaagctgggcgaaggaacacatgaagttccgctaaaaattcaaaatttgagcagtgctgtcacagcaaagatcgaaccatcgactattacagtaacggttgagaaaaaggtaataaaagatttcgatgtggaaacgttgattccttcaacgttcacaccatctggatatgaacttgatgatacttccgttagtcctaaaaaagtctctatcactacaggtgacaaaacattggcagaaatcaaacaagtagtagctgatgtggacgcttcgatggtcacagatgatgggattaatagtgaggtcccaatacaggcgctgaatgcagcaggggaagtattaagtatcgtctctgatccagtgcaagtaacagtgaaagctgattcaatcaagccaagcaagtcggtacgactttatgggatacagcaaggaacaccagctgccggggtagaaagctatgatttcagtttttcaaaactggaagcagaagtaagcggctctagcgatttgcttgcatcgatcggtgacagtattgctgtaccgatcaatgtctcaggtatcaatcatcgaacaactcgtaaaattgaaataccagtagaagaggggttaagtatcaagcccgaatcagttagtgtggagattacacccgtgttgcaaacgtcaagcagtagctctgcttcgacgagcagtcggacacaagaaaatacaagtacgagtagaagtatttcatctgctgattcaggaacggaaccatcgacaacaaccatttcttccagttcggaatctgggacaagcagctcgaccacaagtacagaagaaacatcagaaacaagcgaatcaacgcaaatgagcagaacaaattcctcagaaaattaagttaaaggagtaattttacaactatgggtaaatattttggaacagacggcgtacgcggtgaagccaacaaggaacttacgccagaacttgcatttaagctgggacggtgcggaggttatgtcctaagccagcatgaagaagaaggaaaacgcccacgcgtgttagtagggcgggatacaagaatctcaggtcaaatgttagaagaagcgctgatttcaggacttttatcggtgggtatcgaagtgttccagctaggtgtgatctctacaccaggtgttgcttatctgacacgtttgcaaaaagcaagcgcaggggtcatgatttctgcttctcataatccagcacaagataatggaatcaaatttttcggtgcagatggttttaaattagtagatgaccaagagctagaaattgaagcattattagatgctgaagtggatgaattgcctcgtccatcagctgaaggattgggaactgtagaagaatttccagaaggcttattgaaatattctcaattccttgtacaaacgatcaacggtgacctttccggtttgaccatttgtgtcgatgcagcaaacggagcaacttcaacaagtgttaatcgtttgtttgccgatcttgaaacagatttttatacaatgggcacaaatccagacgggttaaatatcaatgacggcgtaggctctacccatccagaacgtttagctgagatggtcgttgaaaaaggagcagatgctggactagctttcgatggcgatggcgatcgtattattgcggtggatgaacttggaaacatcgtcgacggtgataaaatcatgtttatctgtgctaaatatttggcagaaaaaaatcggttgaaaaaagatacgatcgttacgactgtcatgagtaacttaggattccacaaagcggtggaaggaatcggtttgaaagatgtcgttacacaagttggtgatcgttacgttgtagaagaaatgcgcaaaaacgattataactttggcggcgagcagtctgggcacatgattttcttagattttaacacaactggagatgggatgctttcaggaattcagttactgaatatcatgaaacagacaggtaagaaattatcagagcttgcagcagaggtaacaatctatccgcaaaaattagtgaatatccgcgtaagtgataaaaacggtgcgatggatgttccggcaatcaaaaaagtgattgaagaggcagaagctgaaatgggatcagaaggaagaatcctagttcgtccttccggtacagaaccattacttcgagtgatggcagaagcgcctactgatgagaaagtcaattactatgtcgataaaatcgcagcagtagtcaaagaagaaattggactggattaagagatgttttcataaaaaataaaagaacaaggaccagtgtcagatgtctgacactggtccttgttcttttattattctactgtcactgatttcgctaaattacgtggtttgtcaacgtcgaatccccgtaatagcgttgcgtaatatgcaagtaattgagtcggtacgactgtggttagagtagttagataagggtggacagttggtagcaccagctggtcactttccttttctaatccctctgagacaataactagtgttttagcgccacggctttcgacttctttcaggtttcctcgagtatgcgcaccagtcacttcttcactgatgattccgatcactggtgttccttcttcgatcaaagcaatcgttccatgtttcaattcgccagcggcaaaaccttctgcctggatataactgatttctttcaatttcaaagcagcttcaagagaaacgttgtagtcagcgccacgtccaatgtaaaaggcatttcttgtatcgctgagatatacttctgccaactcttctaaataatctttttgggcgatgaccgattccatcgcattagcaactaaactcaattcatgagtgatatcgaatacaagagaagtttcaaattcttttttatcaccgatagctttggctaataaagttagtacagctatttgtgcagtataagctttcgttgatgctactgcgatttcgggtccagcatgcaatagcagtgtaaaggatgcttcccgcgaaagagtagaaccagcaacatttgtaatcgtaagtgaagggtagccgagacggttgatttttaccagaacttggcggctatctgctgtttcgccactttgactcaagaaaataaagaatggtttttttgaaagaagaggtgtgttatagccaaattcactggctaaatgaacctcaacagggatctgtgtcaatttttccaaagtctgtttacctgctaaccccgcatggtaactagttccgcaagcaacgatatagattcgatcgctatcagacaatgtatcgaccagcttttgatcaagagagacacgattgtcttctgttacgtatttttgagcgatacgacgcatgataataggctgttcgtcgatttctttcagcatataaaaaggataggtacctttctcgatatctgaagcatctacttgtgcttcgaatgaagaacgttctacgatgtcacctgcaaaattttgaataataactttttctgatgtgacagtaaccatctctttatcttcaatctcaacgaattccttcgtatgagcaagcatagccattgcatcgctggcaatcacattgaatccatcgccgagtccgattaatagtggacttttatttttagcgacgtaaataacatcaggtgctgtccgatcaatcaaagcgaaagcgtaagaacctttgatgacccgcaaagctttcaaaaacgcctcttgcgttgtagtatccttcgcgaaagtttcaattagatgagcgataatctcagtatcggtctcaccaataaagtggtcatttgctaaataagcaattttaagttcttcaaagttttcgattacgccgttgtgaacgagcacgaagcgtccactttgggaagtatgtggatgggcgttttcttcagaaggttgcccgtgagttgcccaacgtgtatgaccaatacctatatttcctgtagtatcaatatttattttgtttttcaaattttgaattctgccttgtgctttgaccagataatcagttgtgccatctgagacaaagataccagctgaatcataaccacggtattctaatttttctagaccgtcaatcaatcctggtgttacattttttaaaccaatcattccaacaattccgcacataaaaaacatcctactttctataatgaattcgtatgaatgcttccagctgcaggaaaatccttttgttttatctttgcagatactttttgtggattttctgtagagtgcagtccctagggccatccgccgaatctttcgataaaccctctcctcgtcatctgtttacacagacctggcgctatcctaaaaggtataactatcctcctttttgttttttatctggaaacatttaaaatcataaccttttgcgaatgttcttgtcaacaaaaaaagaataaaaaataaattggtatatatcaaatgctttgtcaaatgctctttttatgtcaaaaaataatgggtttttatctatcatctttttcaggagttcggtacaatagaaagtaatcggatagaggaggagtaaaaatggattcaaaaattgagatcatgacactgggaatgttaaaaaaacaattgtccaaattcgaagcatcagctggtgtatcagatgatacgaaaatatttttagatactggctgggatagcatccaagaaatcgcacctgatgccttggaagttgctcaagctcgtgagtttacggtagaagatgaattgacaaaagagtcgttttccgggtatgcgcgggaagaaaaagcagagcggttcgacacttctgagcagtcagaaactgtgatcgtcataaaaaacttgtattagaaaggagaaagaatgaataaaagacgttgggcagcagttctgattgctgcaggattatttgtggtttcgttagtttcagctagtttgactaagcctcaggaaaacgatcaaattgagggattgaacagttggttatatggggatgaagaactagctccaaatgtgctggaagagggagacagtacgcaaaaaatcgtaaaattatcagtagatggaacgattgctgcgggagggtcttcaggtttatttgcttctgaaggttacaatcataaaaattttatggaacaactgaaggcgattgaagaagatccaacagtcaaaggtatctttttagaagtaaattctcctggtggcggtgtctacgaaagtgcggaaatcgctaagaaattggatacgattcgtaaagaacatgatatcccaatgtatgtcagcatgaaaaacatggcagctagcggtggctactatatttctgctcaagcagataaaatctttgcaacagaagaaacagtgaccggctcaattggtgtgatcatgtcaggattgaattattcaggacttctagaaaaactgggtgtggaagatacaacagttaaaagcggagcgttgaaagatatgggttcaggaacgcgaccagagacaaaagaagaagaagcggtgcttcaagcatatatcgacagcgcatatagtcgttttgtagcaatcgtcagcgagggacggaataaatctgaagaagaagtcaaaaaaattgctgatggaaggatttatgatggtgtccaagcaaaagaagtaggtttagtcgatgaattgggatttcctgaagatgctttaaaagctatgcgaaaggaacaacagcttgaagatgcggaactagtagaatattcttccacgccatctgggtttgctagtacatggttaggaagtaaactagcagaattccagggattgaagccttctgagactagtcagatcttatccgttcttgagaatctagggacagcggaatcaccaaaagcaatgtattattacggaggtgagtaagcatgtcagagctttcaaatgaaaataaggaacaagaaaaagataagcaacagcagcctgctgtaggacctgactccaacttttcccaaaaggtactgagctcttttgaaagagagcctttgacgcccgaagaaatcaaaaagaaacaacgtaaatggaaaaagtatacggacacaagaaatgaaccgccaaaagcaaatgattttcctaagtatttctatgcaggtttttttatccgaatgtttgccttcttggtcgatcttttgtgtatcggagctattacgcgtttaacacttggtattgccaaaaatctaggttggcttaatttttcagattcttatctgagtctctacggattcacagccttacttatttatctagcgtattttattttattgacgaaattcaatcatggtcaaacgattgggaaaatgatctttggtattcgagtcatcagctttgatgaagaagaacttagctggtcaaccgttttagttagagaaggtgcttgccggttcattctaaaatttcctttgctgatgttagggtatcttccagcagtctttaatcagaaaaagcaacatctaggcgattttttcactaatacaagtgttgttacgatcaatctgatcaaagcatttaaccaggaagtcaacagctgatgagcaataaaaagcagtaacagttgaaagcaccttctaaaagtcagatctaaaatctagcttttagagggtgcttcagttatttttaattgtcatgctttttttgttttgctactattgaacatgagctgaacatgagcaagaggaggacactgcgtgaagccgattgattttccagaaaaatatgagaatttaatgcgagtagcacaacaagcactagcaaaccagcaatatcagcaggcaaaagaattatttcaacgagcttacgagttgaaagaaagctttgaggctaatagcctgcttgttttttgtctttacgagttggacgagaaaaaagaagcattgaagcaagcactcttgcatgaaaaacagtatcttcaaaatgaggagtttgctgaattttattttgacttgttaatcagtacacaagattttttatatgctagaaaattgatagcaagtacagatttttatgaagctttcgagcagcgggtcattgaaaaaatccaatttgcagaagaattatccggacaaatggagaggcagaagatcaaggcactccacaataaatcggaggaacttccttcgttggaacctgcacgtcagcttgcgtctattgatgagatcgaacagcttccttatcatgagtttatccaaacagcgagtaaacttattgtatcgccagaggtccatattttagcaagggcaaaattactggagacacttaggcaattgaacgaatgccatcctgttttctatttgacgattgaagaaaagttagtcaaagtcataccaaaagatctgccaaagccgcagcagcaggcaagttaccagcgattatgtgtgttttcagatcgttacggtaatgaagatgcgctgcttagttccgtgttaaaagaagaattcacgttgcaatctgcaattgtttatcctgtctatgatacatacatcgaagacccgaagcgctggtttcaactgactgtagaggcgtgtacaggaaaaacgatgtatgaaggtacagaagatgaaaaacaagattttttaaaaaaaagagaaaaaattttgcagcaaatgatcttcttccattagattttatcagtgaaaaagataaaaatgttatgaaaaacaaggattctatccattcaatatgtttacaatttgaaagggttagtgtactatttaaaggtatgcatgaaacgtttttgatgtataaaatgaatttctaaactcggagggaattaaatgactgcaacatttgaaaaaaaaggcacgaatgatggtgttttaaaatttacgattgcgcaagacgaaatccaaaaaggattaacaactgcgtttaataaagtgaaaaaaagcttgaacgtacctggattccgtaaagggaaagtttctcgtcaagtattcaaccgtatgtacggtgaagaagctttatatgaagatgcattgaatgctgtattaccagaagcttatgaagctgctgtcaaagatgctggcatcgatcctgtttctcaaccaaaaatcgatgttgaaagcatggaaaaaggtcaagactgggtaatcactgctgaagtaacagtgaaaccagaagtaaaattaggacaatataaagatctagttgttgaaaaacaagaccgtgaagtaacagatgcagacgtggatgcacgtatcaaacgtgaacaagaagcacaagctgaattagttatcaaagaagatgctgaagctgaaaatggcgatacagtagtaatcgacttcgaaggctttgtagatggcgaagcgtttgatggcggaaaaggcgaaaattactcacttgaattaggttcaggctcattcattccaggttttgaagatcaattagttggtcataaatcaggtgaaagtctagatgtaaatgtaactttcccggaagattatcaagcagaagatcttgctggaaaagaagcagtcttcaaagtgacaatccatgaagtaaaagcaaaagaagtgcctgaattagatgacgaattcgcaaaagatgttgatgacgaagtatcaacattagacgaattgaaagaaaaatatcgcaaagaattagtagaaacaaaagaaaaagcagcggacgatgcaaaagatgaagcagcgatccgtatggctgttgaaaacgcagaaatcgttgaattgccacacgtgatggttcatgatgaagtacatcgttcaatggacgaattcttgaacaacatgcaacgtcaaggtatctctcctgaaatgtactatcaattaactggttctacagaagaagacttgcataaacaattcgaaggtgaagcagaaatgcgcacaagaacaaatcttgtgatcgaagcaattgcagctgctgaaaatcttcaagcaacagaagaagaaatcaatgcagaaatccaagaattatcagaaacatacaacatgccaatcgaacaaatcaaacgcgtgttgacagaagatatgctggaacatgatgtgacaatgaaaaaagcaatcgaattgatcacaggtacagcgacagaagcgaaagaatagaaatcaagtaataaatcatttctgaagaagctgcttctagaaaattgtttattcgaaataagggactgtgacacgattttgtcacagttccttattttttgttaagagtaaaaaatgcaaaggtataggtcagttgatcctttgttaaacactttttctttttactaaactatgttatgatagtaaaagactgtaaagtctttgatagtttcttgcatactttttgcaagttaaggggtgaagaccatgtatgacaatccaagtagcaatgagaccgtacgctgttctttttgcgggaaaacccaagaagaagtgaaaaagatcgtagctggtccaggggtctacatctgtaatgaatgtatcgacctatgtaaagaaatcattgatgaagaattttatgaagaagctgtacgcgaattcactgaagtccctaaaccactagaaattcttgaagtattgaataactacgtgattggacaagatcgcgcaaaacgctcgttagctgttgccgtatacaatcactataaacgtgtcaatcagcaagcacaagaaaacacagatgatgttgaactgcaaaaaagcaatatctgcttgatcggacctacagggtctggtaaaacatttttagcacaaacattagcaaaaacattgaatgtaccttttgcaatcgcagatgcgacaagtttgacagaagctggttatgtgggggaagatgtagaaaacattttgcttaaattgcttcaatctgctgattacaatgtggaacgtgcagaaaaagggatcatctatattgatgagatcgataaaattgcgcgtaaaagcgaaaatgtatccattactcgtgacgtttccggcgaaggtgtccaacaagccttgctgaaaattctagaaggaactgttgcaagtgtgccacctcagggcggacgtaaacatccacatcaagaatttattcagattgatacgacgaacatattgttcatcgtgggtggtgcatttgatggcatcgaaacgattgtgaagaatcgtatgggcgaaaagacgattggatttggtacacaaaaccaaaaactttctgaagacgaaagtgtcatgcagcatatcattcctgaagatttactaaaattcggattgatccctgagtttatcggacgattacctgttatggcagctttagagaaattgacaacagatgatctggtacggatcttgactgagccgaaaaatgcgctagtcaaacaatatcaaaaacttctttctctagatgataccgaacttgaattcgaacctgaagcgttgagagccattgcgaaaaaagcaatcgaacgcaataccggcgctcgaggacttcgttccatcattgaagaaatcatgatggatgtgatgtttgatatcccttcaaatgaaaacatcgaaaaagtgattatcacaaaagaagcagctgaattgtctggtgagccaacagtaatctataaagattcagagaaaaaagcgggttgatgaaaagaggctgccgtaaaagtcattttggcttttgcgacagccgcttgctttattcatcaccttgttaaggagagagaccatgaaagtccatcaagctgaaattatcataagtgcagtggcaccaaaacaatatccagatacacaattgccagaaatagctctggcaggacgatcaaatgtagggaaatcttcttttatcaacacattgattgatcgaaagaatttagcccgtacttccggtaagccaggaaagacccagacattgaatttttatttgatcgagaacacattacattttgtcgatgttccgggatatgggtatgcaaaagtatccaaaactgagcgagcaaaatggggaaagatgatcgagacatatttaacgactagagaccagctgcgtgcggtcgtttctttagtagatttgcgtcataagccttctcaagaagatatccagatgtatcaatttttgaagtattatgatatccctgtaattgttgttgccactaaggcagataagatccctcgtggtaaatggaacaagcatgagagcgaaatcaaaaaagcgttggattttgatcgcaatgacacgtttattctcttttcttccgttacaaaacagggaaaagaagaagcgtgggcagcaatcgaacaagcaattgaatcataaaaagaataaaaaagacttaccagtcaaactctttcataaaagtttggctggtaagtctttttttgagcttaacttacttttgtttcttgtcttttttcttttcattttgtggctgtggttttagaaatcgatcgatctcttcttttggtgcaactgttttttccggatcgacagcaaatgattcgaaaagtttatctaaattatctgtacgttcaaatttcaaccccattgtaaacacctctttgtttctttttacttagtctatcatgtaatcgtccaaattggtttctaagacataaagttttagtttttctttatcattggttataattgaattataaaaagatttgaaagaggtgagaaaatgattggcgaagataaattattgatgactatccagctcacagacttaaatgaagaagaaaaaaaacaggaaataagcgattgggctattttgacacgtctgttgatccagccaacatttatccgctctttcacacaacaagcggatccgtatgatcttcgaaagcttcaagaaaaaataatgctagcatcggtaagagacgaaagttggttagttgtaggaaatgacgagaacgaatgtagttttcgcttggaagataatcaattattgataaaaaatgtattgtctatctctgttttcaaagaaaagcaatttttgattcgagacttcattcagaaaaaaatgattgctcatggggtgttcgcctatatgcgagcttatagcgagtttatctatcacaatacaaaacagatctctcaacggctattgtttgagaaaaaggatgaaatcgaacatttacctaaaatgaaacaacaaaacggggaagtagtagtcgattgcaaccaatttccaggatacgatcttttttaccaaggtttatgtttcacttcgtgttgggaaatgtattatagtcgctattatcatcaaatcatccctaaaccgatttttctcgacatccaacaagtagaaaaagtgaagggattagaaaacgaagtcatatgtatccagctttatcgagacccctttaactggcaaaagccaaacaatcaaatgtttcaatcctattttagggaccagcttgggtttgatcatcttgcttgggacaatggtgtcggtttattgaaaccgccattcgttgaatacatttacactgaccatacgatccaatctgtccagtatcagaatgcacaaatgcaacctgttcctaaaaagaatgcttcattttttgtaacaaaaagttatgatattcaacaaggagattataaagaaaggcgtgttcgcggaacactaaatgctcaggcgtattttccttgggttgacgagaatcgctcgcgcatgatgtgctataaagttatcgatccgactgttgctttggataatggaatcgaagcttattgttattatattagggaatatctagaagtagaggtaacagatgaaaaatatcaagagtatcttttatccttaagaatctatgttccttcagaatccctgtcagaattaccgttaaaggaaatcaaacatagactctctgatgttaccttcaaacgaataaagaaaaagcggcgaagtatccaattcgatgtcaagaaaggtgagcagcatctgcgtgtgcaatttttagattaccgagaattagaacaattgattactttacaaaaaatatgaggtgaagaaaatggataaacaactctattatcgaataatggttccggcatcattattatccgtctgtctcttttttgttcctaattttcctattcgatcagtcatcggttttttggtcatgtttggcgggatgggactttattattatcttcttcataaggaaagaaaacctgcttctgtttatatgaaaaaaacaagaagcgaaaataaaaaacgataaaacggcttgatgatagacaaaaaaataaaaaaccagtctttttgactggttttttattttttttgactgatttataatttttatgaacgtttttgactgatttatattgcgagtagaaaaaaaatatgctattatttgtattgaggtgatcgtgaaaatgcttacagaggaacgcagacaaaaaatcctagacttgcttgaacagcagaaaatcgtgaaatcacaagatcttgtaaaccttttgaatgcttctgaatcaacgataagacgtgatttacaagagctggagaatagtgggtttctagaaagagttcatggcggagctaagaaagagcaattattgaattttgagcagaatatgagtgaaaaatcactcaaaaacgttcacgaaaaacagcaaatcgccaaatcggcagctgaaaccattaatgacgaagatgtcatttatttagacgctggctctactacgttagaaatgattccttttctgcaaggaaaacagatcacagtagtgacaaattccgttcaacatgcggcaaatttagttgatttggagcttgctaccattattttaggtggaacgatcaagctggcaactaatgctgttttaggatctaatgcgatagaacaactaaaaaattttcattttaataaagcatttatgggaatgaacggtgcccatcttgaacaaggattcacgactccggatccagaagaggcagctgttaaacgtttagccatgaaaaattccgaagagacatttgtattgattgatcataccaaattcaaccagttgtccttcacctctgttgcacctttggaagcagccacgatcataaccgagcgttgtccattagaattcgttaatgaattccgtgaaaagacaacaattaaggaggcaatacaatgatttacacagtaacacttaatccatcaattgattatatcgtacgcgtagatgggttaaaactaggcgatttgaaccgaatgaaggaagacttcaagttacctggaggaaaagggatcaatgtttcccgtattttgaaacggatcgattctcaatctacagcactagggtttttaggagggttcactggcgaatttatttcgaagtggcttgaaaaagaacaaatccagtctttgttcacaaccgtaaaagaagatacaagaatcaatatcaaactaaaatcagacactgaaactgagatcaatggcttaggcccatctatttcagatgaagaaatcgatgagttgaagcaagcattaggaacagtaggacaaggagatatcgtcgtattgtcaggaagcgcgccagctagcctgcgaaaaggattttatcaagaactgattgatatcattcgagaaaaaggtgcagatttcgtgattgatacaacaggtgatgacctaaaaaatgcacttgttaagaaaccgttgttgatcaaaccaaacaatcacgaattagctgagctttacaacacaaccttccaatctgtagaagaaatcattccgtatgggaaaaaattactagctgaaggggcacagaatgtgctgatctcaatggctggagacggtgctttgctcttcacggaacaaggaacttataaaacgaatgtattagttcgcccattgaaaaattcagtaggtgcaggggattcaatgattgccggctttattggggcttacagccgtacgaaagatccaatcgaagcctttaaatggggagttgcttgcggaagcgcaacagctttttctgatgacttggcagctcgcgaattgattgatgagttgctgccagaagttgaaatcacaaaaattgattagtttcaaggaggataatcatgaatatcaaggatttaatggtcaaagaagcgatgatcatggatttgcaagcgactgataaaaaaggcgcaatcgatgaaatggtccaaaaaatgtttgatgccggccggatttccgatatcgacacatataaagaaggaattctagcccgcgaagcacaaacttctacaggtcttggtgatggaatcgccatgcctcacgcgaaaaacagtgcagttaaagaagcaacagttttattcgcaaaaagccaaaaaggagtagattatgaagccttagacggacagccaacttatctgtttttcatgatcgcagctccagaaggcgcaaacgatacacatttgcaagcattagcagcactatctcgattgctgattgatgcagatttcgtaggaaaattaaaagaagcaaatacaccagaagaagtccaagacttgttccaaacagctgaagagcaaaaagaagcagaagaaaaagcagaacaagaaacacaagctgcagaagcttctgctcatccagaaagaaaattcgttgttgccgttacagcttgtccaacagggatcgctcacacttacatggcagaagatgctctgaagaaaaaagcgaaagaaatgggtgtggagatcaaagtcgaaacgaacggttcagaaggaatcaaaaaccgattgactgctgaagacatcgcccgtgcagaaggtgtaatcgttgcagcagacaaaaaagtagagatgaatcgctttgacggaaaagaactgatcaatcgtcctgtcagtgatggtatccgtaaaccagaagagctgatcaatctagcccttagtggtactgcaccagtattccatggtgatggaaaagaaagcagttcagaagaaggaaatgcggatggtactatcggacaaagaatttacaaagatttgatgaacggcgtatcacacatgttacctttcgttattggtggaggaatcgctattgcgctttctttcatgatcgaccaatttattggcgtgccacatgatcaattatcaaatctagggaattacaatcaagttgctagctggttcaaccaaatcggacaagctgcatttggtttcatgctgccggtattagcaggatttattgcttcaagtatcggtgaccgccctggtttgatcgttggatttgctgctggtgcattagctaatacaggcggtgcaggattcttaggtgcactgattggtggattcttagctggttatgtcatcgtatttttacgtaaattattcaagaacttaccaaaatcattggatggaattaaaacgatcctcttttatccagtgtttggcttactgattactggtttcttgatgttgctggtcaatgtccctatgaaagcaatcaatgatgcattgaacggtttcttgacaagtatgagtggttcgaatgctgctttacttggttcattattagctggaatgatggcggcagatttaggcggtccaatcaacaaagccgcttatgtgtttggtacagcaactttagctacgactgttgcaactggcggaagtgtcgtgatggcttctgttatggctggaggaatggtacctccattggcaattttcgttgctacacgtttgtttaagaataaattcagcaaaacagatcaagatgctggtttgacgaacatcgtgatgggactatcgtttgtcacggaaggatcgattccatttgcagcagctgacccgattcgtgccattccaagttttattattggttctgctttaactggcggattagtcggagctttcgggatcaaattactggctcctcacggcgggattttcgttgtattcttactgagtcacccggtcatgtatttggtgtttattgctatcggagcagtcgtatctggtgtgatttatgggttattgagaaaagctcctgcagcagcagaagcatagaaataaaaaagaagaggctgggaaaacccagtctcttcttttttatagaatcaagtagtgtagatgaatagttgttgtaaaatagtttttccatgttcgttaaaatgattgcttcaaatttgtgatagaagatttagcctcgatttcctgcttgattcttggcaagtttgcttcatcagtcaagataaccaaaatatctcctacattcatgatcgtatcaccgtgagtcaagatttcctgatttcctctgcgtatagagattagcagcatatttttaggccaattgaagtctcgtaccattaaaccgtctaaagaactctctgccgttactggaaaatcaaaagttgtccttgcaccttttagtgaggcggtctgagtatttccaagtagacgttccaataatgattcgtaaattggattaccgccgagaaggtcattgacgatataagcaacaagagcagccaatcctaaaggcatcagatgattaagagagccaaccatttctgtcactaaaataattgctgtcagcggtgcttttccaatcgctgtgaaataaccagccatggcaataacgacaaaatccttgatgtagattggatccatcccgaaatcaaccataatgtttccataaaagctaccgattaaagcccccaatgtcaatatcggaaggaaaatcccccctggaagaccaccaccgtaagaaatcatggaaaaaacgaatcgaagaacaaacaaaccgataatcataatgattggcaaggaagcatgtccaaaagctaaaacaatttgattgcctccgcctagagtattaggccataaataaccaattggcaaaatcagcaagaaaggaacgaacccgtgaaaataagctggtaaaggcaatcggttgtaaaattttggcaaagccagcaagaccttctgataaataaaacctaagacgcctagaagtactcctaatcccactaaagaaccataatatttcaacggcaaagaaggaagatcacctagatataaaacaggtctcaagccgaaaaagtaaagagagacgaagttagcagtgattgctgaagcaaatgatgtcagccaaacaagtggagaaaaggagtgatggatttcttctaaaacaaagagtaatcctgcgataggagcattgaatgctgctgcaagtccgctacttgcaccgctagaaattaaaatcttttcttctgaagatggactccgaaacaattgtccagctccttgtccaatggatgcgccaagctgtatagaaggtccttctctacctagaaaaaggcccgcaccaactgaaagtacaccgccaatgaactttttccataaaacagagaaccagttcattgataattccccgcgaagctgtccctctacttgtggaatcccgcttcccttgatatccggttcatttttgaccagataacccacgaaaaatgctgcaaggatgcagcaaatagctacgccaattaagtaaatcggctgttcccgactcatttcatagatacttcgaactaaatcgcttagcttttcgatagataatcgaaacaggctaacgacgattcctgtcagcagtccaacaaatattccttttagaataaaatatatctgagtcttatctaatttcttgatttttccttttttttccattcaaacgcctcgctttcttttaatttagcgcgaaatcaacgaattgacaaggaaaaatccataaaagaaacaaatgattttgaactagctagtttaatgaaagccaagaaaatgctataattaacaagattgataaaagaaaggatgttgttaatgtcatccaaagctgaattattaaacgggatgaacccccgtcagaaagaagctgttcttcacactgacggaccattactgctaatggcaggtgcaggaagtggaaagacgagagtgctgacacaccgcattgcctatttgattgaggaaaaagaagtcaatccttggaacatcctagcgattacttttaccaataaggctgcaaaagaaatgaaagaacgtgtcaatgcgattctcgcatctggaggcgaagatgtctgggtatcgacttttcactcgatgtgtgtgcgtattttaagaagagatgttgattttatcgggtataaccggaactttacaatcatcgattcttctgaacagctgaccttgatgaaacggatactaaaagaactgaacattgatccgaaaaaatatgatcctcgaagtatattaggaacaatctctcaagcaaaaaacagcctgcagacccctcaggattttacaaaaatgcaaggcagttattacgaagagattgcggcaaaatgttatgctgcttatcaaaaagagcttcaatataatcaatgtatggactttgacgacctgatcatgaatacgattcgattatttgaagaacatcctgattcactcacatattatcaaaacaaattccattatattcatgtagatgagtaccaagatacaaatcacgcacagtatacgctagtcaatttattggcaggtagatttaggaacctgtgcgtcgtgggagatgcagatcaaagtatttacggctggcgcggtgcagatatgcagaacatcttggattttgaaaaagattatccagatgctgcagtaattttgctagaacaaaactatcgctccacgaaaaacatccttagcgcagcaaaccaagtcattgaaaacaatagcaatcgaaaaccaaaaaacttgtggacagaaaacaaagaaggaaacaaaatcacttactaccgtgcagataatgaacgagacgaaacccgttttatcgtagaccggatgcaagaagagattcgaagcaatcatcggaattacggcgactttgccatcttgtaccggacgaacgcacaatctcgtgtaatggaagaaactctgttgaaagcaaatattccttataaaatggttggagggcacaagttctacgatcgtaaagaaatcaaagatattttagcgtatttgaatgtgctggcaaatcctcaagattcaatcagttttgagcgtatcgttaattcgcccaaacgaggcattggaccaggatctatcgaaaaactacgcagttttgcttctcttcatgaatggccactgcttgaagcagcgcaaaatgtggatctggcaaatatcggtggaaaagcaggacagcaattaggtacatttggagagatgatccaagaagtcactcagatgatcccatacttgacagtgacagaattgacgaaagaggttttggatcgtagcggatatctagaagacttaaaaatccaaaatacattagaagcacaagcacgcatcgaaaacttggaggaatttttaacggtcacacaagaattcgacaaacaattcgaacagcaaaatgaagaagacgctgatgcaccagaagaaaaactaacggtcttcttaaatgatctggcacttgtttccgacattgacaatttagaagaagatgcttcccaagtgacattgatgactttgcatgcagccaaaggattagaattcccagttgtattcctgattggtctagaagagggggtttttcctttatctcgagcattgatggaagaaagcgaactggaagaagaacgccgtctcgcatatgtggggatcacgcgagcagaagaagcgttgtatttaacaaatgctttctccagaacattatatggacggacgcaatataaccgaccttctcgttttgtagaagaaatcgatcaggagttactggaaatcgaaggcatgcgtcctacgcctaaaaaaacacctgtattcgctaaaaaaacagcatatagctataaacagccagagacagcggttgttccctctaaaagtgctactggaggggaaaataacagctggaaacctggagataaagtcaaacacaaaaaatggggtctaggaacagtcgtccgagtaagcgggacgtcgaaggatctagaactagatgtggctttcccaagtcaaggagtaaaacgtcttttggctgcctttgcgccaattgaaaaagcttagtagtggagggtaaatgatggaacatgaaatgacgattgacgaagctgctaaacgagcagaagaacttcgtacaagactgaaccaatggtctcgcgaatactacgtagaagataaaccaacagtggaagactatgtttatgataaagaatacgcagaattagtagcaatcgaggaacaatatcctgatttgatcacgtctgattctcccactcaacgagtaggcggaaaagtattagaaggttttgaaaaagtcactcatgatattccgctttacagtttgaacgacgttttcagcaaagaagagctgatagcttttgatcaacgtgtacaaaaagcagtgggacgtgtagttgactattgctgtgaactaaaaatagatggactttccgtttctttgcgttatgaagatggaaatttcgtgagaggtgcgactcgcggggatggaactgtaggagaaaacatcactgaaaacctaaaaactgtccggtcggtcccaatcaaattaaaagaaccaatgaacatcgaagtaagaggcgaatgtttcatgccaaaacggtcatttgtccaattgaaccaagacagagaagcagagggaaaagatatctttgcgaatcctcggaacgccgcagctggttctttgcgtcagttagattctaaaatcacagcgaaaagaaatctggacacttttttatacacagtagctgatttcggtcctatgcaagcaaaaacccagtatgatgcgctagaagagctagaaaaaattggattccacacgaatcgggaaaaacgtctatgtcattcgattgatgaagtgtggtcatacattgaagaatatcatgacaaacgtgtggatttgccctatgaaatcgatggaatcgtcatcaaagtgaatgaattctcgctacaagatcaacttggttttactgtcaaagcaccgagatgggcagcagcttacaagtttccgccagaagaagttgaaacgctaatcgaaaacatcgaatggacagtcggtcgaacaggggtagtaacgccaacagctatcatgacgccagtccgagtagcaggaacgacagtaagccgtgccagcctgcataacggtgattatattaagttgaaggatatccgcttgaaagatacagttctgatttataaagcgggagacatcatcccagaagtttcgcaagtcgtgttagataaacgacctaaagacagcgaagaataccaattgcctacacattgtccagtttgtggaagtgaacttgtccatttggatgaagaagtagccttacggtgcatcaatcctaaatgccctgctcaaatgaaagaaggtttgaaccactttgtttcaagaaatgcgatgaatatcgatgggttggggccgcgcgtacttgaacagatgtatgataaaaaactagtagcagatgttgctgatctttacaaattgacagaagaagagttattgacgttggacaaaataaaagaaaaatcagcaaataatattttgacagcaatcgacaacagcaaagataattcggtcgagcggttgattttcgggttaggaatccgacatgtcggagcgaaagcagcaaaaattttagcagaacatttcggtgatctagaaacattgagtaaaagtgactatgagtcgattattgcgcttgatacgatcggtgatatcattgccgacagtgtagtcacttatttcagtaacgaagaagtccatgaattgatgaatgaattaaaacaagcaggcgtcaatttcgaatacaaagggcttcgaaatgcccaattgcaagaagtcgagtctccttttaaagaaaaaacagtagtccttactggtaaactaacacgatttactcgtgaagaagcaaaagagacgatcgaaaatcttggcgggaaagtgactggtagcgtatcgaaaaaaacggatatcgtggtagcaggagaagatgctggcagcaagctgaccaaagcacaagaattaggaatcgaagtttggacagaagatcaaatggcagatgcattggctaaaagtcgctcagtagaagaatgaaaaatgagttttttcagacaaatttcaataaacaatttcagacacggcactcttgtgttaaaatagagagcaaagtttttaactcgtttagaaagaaggggtagtatggcgattagtgaagaacaagtgaaacacgttgccaaattagcaaaacttgcgttcgcagatgaagaacttgcaagttttaccgaccaattaggtaaaatcatcgatatggttgaaatgctggaagaagtagatacagaaggtgttccatttacgtcgaatgtggttgaaacagtaaacgtgatgcgacaagatcgggcgcaagctggatggaaccgcgatgaattattgaaaaatgtgccggaaacagaagacggctttatcaaagtacccgcaatcatcgataatggggaggctggcgcataatgacagaattacacaatcgttctctagaagaactgcatcatatgcttgtatcgaaagaaatcactgtacaagatttgacaaaagcaacatttgaacgaatcaaagaaacagagcctgaggtcgaagcattcattacattgaacgaagaaaaagcattggaacaggcaaaagctttagatgaaaaagggattgatgaaagcaacgtccttgctggtattccaattggtatcaaggataatatcgtaacaaaagatatcttgacaaccgctgcatctaagatcctttacaattttgaaccaatttatgatgcaacggtcatggataaaatctatcaagcagatatgatccctgttggtaagctaaacatggatgaatttgctatgggtggaagtacagaaacttcttatttcaagaaaacaaaaaatgcttgggacccaacaaaagtacctggtggctcttctggtggttctgcagcagcagttgcagctggacaaattccagtttctttaggtagtgatactgggggaagtatccgccaaccagcagcttttaacggcatcgtagggatgaaacctacttatggccgtgtctcacgttttggtttgattgcctttgcttcatctcttgaccaaattggaccaatgacccgtacggtgaaagataatgcattagcattgacagctatcagcggttatgacgaaaaagacggtacttcttcaggcgtttcagttcctaattttgcagagggactgacaggcgacatcaaaggaatgaagattgctttacctaaagaatacttaggcgaaggtgtggcccctggcgtaaaagaagctgtattgaaagcagcagaaacattccgttcattaggtgctgttgtggaagaagtcagcttgcctcattcaaaatacggtgtggctgtttattatatcattgcctcatcagaagcaagttccaacttgcaacgattcgatggtatccgctacggttatcgctctgaaaatgtgaaatcattagatgatgtatatgtcaactcacgttcagaaggattcggtgaagaagtaaaacgccgtatcatgttaggtacattctccttaagtgcgggttattatgacgcttacttcaaaaaagcaggacaagtccgtacattgatcaaacgagattttgaaaaagtctttgcagattatgacttgatcatcgggccatcttcaccaacagttgcattcggaatcggtgagaacattaacgatccaatcacaatgtacatgagtgacatcttaacgatccctgtcaacttggctgggcttccaggtatgtctgtaccggcaggtttatcagaaggattaccagttggattgcagatcatcggtaattattttgatgaaaaaacgatgtatcaagcggcatatgcgtttgaacaagcaacagaattccacacacaacaaccagctattttaggagggaaagacgaatgaattttgaaacagtcattggactagaagtccacgtcgagttaaaaaccaactcaaaaattttctctccagcgccagctcattttggtgcagaaccaaacagcaatacaaacgtgatcgactggggttatccaggcgtgctgccagtaatgaataaagctgcgctggaattcgggatgaaagcagctttggcattaaactgtgaaatctctaaagatactcattttgaccggaaaaattacttttacccagataatccaaaagcatatcaaatttcccaatttgatcaaccaatcggtcatgacggatggattgaaatcgaagtagaaggtaaaaagaaaaaaatccggatcgaacgtgtccatttagaagaagatgctggaaaaaacatgcatggtattggcggttattcttacgttgatttgaaccgacaaggcacgcctttgatcgaaatcgtttctgaagctgatatgcgttcaccagaagaagcatacgcttatctagaagcattgcgatcaattatccaatttacagaagtcagcgatgtgaaaatggaagaaggctctatgcgctgtgatgccaatatttctcttcgcccttatggacaagaagagttcggtacgaaagcagaattgaaaaacttgaactctttatctttcgtgaaaaaaggtttagcttttgaagaaaaacgtcaagcaaaagttcttctttcaggaggagaaatccaacaagaaacacgccgttttgacgaaacaacgaataaaacagttttgatgcgtgtcaaagaagggtctagtgattatcgttacttcccagagcctgatatcccgaaattcgtgatcgatgacgaatggattcaaaaagtaaaagctagtttgcctgagatgccagcttctcgtcgcgaacgctatatccgtgagtttggtcttccagagtatgacgcaatggtattgacacttacaaaagaaatgtctgatttctttgaagctgttttggaaaatggtgcagatgccaagcaagcatctaactggttgatgggtgaagtttctgcttacttgaacagtgagaaactggaattagctgagacaaaattgacacctgagaacttagcaggaatgattcgtttgatcgccgatggaacgatcagctcaaaaattgccaaaaaagtcttccgtgaattgatcacaaatggcggagaagcccaagaagtagttgaaaaaaatggttgggtgcaattatctgatccgaacaaactactgccaatcattaatgaaattttggataacaaccaacaatctgtcgatgatttcaaaaatggaaaagatcgtgcggttggcttcctagtcggtcaaatcatgaaagcaactaaaggacaagcaaatcctggtgtcgtgaacaagctacttaaagatgaattagcgaaacgatagaggctgaaaatgaaaaaagcacgcgtaatttataaccccacctcgggaaaagaattattgaaaaaaaatttggcggatatcctacaggcattagaagaagcaggatttgaagccagcgcctatgcaactacaccagaacctgattcagccaagaatgaagcacgtagagtcgcagaactaggttttgatctagtagtggcagctggtggcgatggtacaatcaacgaagtggttaatggaatcgctccgcttgaacaccgtcctaaaatggccatcatcccagctggtacaacgaacgactatgctcgagcattaaaaattcctagagataatattaaagcagcagcagaagtgattaaaaagcatcaaaccgtaaaaatggacatcggcctttctgataacagttacttcatcaatatcgctgccggtggctatttgacagaattgacttatgaagttccatcagaactaaagagtatttttggttatcttgcttatcttgcaaaaggagcagagatgctccctcgagtaaagcccatcaaaatgcgcttgaagtatgatgaaggggaatatatcggaaatgcttcgatgtttttcctagggctgacgaactctgttggaggattcgaacagatcgcgccagatgccaaattggatgatgggaagttttctttaatcattgtgaagacagcaaatatctttgagatcttgcatattgcggcactcatgctgaatggcggtcgacatgtcgatgatccaagagtaatctataccaaaacaagcagtttgttcgtcgaaacagaagatgatatcaatcgaccagtaatgatcaacttagatggtgaatatggcggggaagcaccgatgcatttccaaaatcttcatcagcatattgagttctttgccaataccgatcagattcctgatgaagcaatcacaggcacagatgaagaagaattagaggttgttagcaaagaatttgtaaaagaagtcgaacgtttaacggatgaagatatcgacggtgacggaaaaatagcagacgaaacacctaatcaaaagaattaatcaaaagccggtgctgaacgtagtaaggtcagtgccggttttagttgtgtaattagctgatttatagtagagttcagtaggattgaaaaataggcttaaaggagcaaaatatgacagaacagcaaatagtaaagaaaaacgaacgatatacagtcgaaatcgtcgacttgagttatgaaggaatgggggtagcaaaaatcgatggttatccattatttatcgaaaatgcactccctggagaagaagtagaaatactagtagtaaaagcaggcaataagtttggatatggaaaagtcgaaacatttattacacaatcacctgatcgtcagcctgtagaaaacaatgcattacttcgcacaggtatcgcacctttagcccatttgaagtatgaacaacagcttgtcttcaaacaaaaacaagtagagcatgtaatggcgaagattgctaagatgccagaagttcctgtacttccaacggtcggaatggcagaaccatttggctaccgtaataaagcacagatccctgttcgccgtatcgatggacagttagccaccggtttttacaaaaagaatagccatgatctagtacctatcgaagatttttatatccaagatcctgtcatcgatcaagcaatcaaagtagtcagagatatcttgcaacggttccaagtacgaggatataatgaagaaaaaaatgaaggacagcttcgtcacatcattatccgtcgtggtcattattcccatgaaatgatggtcgttttagttactcgtaaagaaaaattctttaaatccaaggaaattgctgaagccattcatgaagaattgccagaagtggtttcggtcatccaaaatatcaatgaagaaaaaacaaatgtgattttaggagacaaagaaaaagttttatacggcagagactatatcgaagatcagctattaggaaaaacctatcgaatctcagcgaagtcattttatcaagtaaatactcaacaagcagagtatttgtaccaaacagccatcgaatttgccgagttggataaaaaagacattgtgatcgatgcttattcaggaataggtacaatcggattgtctctagctgacagagtagataaggtatatgggatggaagttattccagaagcaattgaagatgcacagttcaatgccttaaataataaaatcgaaaatgttcattatgaagtcggaaaagcagaaaaagtcatgaaaaaatggcaagaaaaaggggtcaaaccatctgtgatcgtagtagaccctccacgtaaaggattagatcatcattttattgaatcagcaatcgaaatgtcaccagaacgaatcgtctatatctcttgtaatccagcaacttttgcaagagatgctaagttatttgcagaagcaggttatgttgtgaagaaagttcagcctgtagatcttttcccgcaaacccatcatatcgaattagtcgcttcattcgttaaaggagaataaaaatggaccaaaaagaaaaaatgaaagaattgatcaaaaagaaacaaggtggaggccgatccaaacaaatggaaacacctaagaatgatcgtaaaaacatgagaaaaggccctaaaatctttaataaatagacgtgctaaagaaagactaagaagcgttaacttttgttattgtttcttagtctttttagttagtctacattattttggcgatttgccaataaggacttttgagttgtgcaaaatcaaatctgggtcagaatgaacgtcattctgtctcagatttttcgttatttcaatttgattaattgattgatcaaaaagatttttattttcatattctcaaatgattcaacactaaatatacatgtttgacgcggaaattattattcgatttgggcggcatcaggaggttatgacgacgtagcagacccattattttactcaagaaaatgtccgtgcctattatttagaatacgatagtgaacgtgctgggagttttgttcttttagagaaagtctctgaagataaattagttgtcttagattttgactgcaatgaaaaatggcgaactggaagagcaccagcaagtgattgaccggatctacgaagcgacacgatatctgcctttggatcgtttgtgcttaagtcctcaatgtggatttgcttcaacagaagaagaaaatgttttgtttgaagaacaatggaaaaaatttcttttgtcaaaagcattgcagaagaagtttgggtaaaatcattaaatcatctaggagagcttgatagaaaataacactatggtataatcagaatgcttaatactaactactgagggagccttatgaaaaagaaaattcttaaatttatcggatggttcttcggaatcaatcttgggatcgcgtttgcaatctttcttgccttccagctttcccccagacctggagcattcttgatcaaccatatgttttcaaatactgttcaaatcactgataaaaaaacgttcgatcaagcagaaaaaaacgtggcgaaaaaaacagatttgacgtatgagtccaagtataaagagaatacctatgacatctactatccaaaaaacagcaaggggcctgttcctgttctattttgggtacatggtggaggattcgtcggcggagataaatcgggtgtcaaagaatttgcgacaaaattagtttcagacgccaacatcgcagtagttgcgatgaattatgaattagcgcctgattcagaataccctaatcaagttcttcaagtgaatgaactgatcaaagatttattagctgaagaaaaagacgacaaattgctagacatggaacaactattttttggtggagatagtgcaggttcacaaatcgcattgcaatatgcagctatacaaacgaatgacgcgtatgctaaacaaatgaaaatcaaacagctacttccaaaagatagtctgaaaggaaccatttcttattgcggacctgttgatttgaagctaacagcacagcagcattcggatgatcgatttatgaagtttttcgtcaaaaccgttgcgtggtcgttgattggaacaaaagattggaaaacgagtgagcaattgaaagaagccagtgtggctgaccatgtttctaaggaatttccgccaacgtatataactgacggaaatgcttactcattccaagaacaaggtcaagcattagaaaaccgattgacagaattaaaagtacccgtgcaatccttgttttatacagatacaaaaaaagagattactcatgaatatcaatttgattacacgttaaaagaatcgcaaaattgttaccagcagacattggattttgtgaataagtataagtaagaggctgtgatcctgccgtttagttttgagtatgaagaaactaagcggctttttcacaacctctttttcaatatttttttgttcttgggataaaactatcccgaacaatcaatcgcgcaggataagtcaaaatgatcggttcatcacgtataccgtcaattcgctccaatgccattcgaacagctgcttgcccaattgattttgcattgatttgaacactggtcaagctaggggagaggtttgcaattgtctcgatattatcgaagcttgctacaacaatctcttctccaatttggatgtttttttgcttcaatgcccgatagacaccgattgccattggatcgctcccgacaagaatggcagtaggaagaggggattcattttctaatagattagtcgcaagtacctcaccttgtttttctgtccagccacctagacgataagacatatatttttctaagtgatgatcgatcataaaatgctgataggcacgcatcctcttttcatttatagaaatctgcttaccaccgaattcatccatattgactttatatcccccgatataggctattcttttatggccattttctaagaacaattccagtacggttttagtcatccgttcaagatctgcatagaccatatcgacctcttgctggatgtcagggttatccacgacgactatttgcatgttttgttttaacaaagcggtaatcgattctttcgtaacagtcccaacaacgatcaccgcacctaactgatctagatcttcccattgtttaggattatcagatagattatagattcgattcatccctaaatgcagacggcgagcttcttcttccatccctactcgcaaatgtttgtaatagatatcctgttcttcgctcgctttgccgatcgtagagatcacaccaatcgaaggcattctctttttgatatatttacgagtactgatgtcataatccaacgcagcagctgcctctactatccgttgccgagtagcctgagccacatggatcgtctgatcgttattcaacacgcgggaaactgtagcaggagagacatttgcctttcgtgcgacatctctaattccaaccatttttacacactcctcaaaaaaataaaaaatttctattgacaaaattgtttagtaaacagtatacaggaattataaaaaaagtaaacggtttccgttttgatgggagtgaaatgatggatattacgcatagaaaaacagataaaaatttcatcttatttgatgaaaagagccgagtcttccatttacgaaatacatttctttcttatctgataaagatagaagaaagcaatgtattggcgcatatttattttggcaaaccagtcaagcagtacaaagacaataaaaattatccccgaagagatcgtggattttcaggaaatgttcccttaaatactgaccggtctctgtcgaaagatacactaccgcaagaatactcttctcatggcagcatggactttcgaacgcccgcatcgatcattcagcgcaagaatgggtcagacttactggatctgagatatgacagccattatattacagatgggaagccagagatcgaaggcttgcctcaaacttatgtgatggacaagtcagaggcacaaacgttgatgatttcacttaaggatagagaaacagcgatttatttcgatttgttctataccatatttactgatagagcagtgatcacacgatctgtaaagataagaaatgaaaccggagaaacaatcaaactagaaaaagcagctagtttccagctagactttgcccatactaggcgatttgatgaagtcattgctttgccaggagcacatgtcaatgaaagacagatttcacggcaatctgttttatctggaacaaaagtatttgaaagccgtcgaggaacgagcagtcaccatatgaataactttattgctttagttcatcatcatacgacagaaaatactggagaagcgatcggacttcaatttgtttattccggcaaccattctttcgaacttgaaaaagatcaaatcaatcaattgagagtcgtcggtgggatcaacagccatcgtttttcgtgggaattgaatgcaggccagtcttttcaaacacctgaaatgatcctttcttactcaagtcagggattgaacaaaatgagtcagatccaccatgagttgctacgtgaaagaatcgcaagaggtcgtcatcaatttgctgaacggccgattctggtcaataactgggaagccacttactttgacttcaatagtgaaaaaatcaaggcgatcattgatgaagcaaaggagctaggcatcgaaatgttcgtattagatgatggctggtttggaaaaagagatgcggacaattcttcattaggagactggttcgagtatgaaggcaagttgacaaatggattacgtgaaatagcagattatgctcatagcaaagggttgaaatttggtttatggtttgaacctgaaatgatctcggttgattctgaactgtatcgaacacattctgattttcttatgcaggagccaggtagaatgccttctgcttccagatcacaacatgtactggattttacaaggttagatgttcggcagacgattgagaaacaaatgagaaagattttagatacgattcctcttgactacatcaaatgggatatgaaccgttcgctttcagatgtctattcgattacccttgacccacagagacaaggagaagtagcgcatcgttatatgctcgggctttatgaactacttgaacatttgacaactgattatccggaaatcttatgggaaggctgttctggtggaggtggacggtttgatgccgggtttatttattatatgccgcagtcatggacaagtgataacacggatgcagtggagcgtatgaaaatccaatatggaacaagtcttgcttatccgatttcgtccatcacagctcatgtatcagctgtgccaaatcatcagaccgacagatctacttcgttgaaaacaagaggagaaacagctatgagcgctgtttttggttatgaactggatttgacaaagttgtctcctgaagaaaaaaagcaagtcaaagaccaaattatatcctatcaaacgattcgtccggtgatccagtatggccattattatcgtttggcgagtccttttgaagaaaatattgccgcatggatgtttgtgtctcctaaacaagatgaagctattgtgtttttagggaggatactagcttcagctcaaccagcgttccatgaagtatatctgatggggttagatgatgaggcactttatcaggaacagacctcgaagcggatattttcgggggccgaattgatgacagttggactttacttccccgattttcaaggtgatttccaaacagaactgcttcatttcaaaaagttatgagagagaaggaaaaaagtatgaaagcaaatataaaatggttagatgatccacaagtttttagagtgaaccaatcaaatgcacatagcgatcatgtttgctatgcaacaagggaagaagtagaaaccacatcctcccttaaacagtctttaaatggaacatggcgtttttgttattcgccaaatccttcggtacgtccaaaaacattttataaaaaagattttgatgcctgttcttttgatgaaatcactgttcctagtcatattgaattagcaaattatgacaagatccattacatcaatacgatgtatccgtgggagggacatgtatttcgccgtccccctttcacgacaagccctgagaaagaggcggaagggatcttttcagctgctaaagacaatccggttggttcgtatttgacgacttttcgattagaagaaggtctaaagggaaaacaaatctcgattcattttgctggtgtagaacaagcaatgtttatttggttgaatggtcattttatcgggtatgccgaagattcgttcactccgtctgaatttgatttaacaccttatttggaagaagaaaatattctagctgtggaggtttacaaaagaagtacagctgcattcttggaagatcaggactttttccgattttttgggatcttcagagatgtcttcttagttgctcgaggacaaaaccatttagaagatctttggatcaaacctcgcttagatgacaaatgtcaaaatggcaaacttgaagtagatttgtcttttgagcaagtagccaaaaacagtcagctgaatgtagcgatactagatcctgatgggaaggaaatctatcaacagcaatatccgttaaaagagcaaatgacgattcgcatcgatggatttgaaaatgtggcactgtgggggcattttcagcccaatttatataagcttgaattggagacgatagacgaagaaaaaagagtaacagaatatattgactattccttcggttttcgtaaaatcgaaatcaaagataaaatcatatacttcaatggaaagcgaatgatcatcaacggagtaaatcgacatgagtggcatccgaaaaaaggacgcgccatcactatagaagatatggaaaaagatttggctatcataaaaaatgcaaagatcaacggcgtacggacatctcattaccccaaccagatcacttggtattatttatgcgaccaagcaggaatccatgtgatggcggaaacgaacctcgaatcccatggctcatggcaaaaaatgggcgcatttgagccttcttacaacgtaccaggtgcagtacctcagtggcaggcggctgttcttgatcgagcaaaaacgaatttcgaaacattaaaaaaccatccaagtattcttttttggtctcttggaaatgaatcttatgcagaagaaaacattcgacaaatgaacgattacttcaaaaaagtagaccccgatcgacttgtccattatgaagggaattttccaaatccagcattcgaagattcgatttcagatgtaaaaagctgcatgtatgcgccaccagaagagatcattgactaccttgaaaataaagcggaaaaaccgttcatcctatgcgagtatatgcatgacatggggaattcgttaggtggaatggattcttacatgacgttgcttgatcgttatgaaatgtaccaaggaggctatatatgggattttaaagatcaggcgatccaagtgactgatccaatcactggtagagaagtgatgcgctatggcggtgactttgacgataaaccaagtgactatgaattctcagggaatgggatcgtttttgcagatggacaagaaaaacccgccatgcaggaggtaagatattattatgaaaaatacagtaaataaaagtcatatggatacggaaaaagttgcaatcgtcttcggcgactgtacattaggtgtcaaatcggggaatacgcattatattttttcttatacaagaggcggactggaatcgctcaataaaaacggaaaagaatggctataccgggaaacacttccagttttttggcgagcaacgaccgataatgacagaggtagcggatttggatttaaatccggtatgtggttaggagccggattgtatccaaaagtcaaagaaatagaagtactggtggacaataaaaagatcgatttgccgattgctccagtaaataatcaatattcaagtaatgaatacgctgaaacggttgaaatcatttttacactggaaatcaacacagtaccaaaaacccaagtgacaatttcctaccaaatcgctggagagggtaaaatgcttgtcaatatgcattattatggacaaaaaggattaccggaattacccgcattgggtttaaggttcattatgccaacgaaagcaaaattttttgagtatgaaggcctatcaggggaaacatatccggatcggatggctggtggtgtcgaaggtatttataaagtggcaggactccccgtttccccataccttgttccccaagaatgcggcatgcatatggaaacgaaatgggtagaactaacaagaaatcaaacgttggataatacggataaagatcaagaagatttttcgttgcgatttgaacagcaggatacgccatttgctttttccgctttaccattcaaagcagaagaactggaacaggcaacacatatagaagaactaccgccagaaagacgaacggttcttacgatttttgcaaaagtaagaggagtcgggggtatcaatagctggggagcggatattgagtcaccttaccgaatcagcagcgaagaggaccatgaaatcggctttattattcagtagcaatctttagattattatttgaaaaacggagtgtacaagacaaagctgctttattctatatgtcatgaacaagagagtaaaaaagttctcagatacttttgttcatgactattttcttcaataaaaccaattgttatttttctgaaaaacaaagttaactatcagaaaattaaaaaaagtttcataaaaatgattgacagtcgatttttttatgtctatactaggtacaattcttacatcagtttggagcgattttttatgaaatctagaaaacttacaaaactgaatacgtattactttagctattttagataggtttgtattcatgacttcgtgggtacaaacaaaccaggtttgtatctatgatggctaaagatttttaaacacgacttacagccacgtagagaaattcatctatagtggctattttatatttttgcagcgctttttaaggctcgttgaagatgttcactgtagaggcaatttcctacagggacatctttttttgttgattatctgggtcataagtaggaaagaaggagcgaaaatgagaacaacaggacacggtcatttagtaggaattaatgtaaaaccaccttgaaaaagtagagaaaatcagccaagatagataagtaaacaaaagaaagcgggaaaaacaatgatagtaattatgaaaaaagaagcaacggaagaacaaataaaaaaagtcgtcgatcatatcgaaaaagaaggattcaaagtctcaatcgatcaaggaacagaacgagtagtgattggactaaaaggtgatacgcgaagtttacaagaaggagcatttacacgctatgaaggagtagaaaatgctgtgcgtattttaaacacatacaaattgacttctcgagaattccatcctggcaatacagtcgtggatgtagacggagtaaaaattggtgacggcagtttcgtgacgatggctggtccttgttctatcgaaggattagaccaaatcagagaatgtgcgcgaatggccaaagccgggggcgcaaaaattctgcgaggtggtgccttcaaaccacgtacttctccatatgctttccaaggtttagaagaagaaggattgaaatacatccgtcaagcggctgatgaatttggaatgaaagtgattactgaagtgatggatgaagggcatatcgacatggtggctgagtacagcgatatcctacagattggcgcacgtaatatgcaaaattttaaactgctatctgctgtcggtaaaacaggtaaacctgttggattgaaacgtggaatttccggtacgatcaatgaatggcttaatgctgcagaatacattgcagtcgaagacaaatctcctgtcatttttatcgaacgtgggattcggacttacgaaacagcgacacgtaatacgtttgatttaagtgctgtcccattgatgaaaaaattaactcatttccctgtgattgttgatccaagtcatggtacaggaatttgggatcttgtaccaccaatggctcgtgcgggtgtggcaagcggagcagatggcatgatcgtagagatccatcctgatcctgcaaatgcttggtcagacggtccccaatcgttgaatgaaaagacttactcacgcatgatgaaagaagttgcgatcatgaaagaagcaatggaaaagattcagacactcgattaattccagctttttaaaagaaagaagtgaaatgaatgcttactgtacatgttgataaccaaaaatacgatattcatattgaaaaaggcgcactagaacaggctggatcatggcttcaaacgatttggagacctcaaaaagtagctgtgatcactgatacaaacgttgctccactatatgcagaaaaaatcatgttccaattgagacaagctaattttgaaccagtcctttcaatcgtaccggcgggtgagaccagtaaatctttagaacaagcagctgagttatacgattttttagcagataatgattttacccgcagcgatgggatacttgcacttggtggaggaatggtgggtgatctagccgcattcgtggcctcgacgttcatgcgtgggatccatttcgttcaaattccgactacgctacttgcacaagtagattctagtattggcgggaagacagcagtcaatacaaacaaagcgaaaaaccttgtcggaacatttagccagccagctggtgtattgattgatcctgaggttctaaaaactttgccggtacgtcgtttacgagaaggaatcgctgaaatcatcaaatcagcagctatagcagatgcaacgctttggaaacagctgaacgagctgaaagacgaaaaagatcttctggaacatgctgttccaatcattactgctacgttggaaatcaaacgaaaagtagtggaagaagatgtctttgaccaaggaaatcgacttattttaaattttggtcatacaattggccatgcaattgaaaatacagcaggatatggggtagtcagtcatggagaaggagtagctattggaatggtagccatcacttctcatgcagaaaaaatcggcttgtctccaactggatcgacagctgctttagaaaggatacttcaaaaattctatctgccgattacgtacgatctaagtcatccagatgaattattccacgcgataacccatgataagaaagcaagaggaagccaattgaatatcatcttgctagaaaagattgggcaagcaaaaatcgttcctgttcccacagagacattcaaagattacttaggaggactgtaaaatgcgttatatgactgcgggagaatcccatggaccagaattaacagcgattattgaaggactaccagcaggattacctctgtcagaagaagaaatcaatcatgaactcgctcgcagacaagctggttacggcagaggaggaaggatgaagatcgaaaaagatcgtgttcggatcacgtctggcatccgtcacggcaaaacaattggttcacctgtcactttagtggtagaaaataaagattggaaaaattggacaactgtcatgtctgtagcagaagtgcctgaaaaagaccaatcactgcggcgagttgcacgtccgcgtccaggacacgcggatttggtaggcggtatgaaataccatcatcgagatcttcggaatgtgcttgaacggtcctctgcaagagagacgaccatgcgtgtagcaatcggcgcaattgccaagaaaattctggaagaacttgacatcatcgtagcaggacacgtgatttgtcttggtggaatccaagcagaaatacctggaaatatctcgattcaagaaatcaaagaaatttctgaagcgtcagaagtacgagttgttgatccagcagttgagcaaagaataaaagatttgatcgatcagacaaagaaaaatggagatacgatcggaggaattgtagaagtgctcgttggaggcgttccagctggattaggaagctacgtacaatgggacacgaagctagatgccaaaatcgcacaagctgtggttagtatcaatgcctttaaaggcgtagaatttggggtcggattcacttctggttcattaccaggctcagaagtgatggatgagatcctatgggaagaagaaagaggctatttccgacgtaccaataatctaggcggcttcgaaggcggaatgaccaatggcgaaccacttgtcattcgcggggtcatgaaacccattcctacattgtacaagccacttcaaagtgttgatatcgatacaaaagaaccttacaaagcaagtgtagaacgttcggatagtacagcagttcctgcagctagcgtcgttgcggaaaatgttgtagctactgtggtagcgacagagctattgtcaaaattcccaagtgattcgcttgttgagttgaaagctgcagtgaaggagtaccgtgactacttgaaacattattaaaaagggggcaaataagatggcacaacatgtttttatcgtggggcttggactgattggtgcttctatggcactttgtattcgtcagaccaatccagaactgatagtagttggttgggatagtcagtcaaaaacccgtgagcaagcagtagaacagcagatcgttgattacgttgcaaatgattttgaaacaggtgcagaacaagcagacgttatcttattagccgttcccgtccgtacaaccttagcttatcttgatgtccttgaaagaatcaacttgtctgatcacgtcatcattacggatgtcagcagtacgaagcagcaagtcgtgacatctgctgagcagaaaaatcttcggtttgtcggtggacatccaatggctggttctcataaatcaggtatacaggcagccgatgctaaactatttgaaaatgcctattacatctttacacctttggaaaagacgaaaaaagatgttgaaaaactgcaagaactattttgcggaaccaaagcaaaatatgtaactcttacagcaggagaacatgaccgtataacaggaatgctaagtcattttccacatattctggcagctggtttagtcaatcaggcagaacaattcaatcaagaatatccgcgagccaaacaactggcagcaggaggctttcgagatatcactaggatcgcttcctcagatcctgtcatgtggacagatattttgttgagcaataagcagatattattggaacgattggcagattggcaacaagaaatgacacaaatagcagaatggatcatgactgagaaccaatcggaaatcttttcttttttcaatcgggcaaaagaaagtcgagaccagttgcctgtccataagcaaggcgcgattcctgccttttttgatttatttatcgatgtgccagatgaacctggcgttattgcagaagtaactggactgatcggaaaagcgggagtttctttgattaatttgaagatccaagagaccagggaagatattttaggaatactgcaaatcagttttaaaaaccaacaggatttgttacaagcaaaaagaatcattatgtctaataccagttatcattgctggatcaaataggaggctggataaatgcaattattacaacaaatacatggattaagaggaactgttaggataccagcagacaaatcaatttctcatcgcagcatcatgtttggggcaattgcggaaggaacgacgactatacaaaattttttgcgcgcagaagattgtctgagtactttacatgccttccagcaattaggcgttgaaatcgaagaagaggaagagatgatcaagattcatggtcgcggtagccactcatttgtccaaccaaccgaatcaatcgacatgggaaactccggtacgaccatacgtttattgatgggtattttggctggacagccttttacgactactctgttcggggatgcttcgttgtctaaacgtccaatggggcgagtgatggaacctttacgcgagatgggcgctgacttgcaaggaaaagagaatgagcagtatctaccaatcactgtgacaggaaccaactctttatcacctatccgatacaatatgcctgtagccagtgcgcaagtcaaatctgctttgctgtttgcggcattacaagcagaaggcacatccgtaatcgttgaaaaaaaacgttcccgtaaccatacggaagaaatgattcgtcaatttggcggaaggatctcagtagaaggtaaaacaatcacggtaacaggaccacaaaaattaactggtcaacagataactgttccaggcgatatttcatcggctgctttctttctagcagcagggcttcttgttccggaaagccaactgttgttaaaaaatgtcggggtcaatccaacaagaaccggtatcttagatgtgttggaggagatgggcgcagcgattacccagacgaatcacaatgaacagaaccaatcggctgatttaagtgtcaagacgagtcatttgaagaaagcaacgattggtggagaaatcattccacgtctgattgatgaattgcctattctagctttggtggctactcaagcagaaggaatcacgatcatcaaagacgcagaagaattaaaagtaaaagaaaccaacagaattgatgcggtggcagaagaattacagaaaatgggagcaaagataaaagcgacagcagacggtctgatcatccatgggccgacacctctgcagggcgcaaaagtgtccagcagaggcgatcatcgaatcggtatgatgctgcaagtagctgctttgatagctgatggaccttgcgaactagaaggagctgaagctgtttcaatctcttatccggcattttttgacgatttagcagaacttgtgtcaggaggagaagctcatggctagcattttgctgattggtttcatgggcgctggaaaaacaacaatcggtaaagggttagctcaacgtttacaaaaagagtatgtagatttagatacaaagattgaggaacatatccaattgtcgattgccgaatattttcactattacggtgaaaaaagctttcgaaaagtagagtcagatattttaagaaagctgtcaaatgaagataaaattatcgcgactggtggagggattgtccaaagtgcagaaaatcggcgttttttaaaaacacagccgattgttctttacttagaggcagaagcggactgtctagtagatcgtatccaacaagataaaacagctattcgacctttagctcttggaaaaacaagagaagaaataaaagcattattggcacaacgactttcttggtatgaagaaagtgcgacacatcgaatcaacacgaccaatcaaacaccagaaaagatcatcgataccattatagaaaggatcaaaagcatatgaacgtcagctatctagggccagaaagttcattcacttatcaggcggcttgtcagctatttcctacagaacaattgactgcgtatgcttcgatccctgcttgtttgcgcgctttgtttcgcaaacaagtcgatctggctgtcgttcctgtagagaattcattggaaggatctgttcatcacacaatcgatcttctttccaaacatccagaagtcgaagttaaaagtgaaatcgttcttcctatcaagcagcagcttttaggcaatccagcaacaaagattacaaaaatcctttctcatccccaagcactagcacaatcacaacagtttttagaaacgcattatccaaatgtacctttagtagcaacagaatcaacaactgctgcagcaatgtatgtagcagaacatccgaaagaagacgcagcagcgattgcttcattagaaacagcacagcatgttggattggagatcttagctgagaatatccaagataatgagttgaatcagacacgtttttggatcataggtgaccgaaagatgaccagccagcagccagctccagtaaaaatgagtgtcatcttgacactacctgctaatcggccagggatgcttcataaaatgctggcagctttcggatggcgggagatcaacttaagtaagattgaatcccgaccattgaaaaccagtttgggagaatattttttcgtgatcgatttgttgttggaccgtccaatgacattagtagagaatgcgctccaagaaatcaagatgctcggaggagaaagtcaaatattgggctgttatccagtgctgacagtagaatagacgcgtagatgaaagtcaagaatactgattgatttatttaacttaaaataaaaaaatcagtgcttggctattctttatttttgatattctgattgatttttaggaagaagcggtagacaaatcgttacagtcgttcctgtcccaatcactgattggatcgttaagccatatgcatcgccatacattaggcgtatccgctcatctacatggctgatgccgattcctgagaaatgatcatttttttgtttggtattttcagtatcgaagctatcgccgttatcaatcacttcgaataaaagaagctgattttttgttttgccgtacaccgtgatgaatccttgcgttttattgtgaaaagcatgaagataggcgttttcgataattggttgaaggatcatattcggcatagataatgactgcagttcatcaggaatcattattttagccgagattctttcgccatatcgcatactcaaaagatcgatgtaactttgtacgcttttgatttcctccttgactggaatcacttcttcttttttcccaatcgtacttcttagtaaagtaatgaaactgtcgattccttgaactgcttcatctgtttttttctgccaaatcaaaaatttcaagctagtcagcgtattataaataaaatggggctgtatctgtgcttgcatagtttggatttcaagcgaacgtttcttcttttcgtcttggatcgtctgttcataatgatgctgagcattacttagcaattgattgatcgtattccctagcaattggacttcatggcttccttgtacaggaacagtagcttttaagccatcttcctctagccgttttagcgaatcaatcaagcagtagatcgattttgtgtgtcgatccaaatacataaataccaatgagccagcaaaagcaagtgtcacgatattatacaaaataatcggaaaaatcacgcccatttggttagacaaagaatgaagatcgacttgactgagtaatgtacaatcctggcggtacaaaggaagacgggtcaactgctgtccatttgaaatcgttgtttcacctactgttagttttttgaaaatcattgatcggctcccaattgtattttcttcatttgatgcgatgatcgtctgttcttcgttcatgaaggagatcttcgatatctcaggatttactacagattgaaaaagattcgctagttgcttggatgagatcgataaaacagcatatccgtaaacgtgattcaatgtatttttcagttttttgacaaagaagacgctgggtgctttcttatcgcgaagagtcaatccgtggtgtgcaaaaagcatttgtgtatcagcagcacgttcattcactttctgagcaatcgcagattgaaaaaaagaatcggcagatacggcagtgagcatgtcgtttccgacaaaagttcttccattttctccaaagatcaatacatcgtaatcgatcattggatggatttttgaaagagagtcattcattttttggattgttcttagttgctgaagctgttccatatgttgggctggagcattggaaaaatagctttcgacagctggattagaatcaaaagcggctaatgtattctcgattgtatcattcaagctttcaaattcagattggatcttttttagtaccacatcattcgattgattgaacagctggatataggcatcccttgatcgatgataaataaacaaagagatgacgatggcttgcagaaaaagaccgatgaacaaaatgaacaaaagtttggtaaagagttcatgctctttgattttttttctcattttacaaaagttcctttacggtcttgagaaggtgtcattcctgtctcttctttaaaaactctggagaaataacccagttcggtatagccgactttctcacagatttccgtcaaagtaagccgtgtttccgttaaaaagagcttggctttactgatacggactttttttagatattttgaaaagttgatgccaaatttttcagtaaagatggctgaaagatagctatatgaaaaatgatatttttcggatagaagttgtaaattgatttctttctcataattttcctggacgaactcgtagatcaaagtcaagatatcgaaattgtctttttttgcatttgcagaaaagtgggtgagtttctcaagtgtttctttgacaagaatagaaaaatcttcgaaatactcagcatcggctaataaagaaggaagggcgatcttgagcaaagaaagttcttcattcccaacatgctcgtcagccaaagcgttgagtaatgcatagaaacgattgattgcctcatgtttcaaataagctggatcaataggctgttccaatatcgtcgtgaagaaattctcaagttctttgatagttaaagagtagtctttatgaacgatttttgttaaataactacttgcttgctgctcgtggttggttaataacggaagaagttcatgctgataagcaagattctttcccttatgatagaaacgttgtcctttggtgcaatttctgatctcttggaatatttcattgatatcttggattgcaaaagaatcagaaacaacaaaaaaatcacctggaaaaacttcttgacgaaacttttgaacaaacttcctaaatgtatctttggaatcagtattgatcacatagccggattcttccgaaaaggtagaaacaggataaatagtaaacgaatcgtcgctatccatcaatgaatgggtgatcgactgtttttgtttagagccttgttttgaactgaatggccgtttttcggtatataacagaaaaaacagggtgtgttcaaaaagaagagggtcaagcaatggacgagtttgtccagcaatctgctgtgaaagattctcgcagatctgctcataacgattggtgattgggcttttgttgggctttttttgattttttgtgaaacggcagttaaggaatttagaaaaaaatcaggactcaatcgaggctttaaaagataatcagcgacgccttctttaaaagaatctttaaccatatcaaattcatcatagctagagaggataaggatctgtgtttcaggttgttgctgttttaatagccgcgataattcgattccatttaattcaggcatcattacatctgtgaccacgatatcgattgcatgtaccaaagaaaaatcaagcgctttcagcgggctggaaaaagtccctattaattgaaacccgtgctcagaccaattgatcaactgtttcattccatctaaaatcgtctgttcatcatcgataagaattacgcgtattggcatttttttacccgccttaagaatagtcttgtaatttaaaaatacttatttctaggagaaaatgcaaggatatttttattttaaagaaacctcaccatttcgatctttggtctagatgctaagattattccttttgtcatagttgatttgtatttttttattattttaggagaaatttttgaagtatctgaataacaaagaaaccgttttcaaattttggtatgatgaatgtagcaaacgtaaacaactaatggatggaaaaggagcggataaaaatgaacatcagaaagttaattgctggagtcgtttgtttagcggcagcatcaggtttcttaacaggatgcggaagtgctagtagtacagcagacaacgaagaaaaagtcactgtctgggcgtgggatgagacattcaatatcaaagcagtgaatgaagcaaaaaaagtttatgagaacgaagaaacagagatagaagttgttacgatgtctcaggatgatatcgttcagaaactgaacaccgctttagcgagcgggaatacagaaggattgcccaatatcgtcttgattgaagattataggatacaaggctatttgacttcttatccagatgcattcgctgatttgtctgctattgtaaaggaagatcattttgcaccgtataaatttgcggtaaacaaagtaggagataaaatatacggtgttcctttcgattcgggcgtaacagcaaacttctatcgtacggatctgatggcagaagcaggttatacagaagaggatatggataatctaaaatgggacgagtatattcaagtagcgcgagatgtcaaagaaaagacgggaaagaaaatcgctgaagtcaatccttctgaccttggtcgagtaaggatgattatgcaacaggcaggagaatggtatacatctgaagatggggagacagtcacgatccaagacaatgcatctttaaagtatggtcttgaattgtttgccactcttttgaaagaagatctagtcgaacaaacctctgactggaatgctggagtaactgcgatacaatcaggagcagtagcttctagcccaactggcgcttggtattcttcaacgatccaaggagcagaaaaccaatctggaaaatggaagattgcaccaatacctgtacttccagaaaatctgcaaaaagcgcaagcttctaaccttggcggcgctggctggtatgtgatcaaaggagtagctggagaagattcagcgaaagatttcctagaagcaacgtttgcttcgaatgaagaactgatgggcactcttgcgaaagaaatcggactagtatctacgatgcttagcgcgaatgaacaagaagcttatcaagaagcttctgaattttacagtggtcaaaagatctttgacgatttttcaacatggacatctgaaataccagaagtgaattacggacatgagacctatgcaattgaagcagtcgtagctgaagctcttcatcgaatcatcaatggagaagagacagacaaggtactagcagatacacaaaaacaagtagaagcacaattggctaattgatcggtggtaaaaaagtgaatttcttcgctttttcatcagacaaacgaaaagacaaaaaagatcacgtctgccttacagatgttgtctttcttgtcttttcatgtagataatcaatgatagaattggagggaaaagaatgaagcagaaagatttattcaaaaacgggtatgcttttttaatcttgccagtcattttgatatcaatcatggtttttattccgatggttttggctttgatcacgtcttttcaaagtggtccccctgtcaatatgacatttaacgggttaggtaattatcagcggatgttgacagatgcaacttttaaaaaagctttttttaatacattcctgtatttgcttgtacaagtaccaatcatgttgtttctagcactttttatttccaaccttttaaatgataaaaagttgaaatataaagggttgtttcgaaccgctatctttcttccatgtatcacttcgatggtcagttattctctgatcatgaaaagtctattttctcaatctggccttgtaaacaacttgttgttgggcattggtatgattgacacaccgattggctggttgactcatccaatttgggcgagagttctgatcattctttcgatcacttggcgttggactggatacaatatgattttttttctttcaggcatgcaaaatattgattcggagatttatgaagcagcatctattgacggtgcttctaaatggcagcagtttatcaaagtgacgatcccaaatttaaaaccaatcattttgtttacttccattacttcgacgatcgggacattgcagctttttgatgaagtacaaaatattactggcgggggaccagcaaatgcaacgaccaccctatctcaatacatctataatttgagttataaattcacgcctaattttggatatgcggcagcagtttcctttgttattgtttcctttattgtgatattgtcgataatccaaacgaaagtaggaggagaaagtcgatgaaaaatatggtagaaaaagaaacaatcgaacgccccaacgtcaaaaaacaagcattagaacttcgttcgacaattgggtcagtattaaagtatacagcattatgcatcctatcatttatttccatttttccttttgtctggatggttttgggaatgacgaatacacccgtggatatcacatcgggaaaaataaagattggcagtaacttgatcatcaattttcaaaatttgtattccaatgagctgaattttactcgttccctttggaattcagcgatgatcgctttggtgaccactgtgtttgcattactgatttcgtcaatggcaggatatggatttgagatttatcaaagtaaacgaaaagacctaattttcaatattctactgctatcgatgatggttccttttgcggcattgatgatccctttgtatcgaatgttttcacaattgaacggaacggttttgggaatcaacagtttcttggttgtcatcctgccatctgttagcactgcttttttgatcttcttctttcgacaaaatgttaaatcttttccaaaagatctagtagaagccgctcgattagacggtctaaaagaactaagtattttttttagagtgtatatgccgacggctcaaaatacctatgccgcggctgcaatcatcacattcatgagtagctggaacaattatttatggcccttagtagctttgcaatctcctgataaacggacggttccgcttgttttatctgctatgggtgcttcctatacaccagactatggaatgatcatggctggattagtcatcgctactttaccaactgccatcgtattttttgttttgcaaaagcaattcgttcaaggaatgatcggctctgtaaaataaaaaaacacaataagcgcgttccttcaaagtcatttttccaagtaaaaagatacttttgggacgcgtgttattttatgttgagaaaaattaaatgttaacgttttaagtttgtgctcgaaaactctttcattttaaggtaaacttaaagagtaaaggaggaggatacatgctaaaaaattttaaagaagtgattgctgctatattgccgatgactgtcctgattgtcattttaacatttgtttttgcaccgttagaaggagaagacctcgcttcatttctggttggtgcggcaatcatgatgatcggaatgacgctctttttgtttggagcagattattctatgatggaagtcggagatctagtagggaaatatatgatcaaaaagaaaagtttggctgttttggtcagtttgggatttgctatcgggatcgtgatcacgattgctgaaccttccgtgcaagttttgggacaacaagtatatgatatatctgacggagagattggcagagtgttgctgattgggatcgtcagcgtcggcactggagtatttttagcctttgcgctacttcgggtcgtattcaagctatcctattatcaattgatggctataggctacataggcgttttgatcgcctcatttttcaccagttccgaatttatgccgattgcttttgattcgggcggagtaactactggtccagtaactgttccgtttattttggcccttgccggagggatgactagcatgatcaaacaaaagaaaaatgaaaatgacagttttggaatggtcggtattgcttcgttagggccgattcttgccgtgatgattttgggggtgatcttccaatgagtttctggcagcaagtgatagatggaatcgaaatcgttaccatggaagtcattttggcagtggcacctatcgtaatcctatttgttttaatgaatatcattagttttcgtatgcgcaaaaagcgtttctttgacattatgaaaggtttcttgataacgactattgggttgatccttttcctgcacggagtcaatatggcttatgtaccggtaggacagcatttaggcagtgctattgcgggattgccttacaattatatactggttccccttggttttttaatggggttcttagtagggtttgctgagccggcgattcatgtaatggtcaaacaggttgaagaattgagtgaaggaaggatccggtcaaaagtcatgctgatggtgatttcgattgggattggcgctgcagtagggttgtctatgtggcgtttgctcgtcggattctctctttattatttcttgatcccaggatatgggctagcatttattttaggacgaaaagtggacaagatctttttagcaatggcttttgacaacggtggagtagcaacgggtccgatgtgttcgacatttattttatcaatgagcgtggcgatcgctgcacaaattgagggaagagatccgatcattgacgggtttggtgtggttgcaatgattgcattgacaccaatattatccactttagtactaggatatatttataaacgaaaagatgaaaaagacagaatcgaaaaagaaagattgcaaaaattgggggaaagcaaatgaaagatcttgtagcattgaatcttcacatgattgtgacgatcgttgacggaggaatgggcgaagatgttatcgacttttcaaaagaagcaggtgcagcaggcggaacgatcttacatggaagaggttctggtgtacatgattcagggaaatttttaggtttggacatttcgccagaaaaagatattgtgttgacattagtacccgatagtttgacgaataaagtaatggatgcgattggtcaaggcatcaacatcgatattccaggtaatggtatttgttttagtattgatgtagacaaagtcattggtatcactaagattcatcaatatcgagaaattatcggaatgcaagaacttttagatgaaaataaagatagagaaaagtctgaatcatagacaagcgtttgaagaggaaataaacataaacaagaaggcggatgagcgttatttccgcttttttgtttgtatttttctcgtgaatacttatgaaatagtaaatttttatgaaattctactctaagcatcagactttcttttcaaaatatgctattttaaaaatgatgaaaaaagggggagaaaaatgaattttttagttgttttaaaagatactctgattgagcgatctacatttctatatgttcaattgcaggaaaataaaacattgctgcatttttcaccagagttccatctagaggggctaacattaggagaaatctatcaagcagaagggctgtcggctgttttgcacttttttaaggtagaattggaattaccagtaaaagattatatcgagctttctcttgaatcttgggatcgagcagtggttgaactgtttccagaaggtttaatgatcgatacaaacgatgggaagatccatctgactgcagcagaactgcaaaaacaaatgcgttatcaaatagatgacgaaaattctttttctatttttagacgtcagcaaaagattctaaaaagctttttaaaagtgatcagtaaaaaacggaatctgatcaaaacgacacagctgttgaaaaaatatccaggtctgcttcacacgtctattcaatttcctcaattgattacgatgatccatcgttttatacgtatgcaacagctaccatctaagaagctgtttcttccattgacggacacatttcgagtagtcaacagagaagataaaaagaaagtgattgtgattgactttaccagaaatcggaatgtccttcaccaagttgcaatggaaaaggccaattaaggctttttctttttggatttttttgtcataataaatattagatgatggaggagataatatgatgcaaacatggttagaaaggctaatacgatttcagcagaactatcacaaacttatgcagggaagatatgcgaaatttgatcagttgaatcgcggtctattgatcgctgcgcttgtctttagtttgctaagtcgttggttgccctatagaatcggacaattgttgttcatcgtctttttcggatggatgatatttcgtttcctatcaaaaaaaatctaccccagactaaatgagaatcaacgttatttgaaatatcttgatagagtcaaagaaaaatatcatcagataacaaacaaaaagcaagctaaaatggatcgaaaaagttatactttttttgagtgcccgaattgtcatcaaaagcagcgtgcacctaaaggaaaaggacgaatacgcgtgacatgcaaaacatgtggtataaaattcgaaacgaatgtttaagggagaaaagaatgaaattagtattattgcgtcatggcgaaagcgaagcaaattttgaaaattactggacaggatggctagatgttgccttaacagaaaaaggaaaagaacaagcagcagtagccggtcaaaaaatgcttgaagccggacttcaattcgatgccgtttatacctctgttttaaaacgtgcgattcttaccggacaagtcgcactagaagaaatgggtcagttatggcttcctataataaaaacatggcgtctaaatgaacggcattatggggatcttgtgggtaaaaacaaagataagatgaaagaaatatacggaaaagatcaagtaaaaacatggcgcagaggatatacggaagttccgccgttaaccgcagaaaatagatttgaccgcagatatgatcacttggatccgcacttgatcccatacggagaaagtctggaaatgacagtgaatcggatcattcccttatggcaagatcatctagcaccaaaactaaaagatcggcaagatttactagttgtgggtcatggtaatagcatccgagcactgacaaaatatttagaagatgttcctgaagatcaaatggatacgatcgatatcccaaatgcacaaccaatccagtatacattagcagatgatttgacaattctggacaaaaaaatactttaaagaatacctttatctaaaagtgagagatagaaaaaagaagcaaaggaatggaacaaaaggaacatgaaaaattatatatgggactttgatggtacgttgtttgatacgtatcccgcaatggtagatggtgcatggcaagcactaaaagattttggtatcagtatggacaaaaaagaaatctacttcaaaatgaaaaagtattctactagttatttgatcaatgaatcaaacttgaacgccaaagagtttaatgaattatttcaccgatatgaaaaagaaagtacggaagtttcccgtccatttccagaaacgaaacaagtactggaaatgctaaaagacaacggcggtcgtcatttcatcctgacccaccgtttgacagaatcaacatggggcctgttaaaagaacatcgattggcacatctgattgaggaagtagtagggatcgatcaggactttcctcgtaaacctgatccagcatctttaaattatttgatcgatacttttcatttagaaagaacagacacgatgatgatcggcgatcgtcgtttagatatcgaagcagggaaaaatgcaggagtcgctacttgtctttacgacatcgatcattttctgggtgagatcccggcagattatgtggtaggaaatctgaatgaaatccttactttgcagagcatcattaaaaagtagtatcccctttcaaaggagatatgttataattttcataaaggagtgataaaattatatggaaatcagaagacaaaaagaagttgtagaagcatttcattatgatatgagattgccgaaccaagaagtagaaacagatttgaaagtgggcttctcgcctttaaaagaaacgatcgaaaactatccgaaagaacatagcatcgtaggagcacgcttagagttccgtttagtgtttgatacatatgttttatctggaagtgtgagtcagatcaatcatatcctcaatcggaaaattgaaggtcaaaatgatgtcacacaagaagaagtggacgagctagtagcaccgttattcgatatcgtacgccgaatgtcttatgaggtgacagagatcgccttagatcagcctggggtaaaattgaattttcaatcagaaaaacaagaatagacagtaaaaacatacctgcgatagattaaagctatcacaggtatgtttttttattactaattgtaagcaaaaagaatgtcatttcgataaaaatcgtctaaaatataaaagtcactgaaaaaaattttttcaggaggatggttgaagaatcattctcgggaacctttacttccttcgatggacttgtcattaataatatgaggaggagaaaaatgacaacactcatcacagttttagtggttctagtttttgcggcattattatatgtgttctatcgtatgcaaaagcgccatacaaaattttcaacacgcgtctttacagcattaggagttggtatcgtctttggcggtctgcttcaattgatctttggtgtagacgacaaagtcgttactcaatccatggaatggatcgggattgtaggtcaaggatatgtatcattcttgcaaatgctagttatgcctttagtgtttatttcgatcattggtgcattcacaaaaatgaaagtttctgaaaagctagggaaaattagtgcgactgtattgacttctttacttggaacaacagctattgcagcattaatcggaattggttcaacaatgctgttcggactccaaggagctaaattcacacaaggagctgcagaaacagcacgaatctctgaactggcaacacgtcaggaaacagttgaaaacttatcgattccacagcagattttatcctttatccctaaaaacgtatttgctgatttagcaggtagtcgtgcaacaagtacgattggagtcgttattttcgcggcatttgtcggaatcgcttatctaggcgtgaaaagaaaagcgccaaaagaagcagcattcttttcagatttagtcgacagtctgtataaaatcattatgcggatcgtgacgcttgttttgcgtttgacaccttatggagtatttgctttgatgacaaacgttttggcaacaagtgattttgcagctatcgtcaatttaggtaaatttgtcgttgcttcttacgtagcattgcttgctgttttgattgtccactcactgattttgattggtgcaaaagttaatccaatcaactatttcaaaaaagcctttccggtattgagctttgcgtttacttcacgttcaagtgctggagctttgccattgaatatcgagactcagacaaaagctttaggcgtagatgatgcaacagctaatttctcagcaagttttggtttgtctattggacaaaacggctgtgctggcgtttatccagctatgttggcaacgatcgtcgcaccagcagctggagtgaatgtctttagtttggaatttattttgatgcttgtggcaattgtaacaatcagttcttttggtgtagctggagtcggtgggggcgcaacatttgcttcactgatcgttttaggggcaatgaacttgccagtagcaatcgttgggttagttatctctgtcgaaccattgatcgatatggcacgtacagcagtaaacgtcagcggtagcatggtagctggtatcgtgacaagtgcacgcatcaaagatttagatcgcgatgtcatcaatgatgattctaaagtgatcgatgtaaatgcatagtcatagttaaaacatattaggaaatatactaagattatagggcaaaatcatctgtcgatgattttgccctatatttttttgtgtgttttgaaaaccacctgctatgcaggtggtttcggaaagcttctagcgaggtataaaaaaagccacctaaactgataagatgaggtttcccgaccaccacatcaaaaagtttaggaggtacctttttatgaaaaaggctacagaaagtttatcacacactgtttggaaatgtaagtatcatatagtattcgctccggaatttcgtcaccaaatcatttatggcaaatacaaagcaagtattggagagattatacgcgaattatgcgaaagaaagggcgttgagattttagaagcaaatgcttgtccagatcatatacacatgttagtcagtatcccaccaaaaagaagtgtctctcaatttttaggttacctaaaaggaaaaagtagtctaatgatttttgatagacatgcagaactcaaatatcgttatggaaatagaaagttttggtgtagaggatattatgtggacacagtaggacgaaacaagaaaaaaattgcagaatatattcgtaatcaattaagagaagaccacgtagcaaatcagcttacattgtttgaagaagttgatccgtttactggagaaaaaaccggaagaaacactaagggcttctttgagaagcagcgagtaaatgtggagcaagagggaaccgattcggtaagcctttcaggcttaggccggtaaaagaggctttcagtcgcagaacaaaccacccgttcatacgggtggttttgattatttttggattatagtgaggagtgaaagaaagttcgaacaaaatcgtccttcttatttacgtatgttgagactataagttacatgattttcggcctaatctaatagttttgttcaaccatttaaacttaattgcgtacttacctatccttttaagcttatcagtgaagaatcaaactctctatactagcttttattttatcagataaatagctcagaagatcatggtaggcgtataaataattcatgtagagaattcactttttatgctatcctaaaactaataaaaagattatttggtcttactcactacttattttactttagttggaggaaaacaaatgaagtatgaagaattaaaacaaatctttcttcaagaaaatgaaattgaaaaaattcaacgcataaaaggctacaatgtaaatgatcaaaatttaccatttggagaaattgatgtgcctaaaatgcctggctataatttttttaaagaaggaaatatttatattagtaaacatcatcgctattcagcgatgcctaaccatacacatgagtttgttgaatttaactatatgctttctggtacctgtacacagtatgtcaatgaaacaaagatagaattgaaagaaggagaaatcatcttattggataaagacattgtccaacgtatcgatccattaactgaaaatgatttattgattaatatcttactgaaagatgagtcaattacgaccgatattattatcaatatggttaaatcgacaggattagtgaacgaatttttgatgaacgcatcaaataaatcagggaaacacgacgtatttcttcattttcattgcggaaaaaataaagaagttcaactaatcctccataaactagtttgggaatatgtttataaaaaacgctattatatgcgagaggcaaacttgttgttgtcagttttgcttattgaattaactcgagtgattgaagaagaaagcttggataactatcaagaaaaagatgaagagattatccaaatcatcaggtatattgaaaccaactttaggcatcttagcttaaaagcattggctaaagaatttgggtataatgcaaattatatgggaaataaattgaagaaagagacgggacgaacatttcaagagttgatcaatattgcgaaatatcatacagtactagaattgatgaaagaaacggataaaagcatagaagaaattgcctatgatattggctttcactcgctaccttccctctataaattatttgccaggtttacagatagaacaccaaaacaaatgagagatcatctaatgcatcattgactccaaaaagattttcctgaaaaaggaaagtctttttctgtagtttggataaaaaaagctgtatttagaccatggctgaaatgttgtagtgcgcttacaattgccttgtaagctgatcagctgataaaacagaaatggagtgtttgagtttgaataaaaaaaacaattcagtcgtcaaaaagtattctcctttagcaaccgctgcaggaatcggatcaatgctaggatcaggttgtatcgttggattgtcagcaacgattccagtttggcaaaaggggttagagttaacaacggggcaagtagggattctttcaggaagtttaacttttgcgatagcttttggttccatgtttgccggaaatattactagaggtttcggtctgattcgatcatttaattggcttaaccttttttatggtattggtgcagcaatttgtattttttcaacgagttttttgatgttactcgcaggattaatcatcatgggtatttcttctggtgctgatttgcccattagtttaacggtagtttctcatgatgtcccagatgaaacaacgtctgcgcaattagtttcttcgacacagattttttggcagattggtgtttttatttcgtacatttgttctttcctactttcaggtgttcaaggtgtattaggtgcacggctcgtgtttgctattttgtttggatttgccgttatcacatggctatggcgcacattttctactaagttcaaaactttccatgaagaagggtatatccgccaagctgccaataaggtaatgacagaacatgaccatgaagtctcattcaaaacggttctttttggagaaaataagcgaaaatatttaggattctttttagctatcattactttttatgtatgttggaatctattagcaaatacgtgggggcagttccaaacgtatgctttaacgaatgctggagctagtcaaacacaagcaactggattaggaatcattttgaatgttgatgctttaggtacaacgattgtttttacttctatttctggtgggaaatatcgaaataaagctttttttgtaggtgctttcgttcaatttgcagctatgctcggaatggttttaatcggtgggggcgcaggttttattgctttggcaacgacgattgctttttataattttggtaatcctttagctggggaagccatttataaagtatggacacaagaatcatttcccgcagaaacaagagcatcattgcaaggatttatcaatggtttttcacgattatgttgtggacttttcgcatttgttacgccttacttagtaatgccagatcatattcaatcttcgatgattggctttgctgggatcgttttagtagcaacaattgctggtattgtcatgatgcggttacaaaagaaatatggaacatctgagacacgagggacagaagatcttcaagacactaatgtcactgcttgaaaaattgaccaagtgaggagaataaatatggcatttacttttcaaataaataacgatgtagtttgggattatgatcagaaattattgaaaaaagcagaagaaaatattccaaaactaattgaaacagaaattcaaccaattcgaattgttgaaaaaattcctgcacaacaacgtaccaatgagtttaaacttcaagatagtcaaaaggacatctgcacattagctcagtattcactgggaagaggtgagtccatcatcttggatttagaggatcattatgtcggtcaatttagtattgatatcgattctgttggttcaccgatggatgcacctttgtatttacgcttgaaatttgcagaagtaccttctgaattatatgcccgttcagaggactacgaaggctggttgtcacgttcctggattcaagaagaatatcttcatcttgatacgttacctactacactgcaattacctaggcgctacagctgtcgttatgtagaactaacagttatcgatacctctcctaaatggcaagcaagttttagtagtccaaaatttatagcaaaaagttctgtttcaatggcacaagtacctacgatgacgatcgaagacaatactttaaaggcaatctacgatgtttctgtaaaaacacttttagattgcatgcagaccgtctttgaagatggtcctaaacgagatcgaagattatggttaggcgatctacgtcttcaagcactagctaattactatacttttaatgatttgtctttagtcaaacgatgcttgtatctttttggcggaatgcggacaaatgaagggaaaatacctgctaatgtttttacagaacctaagttaacaccagatgatacgtttttgtttgattatagcctcttttttgttacttccttatatgattatgttgcgcataccaaagataagaatgtcttagcagatctttatcttgttgctaaaaaggcaattgatttagcactaaaacaagttgatattgaggggcgtttggtactgactgaagattttcctgtctttgtcgattggtcgaatgattttgataaagcaactgctggacaagcaatcatgatctatacattgaaacgatttttaaaactcgcgaaactatcgaatgaagcgaatgaaatgtactatcaagaaatactagaaaaaatgataaacttttcaaaccaaactctatttaatcatgagaaaaaacagtttgtcattgaaaaaaacaatgaaataaatgttgccagtcaagtttggatggtgttagccgaagtatttgacaagcaaacaaataaggaaatcatgctagaaacgattaaatatcattttccaattcaaggaattgcgacaccttatatgtatcatcatgtggtggaagctttatttatagccgattgtcaagaagaggctataaaattgatgaaagaatattggggaaagatgattgaattaggtgcagatacattttgggaagcttttaaaccagaagatttaaccttttctccatatggtagcccaattttaaatagttattgtcatgcatggagttgtacaccagcctatttaatagggaaatatctgataggtaaatagttagttaattaggaaaaatacatggatcagttcttacttgttaatgaattgatccgtgatttaagaaaaaatgaaagcggttatctctgttggcagatatagtaaaggaggtttattatggaaacaacacaaatgaatctattaaaaagaaagtggttgacaaaatggcgacaacggattggttatggggtatctgacttcgcatgtaatcttatctggcaagtaatttcgctctatctcttatatttttatacggatatcatgaatttgaacgctgcagcaatcagcctgatgtttgtagtgacgcgttttgtagatggtgtgacagatttattggttggctacttgatcgatcacacgaatacacgctggggaaaatcacgaccgtattttctttttggagcagttccttttgcactttttgcttttttgtgtttcaatgtgcctgatttttctaattcaggaaaattagtgtatgcatatgtcacatatctcggtttgtcttttgcatatacattagtaaatgtaccaatggcatcgattttgccaagtttgacaaatgatacagaagaaagaacggcactatcaacttctcgaaaattttttgctttcctaggtgcaacgattgttagttcatctgttttgacacttgttgctgtttttggtaagggaaatgaacaattaggcttcaagattgtcatgggaatgtttggcgtaatcagctgtctactattcttttttacattctccgctgttcgagaattgcctgtccatggaacaaaaaatccttcattcaaaagggtctttacgtctttgaagcaaaataaaccttggatgatctttgcagtcaatatcctgtttatgtggaccagtttttttattcaatcaagtgcactagtttattatttttctgtagtgattggaagcaagacactttctattaccgtagcgacgattatgtcaattgttcctatgtttgcaaacttttttgttcctatacttgctaaactattaggcaaaagaaatttatatcttttatccgcaagtatccagatattaggattgatagttatcatgtttgctgctaagaatataacactgatacttgttggtacctttatttcagccattggttacggagtaaaagaaagtatttatttttcgatgcaagcagatccagttgattttggtgtttggaagacaggtgtgaatgtttctggttcgctttctgcaattaatggctttttagggaaagttgcacaggcaatttctggtggtgtagcgggtgccttacttgcttggggaatgtatcaacctggagaaatcagacaatccggaaaggcaatttttgccattcaagcgatgtatctttatgtaccaatgctcttgattatctgttcgatagtaacaatgatgttttatcatctagataatatttatccccaaataaaggccgatttggaaatgaagaaatctttggatgtcaaatgataagaaaagtaacttagatgagaatactaagtaacaagaggttgtgacttgtttttagtcacgacctctttttttatttattccatataaatacacattatttattccgaaaagtgaaagcgtaaataacaaaaacaaccaacttatttattattaaagaaaagcgtatttaagtaggacgattctgttgagagctttcgtagattttcccattttcctatggtaaactgacaaagttgagaatgttagaacagatcgtttaggaggaaacagatgtttacgaatgaaataaaaatcatgctttatgtggacgatgtagaaaaaaatgcaacgttttggagagcagttggctttgcagaaaaagatcgtcaagaaatggatgggacgcttataattgaagtaggagttgaagatagtcaaacctcatttctgttatatgatcgagcatttgttgagtcccattcacctggcacagctaatagtgccccatctttgatgttttacagtaaagatatctttggactatataaaaaaatgcagacgcaatcagtcacattaggtgatatggtacagcttggagaagaatatgtctttaactttgctgatcccgatggcaactactttgcggttacaggtaaataatagaaataaagactttgtttttctgtgtgaaacaggaaagcaaagtcttcttagttccaataatagcattatgtaaacaaaaaaactttccatgcgtaattatacacaagcaaataaatcgtcaaatgcgaacgccttctttatactgtttaggaacgaaaagaaggaaggaagaaatacatggattatcaagtactgctttattacaattatacaaaaatagaagaaccagaggaatttgccaaaaatcatttagccttttgcaaatctttggatcttaaaggtcgtattctagtagctgaagaaggaataaatggtactgtgtctggaaccgttgaaaacacgactgcctatatggaagcaatgaaagctgatcctcgatttgctgatacgatgttcaagatcgatccaagcgaaggacatgcctttaagaagatgtttgtaagataccgtccagagcttgtaagtttaaagctagaagaggacattgatccaaaccaagtgacaggtgcctatctttcaccgcaagaatttaaagaagctattttagatgaacagacagtggtgattgatgcacggaatgattatgaatatgacttgggacattttcgaggggctgtacgcccagatatacgcagttttcgagagcttccagactggatccgcgagcacaaagaagaatttatggaaaaacgggtagtgacctactgtactggtggcattcgttgcgagaagttttctggttggcttgtccgtgaaggattcaaagatgtcggacagcttcatggcggtattgctacttatggtaaggatcctgaagtccaaggagaattatgggatggcaagatgtatgtgtttgatgaacggatcgctgtcgatatcaaccaagtagataaacaaatcgtcggtcgcgactggtttgacggaacaccatgtgaacgatatatcaattgtagcaatcctgagtgcaatcgtcagattcttgcttccattgaaaatgaagaaaaacatttaggagcatgtagcatagagtgtgcgaaacatccgcgcaatcgctatgttcaagaccatggaatctctccagaagaagcagaactgcggtttacagctttaagtaaatagaaaacaatagttttgattgtcgaccatttccaatatgcgctatactagcgttgaggatggtgatctatatgaaatcattactttatgctattggggatgtccatggcaaatatgagctttttgaaaaacttattcactattatgatccaaagatccatcagcttgttttattaggggatctcaatgatcgaggtcctcgtacaaaagaatgttttttattaggaaagcaattagtcgaagaaacaggagccatttacctccggggaaaccatgaagaatattttttgcaatttctgcaatcaccggaggactggtatgcgccttatatgagaaatggtggaaaagaaacgtttgaaagcctgcttcacccaggggcatcggaggaatactccccaactgaaatctcgatgatgatccaatcgagatattcagaactgattaaatttttagtccagcgccccttgtattatgaatgggaaaattatctttttgtccatgccggtgtggatttgacaaagaaagactggcgtaagacaagtccaagagactttatttggataagggaaccatttcatgaagggaaaaacaatacaggtaagacaatcgtatttggacatacgattacaccaatgctccatggagatatgcagacaacagacctctggattcaggatcataaaatcggcatggacggtggagctgtatttggagggtcattgcatggggttgtttttgacaaggaaggtattcttcaagacattgaatatcagaacaacgaaggaccatggcatggaatctgactaatggaaagaatgaaggagctgtgactttgttgcggctctttttatttgtatagagaatattgtttctttcagtagtttaacccaggataaaaagtatgatagaataaagaagcaatttttagcagaaaagaggcattttaatgacggaaaatttgaaccagacgatcattcagcttgtacaaaaagagctttcagactatcgtcctaagcagttgactactgtacttaatttgttaaatgaaggaaacactgttccttttatcgcgcgttaccgaaaagaaatgactggaagtcttgatgaagtccagattcgtgaaatcgaagagcggtatgcctatcttgaaaacttagaaaaacgtaaaactgaagtgattcggctaatcgatgaacaagggaaactgacccccgagttagaagcagaaatcacccaagccgtgaaaatgcaacaagtggaagatttgtatcgtccatacaaacaaaaacgacggacaaaagcaacgattgctaaagaaaaaggacttgaaccactcgcgaagtggctgatgcagcttacagatggagaggtgcaatctgaagcagaaaaatatattgacaaagaaaaagaagtctcttctgccgaagaagcgttgcacggtgctcatgagattattgctgaacaagtcagcgataatgcaaaatttcggacttggattcggtcttatacgtataacaaaggtatgtatgtcagcaatgtcaaggatgagcaagcagatgaaaaaggcgtatatgaaatgtattatgactttgcagaacccgtccataaaatggtttctcatcgaatattagctactaatcgtggagaaaaagaagatattctgaaagtattctttcaagtagatgaagcagcaattttagcttacttggatcgccaaatagtcaaaaatcctgcctctccttcttcttcattcgtcagagaagcctatcaggatagttataaacgctttattcagccagcaatcgagcgagaactgcgcaatgaattgactgaaaaggcagatgagcaagcaatcgctattttcggcgaaaacctccgtaatcttttgttgcaaccgccactaaaaggtaaagttgttctgggatttgatccggcttatcgtactggatgtaaactagcagtcgtagatgcgacagggaaagttttagcaatcgaagttatttatcctcataaacctgcagcgcaagcaaaaagagaagctgctggaccagcttttatccaattaattaataaatatcaagtagatatggtagctatcggaaatggtacagccagtcgggaatctgaactttttgtggctgagcagttgaaatccgccgaccataaaacctattacgccatcgtcaacgaagcaggcgcttctgtttactccgctagcgaaattgcacgaaaagaattcccacatctacaagttgaagaaagaagtgctgtttctattgcccgtcgcctgcaagatcctttagctgaattagtcaaaatcgatcctaaagctgtcggagtaggccagtaccaacatgacgtttctcaaaaacgtttggctgaacaattggattttgttgtggaaacagcggttaaccaagtaggcgtggatgtgaatacagcaagcccgcagctcttgcagcatatatcaggattgaataaaacaactgcccaaaacattgtcatttatcgtgaagaaaacggagaattcaccgcacgaactcaattgaaaaaagtgccacgcttaggaccaaaagcatatgaacaagcaatcggattcttgcgagtccctggtgggaaaaacattttggacaacacaggtatccatcccgaaagctattctattgcaaaagaaatattaacttcagtccaactttcagaaaaagagcttggtacagaagaagcagtagaaaaattgacacgactatccgtagagaaactggctgaaagcctatcagtcggagaagaaacgttaaccgatattttagctgggctgacacaacctggacgagacatgcgtgatgagatgccagcgcccttattacgtacagatgtattgagtatggaagacttgaaaccagggatggaattgactggaacggtccgtaatgtcattgacttcggcgcatttgttgatatcggtgtgaagcaagacggacttgtccatatctcgaaactcagcaaaaaattcgtcaagcatcctacagatgtcgtgtcagtaggagatatcgtaacagtttggatagaacaagtcgatacgaaaaaaggcagaatcagtttgacgatgctttccccttatgaagagtaacaatgaggagtaacaaaaattgacacaagaagaactgcagcagttagtagaagagatatcattaaaaagcttccagcttcctttcaagcaccaagcaatgttcaatccacgcttacgtacagctggcgggcgctatcatttaaacgatcatcatttagattttaatgcgaagctatttgaagagtcagacgaagagacgattgcaggaatcatcaaacatgaactttgccattatcatcttcatctagctggaagagggtatcagcataaagatatggatttcaagtatcttttgaaaaaaacaggagggttgcgctatgcaccagccttgacgaagaaacagataaagatggagtattatcgatgccaagattgttctgccacgatctgccgcaagagaagaatcgatgtacgcaaatatcgttgtggaagatgtcatggagaaatcaaatggattgagacaaaaagagaagactttaatgaagcacaaaaaatcagatgaaaggatggaaggcctttggaaaaaagtgagcagaggaatctaaaagactggaatcagctattaaattttttagccgcacctgaagagggaaattttgaggaactgacggcacctacacttattttagctggaaactgtcttcctatcttagctgataaagcagcacaaatgtatttaaatggccaagtagatcaattgtttttggtcggaggggtggggcatgcgactagaatcctttatgagaattttgaaaagcaaggatttcattttgaagatggcatgagtgaaagtgaaatctgtcgtcagtatctaaaagaagtctatgatttgcccgataaggcttttctgatagaatcgaagtctacaaattctggagagaacgccactttttcactggagattcttcattccttaggagctgtaccagaaaaattcttattgatgaatgatccgacactgcaacgcaggactcgagcaacttttgagaaagtatggcaaaatgaacaaaatattttcgcaaatgctgtgccatttgtgccggaaatccttcacttttctgaggagatcatctttacagcaaaagaactgaaccatcaatggcctaaggaatatttccatgcgctagtattaggagaaatggaacgactccatgacgatgagaacggctatggtccgaaaggaaaagattttattcctcacattgatatatcagaggaagtttggtcttcttacaccagaatcaaagagtcaataaaaacggatttttcccgtacgtgaccaatttagtaagcgaatcctcctttccaaataaatttggttgaaattttcaatcgtttataagataatgaggagcgtgttgaatgtaatagctaaaagaatggacgctagataagagaagaggattcaaatggaaaatcaaaataaattgtatcattttgttggtatcaaaggttcaggaatgagctccttggctcttgttttacatgaacaaggtctaaatgtccaaggatcagacattgaaaaatatttctttacacaaagagatttagaaaaagcaaatatcacgattctgccatttaacgcagataatgtaaaaccagggatgacgatcattgcaggaaatgcatttcctgattcacatgaagaaattcagcgagcaaaagaattaggtttggaagtgattcgctatcatgactttattggtcattttatccaaaactatacgagtatcgctgtaacaggctctcacggaaaaacaagtacgactggactgctctctcatgtattgagtggtgtccgtccaacaagttatctaattggagatggaacaggacatggtgatccgcaagcggaattcttttcatttgaggcctgtgaatatcgccgtcatttccttgcctattcaccagactatgcaatcatgaccaatatcgattttgatcatccggattattatacaagtatcgacgatgtatttacagctttccaaacaatggctggacaagtgaaaaaagctatttttgcgtatggtgacgatgcttatttacgcaaattaaaagcagatgtgccgatttattattatggtgtcacagaaaacgatgatatccaagcacgaaacatcgaacgcacaacttctggttctgcttttgatgtctatcatggggatgaatttgttgggcacttcactgtaccagcattcggtaaacacaatatcttaaatgctttaggtgttattgcagtagcttatttcgaacatttggatctgaaagaagttgcagaagaaatgctgactttcccaggagtaaaacggcgattcagtgaaaagatcgtagcagacatgaccgtagtcgatgattatgcgcatcaccctgcagagatcaaagcaacgattgatggcgcacgccaaaaatatccagataaagaaataattgcagttttccaaccccatacgtttacgcgtacgattgcattgatggatgaatttgcagaagcacttgatttagctgataaagtttacttatgcgatatttttggttcggctcgggaagaacaaggaaacgttaagatcgaagaccttggagcgaaaatcaaaaaaggtggagaagtcatcaaagaaaataatgtatctccattgttagattatcatgatgcagtagtaatcttcatgggtgctggagatgttcaaaaatttgaacaagcgtatgaaaaacttttaagcagcacgacgaaaaatgtactgtaatacaattactgcagtgtccttataaaaatagaaagagggagagtggcaaaaatcttgccatgctcccttttttgcaacttatgataaacggtgttcaaaagcttacatctgcggtaataagcccaaccaaatcaaaaacatgagaagctgtttttcttggctgttcttattacttgatgcagggcagctttttcacgacctcagataaacggtgttcaaaagcttgcatctgcggtaataagtccagccaaatcaaaaacatgagaagctgttttttcttggctgttcttattacttgatgcaggacagctttttcacgacctctgtaaactataggaatctgttaaatcaagggagcagaacttgccttttacgctacttttggtacaataatgtatgattaaaaataaactggagggtttctatcttgaacataggtaagccgagaaaactaggaaaaacaataaatgaaatcgaggaaggcgactcgttatccttaacagaatctattgaagataaccagcttttgctgtatttgggattgacgaatgatgcaaatcctttgtatatccaacatgactttgcacaaaaaacagaatatcaacagccaatcgttccatcagtgatgctgatggggatcatcacaagtgcaatttcaaagcatcttcctggaccaggatcacatgttgtcaatttttctgtcaattttattgaaccggttttccattatgaaacactgacttttcagtttgaggtcataaaagtagataagatgaaggatgtggtgacgatttctgtagaagcggagaatacgaacgaagatcgtgtgttggatgctgtcgttatggtccaaccgccacaagttcctgaattggaaatagcaatcgaaagtgaaggtgaattgaatgaataatccaagtacatcaatgtcaggtatcaatcgtttttatgcaaaagtttatggatttttaggtatgggacttgcccttagtgcagccacttcttacttggctctttgggtattccctttgcaattagcaacttttatcaataattttccattaggctttgtgggtctgtggatcgttgaactgattttagtaatggttctaggcgtaaaagcacaaaataatccgagcttagcaatcggtggatttattgcctactctcttttgaatggcataacattagcagttactcttgcatactacgatattggaacagtaacgcaagctttcttgacagctaccttgatgttcatggggatgtctgttgtcggagcaacaacaaaaagagatcttagcggggttggaagagcaggacaagcagctttaatcggagtaatcattgcactagtcttgaacatcttcattttgagaagtagcgcagttgagctgttcatctccctactgttagtcgtcatctttgcagggatcacagcttatgataaccaaagcatccgtaatatctatgtccagacaaacggaacagcacatagtggaattgctgtattcatggcattgaagctgtatttggactttatcaacttgttcttggcgtttctgagaatctttggacggaacaactaaaaaagaaaaaaattcatcagttggggctataccgaattatttggtatggtcccgctttttcttttcgcattccgcaggattctttgttagaatgaataagaactttacagtaaggagttaagaagatgacaaaaaataaattattactcgttgatgggaacagtgtggcttttcgcgcattctttgcgcttcacaattctcttgaacgtttcaaaaatagaaacggtcttcatacaaatgcaatctatgcattcaatacgatgtttgaaaatgttatgcaaaaagagcaaccgactcatgttctggttgcgttcgatgcaggaaaaacgacttttcggacagaaatgtatgcggagtacaaaggtggaagatccaaaacacctggcgaattcaaagaacaaatgccatatatacgtgatttgttgacaggactaggggtacagtattacgaattgcccaattatgaagcagatgatattatcggtactttggcagaaaaagtagacaaagatcaatttgatgtcgtcgtgctttcaggtgatcgggatttgactcagttagctagtaaagaagtaaaagtggatatcactgtaaaaggtgtcagcgatatcgaaagctatacaccagaacatgtagcggaaaaatatgatgggttgacgccaaaacagattattgacatgaagggactagccggagatgcctctgacaatatccccggtgtgactaaaatcggtgaaaaaacagctatcaagctattgaaacaatatggctcagtcgaaggaatttatgaacatatcgatgaaatgaagcaaagcaaaatgaaagaaaatctgataaatgacaaagagcaggctttcttatcgaaaaaattggcgaccatcaatacttcagcgcctgtggatgtctctatcgactcattgaagtatgaagggaaaaatctcgataaactcgttccgttttataaagaaatggatttcaatcagttcctttctaaattgaatatcgtagaagaagaagtaaaaatggatgatattttgtttgaagtcgttcatgaattcaaagaggaaatgtttactacggatatggcgttgtacgtggaaatgatgggcgacaattatcatacagaggaaatcgtcggagtagcgtgggggacagaaaagaaaatttatgtcacgaacgatctatctgtattcgaaaaccgagcgttccattcttggatcactgatccgactcggctgaaaaaagtatatgatgcgaaacgaacttatgttgctttaaaccgctatactggaaaaacgaaaggaatcgattttgatgtcttgctaggtgcataccttctcgatacgaatgaaaaaagcacagatatcgaaggaatagctgctcattacggatacaacgatatccaatcagatgaagctgtatacggcaaaggggcgaaaaaaggtttaccagaagaagaggaactcttttttgctcatttagcgcgaaaagtagctgcaatcaatgcgttgacaccaaaattgagccaagaactggcagataaaaaccaagaagatcttttccggaaaatggaactgccattgtctatcattttggcagagatggaaataagcgggatcaaagtagatgcgactcgcttacaagaaatgaagggcgagttctctgctcgcttaagagagatcgaacaaaaaatctacgaagaagccggcgaagaattcaatttgaattcaccaaagcaattaggagtgatcttatttgaaaaaatgggattacccgttatcaaaaaaacaaaaactggatattccacagctgtagatgtactggaacagcttcgtgaacaagcaccaatcgtagaggatatcctcacctatcgtcaaattgcaaaaattcaatctacctatgtcgagggactgctgaaagtgatccaatcagatgggaaagtgcatacccgttatgtccagacattgacccaaacaggacgattaagctctgttgatcctaatttgcagaacatcccgattcgattagatgaagggagaaagatacgtcaggcatttgttcctagagaaaaagactggctgatttattcttctgactattcacaaatcgagttacgcgtacttgcgcatatctcaaatgatgaacatttgaaagctgccttcctagaaggtcaagatatccatgccagcacagcgatgcgtgtatttggaatcgaaaaggcagaggatgtcacaccaaatatgcgtaggcaggcaaaagcagtgaattttggtatcgtgtatggcatctctgattacggactttcacaaaatctaggaatcagccgaaaagcagcgcagcaatacatcgatacgtactttgaaaaatacccaggtgtcaaagaatatatggaaagaatcgtacgcgaagcaaaagaccaaggctacgtcgaaacgctgtatcaccgccgtcgatatctgccagacatcaattcaagaaattacaatatccgttcttttgcggaacgaacagctatcaatacaccaatccaaggaagtgctgctgatattttgaaaatcgcgatgatcgaattggataaacgattaaaagaaacaggtcttcaagctacgatgctgttacaagttcatgatgaacttgtcttcgaggtaccggaaaaagaacttgaatcattagataaattggtgaaggaagttatggaacaagctgtttctcttcatgtaccactgatcactgacagcagttggggaaaaacgtggtacgaagcaaaataaacattgtttaagacagagcaatataatgaaggtgaaaagaaaaaaatgccagaattaccagaagtagaaaccgttcgtaaaggattggaacggttagtagtaggaaaaacgattcaaaaagttcaagtcttgtggcccaagatcatcgagcaaccagagacacccatctttgaggcttctcttgttggcgaaaccgtccaatccattggacgtagagggaagtttttaatttttcatcttgatcattatgaactgatctcacacttgcgaatggaaggaaaatatcaatttacgaaagaaaatacaccaatcgataaacatacgcatgtacttttcttttttgaggatggaagccaacttcgctacaacgatgttcgaaaatttggtcgtatgacaatcgtcgaaaaaggagcaagtgcaacttaccgaggaatcatgaaattgggacctgagcctttgccagatagcttcttattagcagattttgcaaatggactgaaaaagtcccacaaagcaatcaagccattgctgctagaccaacgtctagtgactggtctaggtaatatttatgtagatgaagcattatgggaagcgaagatccatccagaacaaccggcgaacacactgcgccccaaagaggtagaacaattacgtctatcgatcattgatgttttggatcgtgcaatagaagccggaggtaccacgattcgcagttatttgaatgcattaggagaatcaggtggatttcaagtagcactgcatgtctatcagcaaactggcaaaccatgtatacgttgtgggacgccgatcgtgaaaacaaaagtggcacaaagggggacgcactattgtccgaattgtcaaaggctaaaaatcgcaaagtaggatttgttttaggtttgacgggtggaatagctaccggtaaaagtacggcagccaaagtctttcagtctcatggatttcctttgatcgatggcgatgtgattgccagagaaactgttgagcctggaacgcttgctctgaggaaaattgtatcagtgtttggccaagaggtattgcagtctgatgggcagctagatcgagggaaacttgggatgattgtttttccatcaaaggaaaaacggcaaaaacttgatcagctattagatccgtttatccgaaaagcgataaaagatcaaatcgcctctctaagttccaatcatcctttagtaattgtagatatcccattgctctacgaaggtcattatgaccactatatggatgcagtagctgtcgtttatactacgccagaaactcagcttcagcgtttgatgaaacgtaatcaactgacgctaaaacaagcgcagcagagaattagtagtcagcttccaatcgaagaaaaaaagcagcgtgcggatattttgttcgacaataatggaacaaaagaaaaacttgtgggacaaatcgaaaattggctttttgctaatcgctttctttgagtatctgtgtcaattttgctatcctgagtatagaaagtgagggatagcgatgggatcattaaaaaatcaaaaggataaagtcgtaggtaacgcaaaagaaaaaatcggcgagatactcaataaagaaaatctaatcgatgaaggtcgtacgcaatcagaaacagcagaagaaaaagaaaagcagtaccaagcaagaatcgatgaaatagaagaccagcaggcagaagaagaagcgaagcggcaagatttgactcaagaacgaaaaaatccgacacctgatcgtagtaaaacaccgctcccagaaagtgaccacattcccgatgagcaaaaaatcgaggaacagcgaatgaaacactatacaggaatcgaagagaagttataaaatagtaaaaaatcgagatgtgacttgaagcagatgagaaggtgttcatctgcttcaagttttttgtgctagatgactaaatcagcttttgtgtaagttatttctcagtaatcaaggtgatcagtattggaaaattgaaatttggtaaggacaggggacacaaatacgcatgaaagtagaaaaaattgttcttatatccggtttttttgggtaggacagtcgcgtttgtgatttgtttcgtgttataatacaactagttgtaaagaaagacacaccctttatataaaaatgcgatgcaagaggtgagacaaaatgagatgtcccagatgtcaacataataattcacgagtaatcgacagccgtcaagcagatgatggacgtgcgatccgtcgccgtcgcgaatgtgagaattgttcgttccgattcactacatttgaacgaattgaagctgctccgttattagtaatcaagaaaaacggggaacgcgaagaattcaatcgcgataaaattttaagaggactcatccgttcagcagaaaaaagacctgtagctatggaacaaatggaacaaatcgtcaaccatgtcgaaaaccgcgtacgcagtctcggagaaaacgaagtatcgacgaatctaattggtgaatatgtgatggaagatttagttgatttagacgaaatcgcttatattcgttttgcaagtgtttatcgccagttcaaagatatgtctgttttcttaaaagaattgcaagatatcgtggataaagcaaaagaaaataataaagagaacaataaagaaaacaataaagaaaacaataaagaaaacaattaagaaacaaaaaggaggcatttccttggaaaatgcttggaaagagcttcaaccaaaaaatatttaccaaggaagaaaagcggctccgctgagagaagacagcaagaacgccttgctgtatctttatcagccactaatcggcggagaagccttgagtatctatttcaccctgttatcagaaatctctcaagaatctggcaaaggtcctgaagggatgcatgcagatctgcttagtagtctaggctacggtatcccgcaattttatgatgcaagaaaaaagctagaaggaatcggcttactggatgtttattttaaagaagatagtgatctgggacctcgttttatttatgagctgttagaaccactcattcctaaagcatttttcaaagactctgttctggcttttcttcttctggaaaaagttggtgaacgacgattccagaagcttacccaattgtttgaacctaaaaggcatacagcagagggatatcaaaaaatcacaaaaaaatttttagatgtttatcgcttcaatgaagcagtgtacgctgctaatcaagaaaatatcgaatcgctgaataaatcttttgaagaatctgaatcagtagcattacttgaagcagattcgacattcgattggcagtttttgaatgattggctggcaaaaaaacatattgcaagtcttgatgatccaatcatcaaacaagtcgacatgtatcatcagctttacggtttcgatgaattgacacttggcgaactgatcagtcaatcttatgactttagtgaacaaaaagtatctgaaaaagaactgcaaaaagccattttggcaatgcagagacgtccggtgaagcaaacaaaagaaacagttgcggtttctgaaaacagtaatgaaccctcgtcaaacgaacatttgacaaacgcagcgcttcagctgataaaagaagcacagagcattccaccgatgaaatatctggaagcaatcaagtcagaaaaaggcggatatgtttctaaacaagaaaactggttactgcaagatcttgtttctcaatcaggtctttccagtagcgtgatcaatgttttgctgaattatgtactagtgatcaagaataatgctagcttaaatgccagttatgtaaatacagtggcaaatgaatgggcacaaaagaaaatcgccacagcagaagaagcaattcagcatattcggcaaataagcaatcaagcaaaacaatcaaaacaaaagaaccaaacaaattatccaaacggcaagcgaaatgttcggcgggaaaagcttcctgattgggtcaatcagccaaaagatgaaaaacagatcagcagcgagaaaaaagcagagattgaccgccgttttaaagaatacctggcaaaaaaggagggtgacatctagtggaagacgtaggaaaagaattgaagaggatcatcagcaaacgcaattatcaagaaaagtatgctgaaatgatcgctgaagtcttaaatgatgcggatgttcaagcttttctaagcgcacaccaagaagaattgacacaagcggatattgaaaaaagttacgccaaattgtatgaattcgtgcaagaaaagcgtaaatatcaaaaaaacgatccaacgatgatcgctcccggctatgagccgaagctgacattgaattttcattatgtggatgtcacttatgtaccaacggaagcattgttagcacggcaaagacaagaagaaatcagaagccgagtaaaagcaatggatatgccaaaagatattcaatctgcttcttttgaaaactttgaacgtacagatggacgaggatatgcgagcttagaagccctagattttgtagagaaatatactgctgatccaaaagggtatcataaaggactgtatctagtaggaagttttggtattggaaaaacatatttattaggagcaacagcgagagaattagcgattgctggattcaccacgacgctagtccattttccgacatttgccgttgagatgaaacaggcaatcggaaaagatcaagtggaagaaaagttagatgcagtgaaacgttcacctattttgatgatcgatgatattggtgcagatgcgatgagtagttggatacgagacgaagtattcggtgttatccttcaatatcggatgcaggaacagttaccaaccttcttctcatcgaattttacaatggatgaattggaacagcatttgtccgtcactcaacgtggagatgaagagccgctaaaagcgaaacggataatggaacgcatacgttatttgacaaaagaaatcgaaatgactggtcgcaaccgacgcaatggttgaacagttgacaagtccaactgacatttgacctagtagtaaaagcaggtcagcgaatcattatatggacagaaatgaccggagacaatcaccgcaacaagtaatgcagaaacttaaacggaggattttttatgagggctattttttctagtatatctgtagttggtctattttttcttttagcaggctgcggtagcgcagatagcaacacaggttctgttgattcgattgatgcgggtcaaacagtaaaaacaagcagtacgaaaacggagggacaaagcatatttgtcggaacgattgaaagtatcactcaagtagaagcagaagaagaaacgcttcagttgaaactcgtcgatgtcatggccaaagaagatccagcgaatatgggaacgtcattcagcaatgacggagtgatcttaaatgctactgctgaaaaaataagcgtggacataaatgaattgaaaatcggtgacaaagtccaatttacattagttgagatgccgatcatgacgatgtctatcccaccgcaagttcctggagattcgattattgatgtttcattgaacaaataaccaacaacattttttcaaaaataagaaaatgttgttttatagaacgaaaaggtatattttttaaggagatatgggaatttttttattcctagtctccttattttatttggaaaatgctataattatctagaaggagtgaagctatgaaccatttagatttatctcagcgcttagccgcagtgggtgactttgtccctgaatccgctcgtttagcagacattggatcagatcacgcttacttacccgttgcattgatattaagaggaaaaatcgaatatgcagttgctggcgaagtcgttcaaggtccttatgaatcagcacgtaagcaagtcaaaaaagatggattagaagaccgtatcaccgtacgccttgcaaatggtctagatgctatccagccacaagatggtattacagctgtcacgattgcgggtatgggaggttcactcatccgagatatcctagaagctggcaagttgaatcaacgcttaagcggacaagaacgtttgatccttcagccaaacatcggagagcgtacattacgatcttggctgcaagaaaatcagtataaaatccaatcagaaaaaatacttgaagaaaataaaaaaatatatgaaatcattgtagccgaaaaagaacaaaaaccagttacttacaatgaaatggagctgatgttcgggccatttctgcttgaagagaaaagtgagatcttcaaatcaaaatggacaagagagcttcaacaaagaaaagctatccgtgaacagctcaaacaagcagctaatcaagaggcacgtcaaaaacaaatcgagcaggaaatccaaatgattgaggaggttttaaagacatgacaatcaacggacgcaccttcatccaaaagtttgaaagctattgtcctcagtggctagctgaagaaggagacccagtcggactgcatattggaacattggataagccaatccaacgagtaatgatgacattagacgttcgtccagaagtggtcgaagaagcaatcaagaaaaaaatcgatttgctgattgctaaacatcctccaatctttcgtcctgtaaaacggctggttactgatcagccacaagaaaaaatgtatgcagatttgttgaaacatgatatttccgtctatgcagcacacacgaacatggatattatttgggatggactgaatgactggttttgtgaacttctcggtattgaagtggagagttatttagtaaagactcatgagattcattataaaaaactggccgtttatgtacctgtggatgatgcacagaaaatgcgtgaagcattagctgcagctggtgctggtacacaaggtgattataccggtacaagttttacctcgattggacacggtcgatttactccggaagctggtgcacaaccagcgattgggaaagtaggaaagtcaaaacaagttcaagaggcaaaagttgaggttattttgccggaaactatcgaaaaacaagtgattcaagccatgcggtcagctcatccttatgaggaacctgcttatgatcttttcgctatagatgaaccagtcgaaatgttcgggttaggacgagtaggtgaattgccgcaagaaatttctatagagacatttgtagaacaagtaaaagaagcgttccaactagatggacttagaatagtccagccaaaaaatgcaaaatcctctgtgaagcgcattgcgatttgcggtggaagcggtgaaaaattttatccgcaagcaatcgcccaaagagcagatgtctatatcacgggagatatctattatcatacggctcatgatatgcaaagcgctgggttgatcgcaattgatcccggtcattatattgaatcgttatgcaagcaacgatttatcgagaaatttgaatcttggaaacaagaagaaaattgggatattaactttttcgtttctgaaacaaatacaaacccatttcaatttaattaaaaggagagaatactatgtacgaaaatcttttgccacgttttttacgatatgtcaaaacagaaacacgctccgatgcaacaagcaaaacgactccatcgactcagacacaagttgcttttgcgcaagaattgaaaaaagaattagaagagttaggcttagctgatgttttctataatgaagataacggattcgttatgggaacattaccaagcaatgttgatcatgaagtgcgttccattggatttatttcccacatggatacagcagattttaatgcagtaggagtcaatccacaaatcattgaaaactatgatggcgagtctacgatcgtactagatgcggaagaacgctatacattgaatacaaaagattttccaaatttgaaaaattatgaaggccacacattgatcacaacagatggcagtacattactgggagcagatgacaaatcagggattgcggaaatcatgactgcaatggagatcttgatcaataatccttctatccctcacggtaccatcaaagtggcttttggtcctgatgaagaaatcggtgtcggagcggataaattcgatgttgagcaattcgatgtagattttgcttatacagtcgatggtggtcctttaggtgagttgcagtatgaaacgtttagtgctgctcaagcaaatattacgatccaagggaaaaatgtacatccagggacggcaaaagatacaatgatcaatgctctacagttagcaatcgattttcataatcagcttccagccgatgaagttccagaaaaaacggaaggatacgaaggtttcttccatttgatggcattggatgggaatcctgaagaagcttctatgagttatatcattcgcgatcatgatcgtgaaaaattcgaagcacgcaaagcacaaatcacacatatccaagaagagttgaatcagcgatttgatcaagaacgaatcaaagtagatatgtatgatcaatattacaacatgaaagaaatcattgaaaaagatatgagcatcgtggaattagcgaaacaagcaatgatcgagcttggtatctctccagtgatcgaaccagttcgtggaggaacagatggttcaaaaatctcttacatgggtattccgacgccaaatctatttgccggaggagaaaatatgcacggacgattcgaatttgtttctttacaagtaatggaaaaagcaacagacgtgattgtaaaaattgcagaattgaacacaaagagttaaaatcgaaaaagaacagcttatgacaaggcgttcgtcccaatgatggaatgtcatctgtctaaggctaaagggcaggacaatggaattggttgtcccgccctcttttttgaagagtaaataggagataaagaatggaaaagctgctagttttttataacaaaagttcagggaaagatgagggtgagaaattagcacgctggtttcaagattatgtaaaagaaaagcagccagaattatatgtagaactagctgaaactggcccatcgattgatgatgcggaattagtcaagaaagcagaagccatagaagctgatactttagtaattataggtggagacggcacgattcatcatatcgtccaagcgttccaaaaaacattatctcaatactatgtcggattacttccaggtggaactgtcaacaaccttgcacgtgttcttgagattcccctcaaaaaagaagaagctgctgacgtgatcctggaaggcaatgtacggaaaatagactacggtcaagccaatgatgaagtcattatctctacactgacaatcggaatcttagcagatacagcagtttggatcagtcaaaaagaaaaacagcgttacggctcgtggatctttatcaagaagttttttaagttattgctgaagaagaaaaaatatcatttggatttagaaacagacgaggagcattggaaaggaaaatcccaactgttgacagtcacgatgtctaactccgtgggcggttttacaaattttgacgactcagcgaccccagatgatggaaaattccatgtaacgatcgtaccttccttagatattttccgatttattttttatttgcctagaatcatgagaggcaaattctatacgatccccggcattacttatttcacagccaaacgcatgaaaatccaagcgcaggaaaaatctgtgggcactcgaacggatggagacacgacagatgatcttccagttgaattatctgttgtatcaaaaggattaacagtttattcaccaaagaaagaagaaaaagcttagaaatagtagttaacagaaagttggaagaagagtaatggatgtattgttacacaatcctttgtggttttaccttttcattgtgaatttttacttattttgtctgatggggtatgataaacatcaggctagaactagcggctggcgtgttcctgagaataatttgatatttgtcagcctgttaggcggtggtttgggaggattgatctctcgaaaagttttccatcataaaacgcggaaaaagaagtttactataggattcgctgcaggtgtacttgttgatttgattctcatttattttttccattaaggagcaggagatgtcgtctaaaggaacgaaaactaaaatcattctgaatctgcttttgctgattgtgatttttgccattatttattatttaatcaatcaatcatttgcagatatctttgccgaattgctgtctaccagtgttgttgttttggcagcggctgttatattagggacagtttaccaaatcgctgaagggcgctcaatcaaagaaattgctgaacctttcgcgccgaattttacaacgaaagatgggttcttgacctctagctatattgcgttttaccgaatcgtttcgtttggtacaggaacgctgatctcggagatttatttttataacaaaaaaggaatgaagctatcccagggagcaggggtgacagcactccatatgattatgtacaaactggcagtgatcacttatgcattagctggcttggtcatccaattctctcttttttattctaatggtccgtcaatgatctggtttatcatcgctggtatccttttgacgatcgtgattgttgcctttttattggcgatgtccgtcagcttgaatgtccaaatattttttgtcagcttatcgaataagttatttaagagtgagcgtttgcgaaaatgggtggatacatgcaatcagcagatctactctttaagggaaacggtccaaaccattatccaagacaggactgcgctattgcggatttatctatggaatatgttaaaacttgtattttggtatgtacttccctatttgattctgattgaaaaccatcctaaaatagattttctactgaccatttcgtttatcagctttgcagtagtgctttcaggggttattcctacgcctgctggtattggttcctttgaatttgtctatttgttattattcagaccagttgttggaacagttgacgcagtttcttcgcttttactgtatcgtttcagttcctttatcttgccatttctctatggatttgtgtatgtgattgctgaacggcgaagagtgatcaaagaagaaataatagaagtaaaaaaagagaataaagaaaatcaaaggtaggtcttttataagatctaccctttttatcaaatcaaagaaaaacgttatggataagataattttacgtttgtttggctctttttttatatacatacaatcaattttgtttttttaagatttatataagtcgagaaaaaaagtcaaaaaactatgtgtatattttgaccaaaattgaccaaagcgatataatagtttttgtaaagatcaaagaaataagtgatcttacctttaattaggagggtatacctgtatgaatattgagaaaatgactacgacgcttcaagaagcgattgctgaagctcaacagattgcggtcactcgaaaacaccaagatatcgacattgcccatgtatggaaaatctttttacaacctaatcattttggtcgaaatttctatacggatgccggattggatgtcgaatcttttgaacatgaaattgatcgtctactggatgagtatccagttgtttctggtggaaacgtccaatatggacaaaacctcagccagaatttctttcgattattgaatgaagcagaccaaatacgtgaaagcttcggcgacgagtttctttcaacggaagtcgttattttagcgttgatgaaattaaaaaattatccgttaactgtttatttgaataaaaacggattatctgaaaaagaattgcgtaaaaacatcgaagagatgagaggaggagaaagagtgacctcaccaaaccaagaagaacaatacaaagcattagaaaaatacggcgttgatttagtacagcaagtcaaaagcggaaaaatggatccaatcatcggtcgtgatgaagaaatccgtgatgtcatccgtattctttcacgaaaaacaaaaaataatcctgttctgataggagaacccggtgtagggaaaacggcaatcgttgaagggcttgctcaacgtatcgtacgcaaagatgtgcctgaaaatttaaaagataaaacgattttttcattagatatgggtgcattgatcgctggagcaaaattccgtggtgaatttgaagaaagactaaaagcagtcttgaaagaagtcaaaaaaagtgatggacgtatcctcttgttcatcgatgaaatccacaatatcgtaggggcaggaaaaacagaaggaagtatggatgccggaaatctgttgaaaccaatgcttgctcgcggtgaattacatttgatcggtgccacaactttagatgagtaccgtcaatatatggaaaaagacaaagcgttggaacgtcgctttcaaaaggtattagtcaaagaaccaacagtggaagatacgatcagtattctgcgtggattaaaagaacgttttgagatccaccatggtgttaacatccatgacaacgcattagtagcagcagctactttatctgaccgttatattactgatcggttcttaccggataaagcaatcgatttgatcgatgaagccagtgcaacgattcgggtagaaatgaactctatgccaacggaattagatcaagttactagacgtttgatgcagttggaaatcgaagaagctgcactgaaaaaagaatcagatgatgcaagtaaaaaacgcttgaaaaatttgcaagaagaattagctgaacttcgtgaagaagcaaatgcgatgaagatgcagtgggaaacagaaaaagaagaagtcaattctgtttcagcaaaacgtgctgaaatcgataaagcaaaacacgaattagaagatgcagaaaataactatgatttagaacgcgctgctgtattgcgtcatggtacgatacctcaattagaaaaagaattgaaggaattagaagctaaagcaaaagacagcgagattaagatggttcaagagtccgttaccgaaaatgagattgctcaagtcgttggcagattaacgggtatccccgtaacgaaacttgtagaaggtgaacgagaaaaactaattaaattgaatgaaacacttcataaacgagtgattggtcaagatgaagcagttgatgcggtcagtgacgcggtaattcgttcacgggctggattgcaagacccaaatcgtcctctaggttctttccttttcctaggaccaactggtgtcggaaaaaccgaattagcgaaagcgttagctgagaacttgtttgactcagaagatcatatggtacggatcgatatgagtgaatatatggaaaaacatgctgtgtctcgtctagtcggagctcctccaggctatgtaggttacgaagaaggtggtcaattaacggaagctgtcagacgaaatccttatacaatcgtcttgttggatgaaatcgaaaaagcgcatcccgatgtcttcaatatcttgttacaagtcctagatgacggacgcttgactgattcaaaagggcgagtagtagatttcaaaaatacggttctgatcatgaccagcaatatcggttcacagttactgctggaaggcgtgactgctgatggaacgattccagaagcagtggctgaacaagtcaacacgctattacgtggaaacttcaaaccagaattcttgaaccgaatcgacgacacgattttatttacaccattgagcctagacaacgtgaaaggaatcgttgacaaaatggtggcgcaattggcacaacgtctggaacatcaagaaatcctgctgacaatcagtgatgaagccaaaacgtggattgctgaaaatgcttatgaaccagcatatggtgcaagaccattgaaacgatttatcactaaggaagtagaaacaccactagctaaagaaatcgttgcaggacatgttatgcctaaatcaaaagtaacgattactttacttgatggacaacttcatttcaaaacagaagagctagaagaaatcgtctaatcttccattgagactataaaagaaaaaaggggtctgacacaactagtgtcagacctccttttttcaaataaacagtgttccagaagtagtttcttcgaaaaataagccgaaatttcttgaagctgcccgcttctgtcacaacctcttttattaggtatttttcactttttctaatttataactttcaaagtaacgctcatcttttttactttgagaccatgcaaacaatcccattaaggcagcacctatcgtatttgtcagcaagtcgcccatcgtatccatcaatgctgctcgtccgacaaacagtgtgccatcagaagcagcaaaacgttgaagattcatgcctaagaactggtcgcataagaattcccagaactcccaaaacacgccgcaaagtccagcaaacgcaaagccgaataagaggaacaaccaaggactagtttttgatatctcagcatctttcatcaagtaaccaatcaatccatagccaagagctgtcaggaccattggactcaccgcatgtaagattttgtcccaaaaagagatgatactgatcaaatgcatccctgtgcctaaaaagacagagatgaacaagaaaaaccagtaaaacaaaacgattgctgctggtattttaagtttgaaaactttcaaaatgacttgtggcatgaaaatcaatgcaatccctaataaagattccacgataaatgtgattccttgagaagtcgaatatttttgtgtgataaattcataaaaattatagcagacaacgaatacaccaaaagcaagtaaagctatttgcacctttttgatttctttaatcactgaaagtccctccatctaaaaatctttttacttctgaaagcaactcaatttctgaagaaaccacttttccgttcaatttgatcaaacctattgtatataagttcaggtagtgaaattgattttcagctgtttcttgtagtgcagcgatttttttcgggtgggttccgccttgctgtcgagtatcagtatataagccgatcactgggatgcctttcgcataagccacaccgatttccgatgctacccccgcatcgatcgtcagcccatctagtaaagcaatcattaaatcactagccaacactttttctgtgtcagcaagagcaatcattcgactgtctgcataagcagttttgtcattgattgcttcattttcttgaggaagatagatcgaaagctcagaagagagctctctgatttctttaactaactgttggttatataacaaatcacttttagcaaacattggtgcggcaaaataaattttcatctaaacatcatcctttttatcaaaaataatcgctaaagtaagcttccatgtttggaatgatacgctctagtgacttcagtgtttcttcatctgtttctaaccgttcgattcttgccaaataagaagcacggcgataattcatcatcaagcaagtcaatgtttggatatccagtcgaacggattttcctataggttcatttaagacacggacttgtccctgttcatcccatgttaaagcgaagacaccattattccaaggagcgacaggatcttcaatgatgaaatgaaaagcatcagctgttccaacaaacggaaaccgttgaaggaattcttttacatcaacgatccgagccataaaatatggttcgatctgctctttgatctgactatcttcaatcaaaaatgctaaaggctcatttttataaatatctccatgtacccagtagatcatggaaaaatgtgcggaaataaagttccataagccatttcgagcttcttgatcaagatagaacatttcttttacgtgaaatatttcttcagctacccagtagaacagaacacctcttggttcatggttgctatcgtagtagacagcggctgtgcgctcatcttcattttcgaaacgccaatactcttcccaatgaaaatcactgcggaataaagcaccatggttttgttgggcaaatttgtcataaacggaaaatacgtctggatgatcaactggtaatcgctcaaccataccacttactgggatttgtttaggtagctgtgtatctctgattttaaaggaaagtttatcagacatgatttcccatcctttacgccgatagtaggggatactgtaaggatacaaataagagatccattgcttattcttgcgcatattatccaatgcaacgataattagatcttgcatcaatccatggttaacatattctggataagttccaactccagtcacaccacccattttataacgtgcaccgtgaatattgacttcacaaggatagatagcgatttgagagatcagtttattttcgtggaaccatccgaacactttcgatacttccaaaatcggttttttggaacggataaaagctcgtttattctcaaacccgctttcctcgatgtctgcttcagtcacttggaacacataggaaagcaattcattgaattgatcgatatgttcttgagtgaccggttttaattcaagattttctctaaaatctttttgatccattttttcatctccatttattagcttgataacagtatagcaaaattctacaaaaaaaacttctatagctgactaattaaaaactctttaaattactgcttttcgttggtataatggaaagtgctgattatatgaaaagaggagacgctatggatataaagaaaatgaaagaacgccaagagcagattcgtaatttttcgatcatcgctcatatcgaccatgggaaatctacattggccgatcgtattttagaaatgacgcacactgtgacgtctcgcgaaatgcaagatcagctgttagactcgatggatttggaacgtgaacgtggaatcacgattaaattaaatgctgtagaactcaattacacagcgaaaaatggagaaacatatatctttcacttgattgacaccccagggcacgtcgacttcacctatgaagtctctcgaagccttgctgcctgtgagggtgccgttttagtggtcgatgcagcacaaggaatcgaagcacaaacattggccaatgtttatttagcgttagacaatgatttggagatcctgccagtcatcaataaaatcgacctacccgcagcagatcccgaacgtgtccgtcaagaaatcgaagacgtaatcggaatcgatgctagtgaagctgtattagccagtgccaaatcagggattgggattgaagatattctcgagcagatcgtggaatatgttcctgcaccaagtggagacttagatgcaccgctaaaagctttgatctttgactctatttatgatagttaccgcggtgttgttctaaatgtccggatcacggacggtatggtcaaacccggagacaaaatcaaactgatgagtaatggcaaaacatttgatgttacagaggtcggggtcttctcgccaaaagcagttgctagagactttttgatggtcggtgatgtcggttatatcacagcaagtatcaaaactgtccaagatacacgagtaggggatacagtaacgttagcagacaatcctgccgctgaagctttaccaggttaccgaaaaatgaatccgatggtttattgtggtctttatccaattgatacttctcgttacaacgatttgcgggaagctttagaaaaactgcaattgaatgatgctgctttacaattcgaaccagaaacctctcaagcattaggttttgggttccgctgtggattcctcggacttcttcatatggatgtcgtccaagaacgcttggaacgggaattcaatctagaattgatcacgactgcaccatccgttatttaccatgttaataaaacggatggtacgactgctacagtagataacccggcagattttcctgaacctgtaacgatccaggatgtagaagaaccattcgtcaaagcacagatcatggtcccaaatgattttgtcggtgcagtaatggaactttctcaacgaaaacggggagaattcattacgatggattatttagatgattaccgagtaaatgtcgtctataatattccgctttctgaaattgtctttgactttttcgacaaattgaaatcaagcacgaaaggctatgcctcattggattatgaaatgtctggttatcaaaaaagcaagttagtgaagatggacatcttgctgaatggagaaaaagtcgatgcattaagctttatcgttcaccgagactttgcctatgaacgtggaaaagcaatcgttgaaaaactgaaaaaactaatcccacgccaacaatttgaggtgccaatccaagcagctattggacaaaaaatcgttgcccgttcagacatcaaagccttgcgtaaaaacgtcttggctaaatgttatggtggagatgtttctcgtaaacgtaaactcttagagaaacaaaaagaagggaagaagcggatgaaacaaatcggctccgtcgaagttccgcaagaagccttcatggccgttctgaaaatggatgaagaagaaagtaagaagtagcaaggtttgtttgaaaacagtgtaaaaaataaaccatgtttacatggatttgccaccggtttgccaccggtggtttttttcggtggcaaaaatcaagaattctttctaagattttccatgatatcgaccgtttcatttctcatcttatctgttacatgcgagtaagtatccatcgtaattgaaattctgctgtggcccaatcgttcagagatttctttcatttttgcgccattttcgagaagaagtgtagcatgagtatgtctgagagaatggaagttaaaagagagggagagtgcattcgatatcctcctagtattccatttcactacacttggcgtaactagctcaccgtcttccttcgtacatactgcatttgaatcaatgtagagctttccatacttcattcgattttctaattgttgtttcttatgttttttcagaattgctagcaaggtttgtccaataaaaatcgttcgattggaactgcttgtctttggtgtaccatatacccatgcgccaccattctttaccatttgtttctctacagtaattgttccatttgaaaaatcgacattatcccacgtcagaccacaaacttcgccaacgcgcattcccgtataaaatccaatattcaaaggaatatagaaaggatggccttcaggagtgatttctagcatatgatcaaagtcctcaagagaaatgatttttagatcttttttagtcgttggtcgttcttcgtattttggtatctttacatacagcataggattttgcttgattaacctccaaggataaactgccatattcagcgcattcttaaggacagaatgagtaatagtcattgttttcttcgagtaaccctttttaaattcagcattgatgaaattttgtaaaagagcaggggagagatccgtaagttttttctttcctaaataaccgtttatatgatttttgatggtaaatcggtagttttcataggtattgtattttagatttagtttaacgtattcctccatccaaaaatcaaggtattgttttactcgagtatccgtacctaaaaagtattgtcctgtttcgtcaatatctgataaaacttttcgtaaagcagcttcggcctctggtcgggtgtctccgccaactttctccactttttttcttgagccatcatcattgatatcttcaaaataataataccaacgttttccacgttttctcacaccgccacgcataaaatcagtcctttcatattgctatgtcattagtacgatagttaaattcttttggtacatatagagagggaatagatgtaaaatctgtattttcaatagaagtatacgaacttatgttcttttgcgtttaaaaagaaaagcccgaaggctgatcttaaactattacaatgcaactaattagggacgagcgtattgattccctcgaggggcacgactatacccagcattatcagcatctatttgagtcatgtattgataattatttggatttgtaacacgagaatagtactttccactatctgaacgagcgaaaaccataccatttgcagcgatagaccactggccatcaacagtgtatgaattattttgttgttcagcttgatgttgagcttcagcagcttgctgttcttgagcctgacgctgagcttcagcagcttgttgcttttgtcgttctgcttcagctgcctcattagattttatagttgaatcaacattgactaagcgatttaataattcttggtttccaccaggtatagattgaatagctgataatgctgcattgtagttatctctagttggattagcttcagcttgttccagaatggttttagctgttgaagttttttgattaatttcttcttggcgttttttctcagcttctttagctttttgttcttcttggcgttttttctcagcttctttagctttttgttcttcttggcgttttttctcagcttctttagctttctgctcttcttggcgctttttctcagcctctttagctttttgttcttcggcctttttctttttagctaattctttagcctttttttcatctttttctcggctttcagaagagacagatacactagaagatgaagatttagcgtctttgtgtacatctgcttgtccagttgttggtggagcaagagcccctccgattaccataactataaaagctactagaattccaatactaatctttttctttgaacgtttcttcttggagaaaaaagaatatactaaaaaacatactccaaatagaaaaccaaagaacccaactaaaattaaaaacgtactcatttattcctccttgttgaatatatcactgggtaaatcaagtatttactcccacttgaaggcaggtagtgatagtcgcccttaataaagccttaacaaaaagaaagccggaaggccaaccttttttaattagtagggatagttttttcaaaacttccattatccataaaatctttcatgataataggagaacctggataaataatttctacaccaacaactgcatcaacagtagcatcaggcttaacatctgtatcgcccatctttacaagatctggtttgtagtcttgagggaacaagccatttgctccattcaatagttcttcggttttatctgtttcctgtataggtttgattgatgtagcgaatgccatccaaggactttgagctttgtcagatttattagtatattgaatttcaatagctaatatttttttatttggatcatattggctagataattcttcagtgttttttattacaatctttgatgaatcgtcttcaaaagttgtatcacttgtagatttttcttcagtacttgaatccatagagttgctgctctctaaagtaaccattgtagaagtattagtagtcgtttttttaggcacatcagagtttgaatcgttgttaccacaagcacctaatgtgatactagaaaacaagattaatcctaacccaactatttttttcatattttcctccaaaaaataaaataatttactcccacttaatggcaggtagtgatagtcgccaattttaaattaaaaatctgtacacgttttcaggtagcccatacaaatttgttaattcctcaacttttctagggtattgatcgttgtcttctttataaagagaaacaatgagattagcagcaaagcaattcgcttcgctttctgatttgcttctggatgttcgtgtagatacataatagctagataacccacgatgaaagatggcgtgaccaagctcatgagcacaaatgtaaaatctttcctcagaatcctttaattcgtcattcaaaagaatgacagcacggcctaaaatctcttggaattgacctttaggatcatcaataaaaggaacatattcaatttgaatgtccattttttcacaaatataaaatggattagcggattgatacttccgctttaggttttccactaaattgataacatccaattccatacccaatcacttctctttgtccttgtcttcttttttgaatttccaaaacatgcctgctaaaacatctctgactctttgaagctgttcgggtgttaacgtttcgcctccataagccatgttagcatttgattcaagtaatttatccagttcaatcaaatcgtcctcatttgcccattccggaatcgtatttacattaactggtgaattctcttcaaaatatgatattgaaacgccgagagcagtagataatttttttaaggtttcaagcgttggatctttccgttcgcctttttcaaatcttgatatttgagaagcactcactccagattttaaagccaactggttaacgcctaagcctctagaggttctcaatttttttagtttttctccaaactccatgataaaccccctttcttaatatatgatatagcccataggcaataaaatcaaaaaaaattgcattttggcaataaaaagtgttgccaaaagacaaatttagtattatagtattgtcataaggcaacggaggtgtattaaatgaaaactttgcttaagcaagaaaagctctactccttgatgcaatcaaaaggagatgatccatattcacttgctaaaagaatgaatgttgctccgtcaacagtttatagaattttaaacggagatcgcggaatcggtggtgaactaattccgaaattgcttaaagcttttgatttatctgaaaaagatttcgataagctttttatttttagtgaagtattgccaaaaaacaacagacaggagattgccaaatgacacgacaagaaaaaataaacattgtacttgatgctagaccacgattggttcacatcatcaaatgtgcaaatgatgatcaactcgatcgtctagttgaagaagtccaaaaagagcttgaacgtgaattagacgaagcagctttcgtttgattctttaaattaatagtataaaaaaattgctcgtattgatatacgggcgaataagaatatgaggtgtttaaactgttaaaaaaatcaagtgttattcgagaatcgttagtcgaagtaattaataagagtggtgagaccaaaaaggaaatagcaagacaaatcaacgtctctcaacagtcattaagcgattggacaacattgcttaatacgaagcccgtgacgttggaaaatgctcaggcgttaacggatcattttagagattcagatttcactcttcaagtgattcatgagtttttcggtctattcaaatcaattgatggtgatgtttatagaagagatccatcttcattagacaagttgcaaatgattgaatcagatgagcggaaacagaagaagcaagaagtagaaaaaattcttcttaaacaagtaaattacttaactgttgatgatcgtcaacaaatcattgcatatgcttatgaatttttagacgagatcatggttgaagtcacactaataagtgcattatgcgaaatacttggaatcgatattcgcaagcttagtgaggaacggctgtcgtactgggtagcacaaggatatatgaaaggatgatggaaatggaaacattggaaaatatttttccaaaaaaagttgtcttgaagcgcaacaataaaagaaacattgaaaaattaacatactcagttactgaagcggcattagctataacaacaaatcctcaaaatgttaaagatttgattgagatgggatacatcggttttttgaaactcggtgaaattagaattcctaaaactgaagtcgctcgatttttagagaatcatatgaatgaagatcttgctagcgaaattgctaaatatagagaggagagaaagaaatgaaaactgtatttaaaatgactgtcaagagcgctttgcttatgagtctagtagcaatcgtactggcaagtattaatccagcatatgcacttatttattggggaaccttagtagcggttactgctgtaagagaaagtttcaaaatgccaacacaaaaaagaccgaccagcgacggcaatcgctaatcggcaacataacaaaatatcttatctgtattttagcatgaaaggaaggctaaaacaatgaacgattttggacaagcattagatcagtatttaactactccagaatggggcacaccacacgaagaggaggaagacgatgagtaagtctattttagaaatgagccatcaagaatggcttgaggatcgtcaaaaaggtattggtggttctgatgttggaacgattttaggattgaacaaatggaaatcaccttatcaattatggcttgaaaaaacagggcaagttgtacttgaagaaacagcaagcgagccagcttattggggcaatatcttagaagaagttgttgctaaagagtttcaagaacgtacaggtaaaaaggttcgcagaagaaatcaagtctttgaacatccactgcatccgtttctaagagcgaatattgatcgggacgtagtgggagaaaatgccattctggaatgcaaaacagccaatcaatttctcggtaaagaatgggaaggcgaagaggtaccgcttagttatctctgccaagttcagcattacatgaacgttctaaacaaagactattgttacatcgctgtcttgatcggtggccaaaaattcatctggaagcggattgaacgagatcaagagctgatcgatacaatcactgaacaattagtagagttttgggaaacgaacgttcttggaggtatcgagcctgtaattgacggaagtgaagcgactgctgacttcttaaaagaaaaatatgcagatgtagaagaaaatcaaacagctctaccatcacgttttgatgaacttatcgagcaaaaaagagaactcaagcggacgaaaaaagaaattgagtcagctatccgtcaagtagataacgagattatcagcgagctaggaaaacgtaaggcaagtatcgggatcactcaaaaaaacatcatcagttggaaacttgttagtactaaacgcgtgaactcgaagaaactagcagagaaatatccagatatcgcaaatgatgaagagatttataacgttactgaatcaagaaggctaaccgaaaaggagatcaaataatatggcaacaaatgaatcgttaaaaaatcaattggcagcaaagccacagaaacaagttgcaccaggtcaattaggacttaaagctttgatgaatacaccaacaatgagaaagaagtttgaagaagtacttcatgacaatgctaatgcttttatgtcgaatgttatgactcttgtatctaatgacagttatcttgcagatagtgaaccgatgtctatcatgagtggtgcgttaactgctgcaacattaaatcttgggctagataagaatttaggttatgcatatttagttccattcaatagtaaaaacaagcaaacaggtaaatgggaaaagaaagctcaatttatgcttggctataaaggatatatccaattagcccaacgatcaggtaaatacaaagcattaaatgtgattgaagtttacgaaggagaactaaaaagctggaaccgactgacagaagagtttgagtttgatccaaatggtagaacatctgatgaagtcattggatatgttggctattttgaattactgaatggattcaagaaaactgtctattggaccaaacaagaaattgaagctcatcgaattgctaacaataaagatcgagataagacaaagttaagtggtgtgtgggcatctgattacaatgcaatggcacgaaaaactgttttgagaaatcttctttctaaatgggggatcttatccattgaaatgcaagaagctaccacatcggatgagagagtccaaagagttcaagaagatggcagcattattgctgaaacagaagttgaggaagatattcctgaaagaaaagaagcagaggttatttctgaagaaaacgaagatgtacaaactggattatttgatgcatctaatccgccgttaaacaaataatgagggagttttctccctcaaattactagaacgaaaggaggaacacaattggattacatcggacagcttaatgcttttgacaattggcttgaatataacgagcttggcgctggtccccaactgctttggtataagctaatggctatagcaaacaaaagtggatggcagagcgaattatcgattgccaatacaaggctacaagcaatgactaaaacgtctgaaaaaacattgattaacaatcgtaatcaattgatccaaaacggactccttcaatataaaaagagaggtcgtacaaaagctggagtttatattctttctgatctaactggaaattttacagtaaaaactacagtagataatacggtagaaaactccgctactggaaatattccagtagatagtaaagtaaatccgaaagtaaatagggaagtaaatccttcagtagatcctacagtaaatccttcagcttatataaacaatacaaaacaaaacaagacaaataaagaagatgatataggcgtgtatgagttcatccaaaaaaactgggggaaagcacctactggacttttgcaaggagcattaggaccgatgattaaaacttggggagcagatatgattctctttgcttttaaattagctttcgaaaacaacgttgagatgccaggattgaaaaaatatgttgaagcgatattaaattcatggagtaatcaaggaattaagacaatggaatcagcagaaaaagctcaagaagcttttaagaacaagaaaaaacaaaactatcttcctaaacgtcaaaacaatgtacggcgtgaaaagttacctgattgggtcaacaaacctcaagaagaaaagacgctagatcctgataaaaaagcagaattagaagcccgctttgctgcttatcaggctaagaaggaggcgcttcttgagaatgaataaatatcgtaatcgaaaaactatccatcgaggtatcaagttcgattctatcgcagaagcagagtactacgatctagccttatggcaagctgaagcgaacggctggaaagtaaaacttcaggaacgatttgagctgatgccgaaatttgaactagacggaaagaagtatcgcaagatcgagtatattcccgacttcacattttataaaaacggcaaacttgtcaaagtcgtagatgtcaaaggaatgcagacaaaagactttaagatcaaggcaaagttgttctgtcatcaatatcaagtgccgttgatattagctaaaaaatatcggaatacgttcaaggaagagcgtttttaacgaggtggtccatcatgacaacagaagaagtgattcaaatgcgaattcgaagcattcaacgtgaaattgacgatctggaacgaacaaaggcagtgatggtcaatgaaacggcgagaaaggcaatcgatttgcacatagtgaatttaagaagggaaattcgtggattggaggaatgagcgtggataagaaagcgacaattaaacgaattgctgaattaaccaagtcagaatcttggcaggaagacaaagaaatagttgcagaagtccaaaagctcggcaaatcaatgtggattgaaaagcctaaacggaaaacgccgagaaaaattgcaatctggcatggtgatcgaattctagtaacaggtactgctgaacagttatctgaaattactggattaagcaaaaacattatttgggatagagctaggagcttatggattgattcaaaaggacgacaatttaggtatgtggaggagaaataatgttagatatgaaaatcgaagattatcgaattaccagtgattctagaaatattgtcttatcgaaggtaagacgagatgaggaaggaaacatccgctacacagaaacaaaagaagaatcacgagcagatatcggatactttcaaactgtctcatcgtgtttaaaggcgatacaacgcgattacgtgttaagtgaagaaagaacgataaaaagtattatcgagtacaaaaaagcgttagaaaacatcactagacagtttgaacaggcatgtgagattgaggaggaagcggaatgaaagaatataaacgccagcacattatcaagcatgctctagaaatgtacatccagcgtgaaggtgcatcggaaaaagacattaaacaagaaaagtcggttcttaaagaagtggaacaagagatttctcgtatgaaagagaggtttcaaacggggtgtgaatgctaaatgttcaaaatagcattttatctgttcgattacaaagatggttcgtttaagaaagtttatttccatcactggaatgatagcaagccagtgtttacaaaaaacaagaggagagctcaggagtattttgatgaaagatcagcaaataaagatatagtgcagttaaaaaaagcagaatcaccatctgcgaaaacattatctataaaattggaggaaaaagaatgaaactaaaagacggattttacgctagtagccacggtatcggcggtttaatgctagatatgccgactaagaaccctaaaacacgtaagaaaccaaaattcaaagtcggcgacatggtccgatgtgaagcagaagagttcatctatccatttcgtggatatgtagaacacgtctataatcactcagcgatcattcgtattgaaaacacgatggaatgtgataaatggacagcgaaaagtaaagagaatttagcagtggtgagattggtggatattgaactaatcaatgacaagtaaaaaagccggatcgctccgactgatgtaataaatccgacaagtttattatatcacaggaggcagctatggagttaaaaggaattgagttaagtgacatcgaaaaaatgcaaggagatcattgtgcaatcatcatttcaaacgggcaaatgaaaagtgtaaagcttcctccgtttggaacaatagtcatagaatcccattgcaataaagtcaagcaagttaaagaagaagtgaaacaattattttaaatatcgtcctaccagaaaactggcggacacaagttgacaagaactttcttgttgatttgtgtccgcttttttgtttgcgaaattattgaggaggctatctatatgaatgatttaattcaggaatacaagaatgacttgaaaatgttgaaaaagcaacatcaaaaaatcttaaataaacgatatcgcacacctgtcaaagaacatgggagagtgatacataaattaattgatgatcgttctcctcaagatatagcagatcaaaaagtaatagcagaagctatctctactacagagtacgctttattctggttagaaacaggcagagagaagcctttcgatgatgagcaagccaagaagataccaaagcatagaagagccgttaaactggcagatatagacgttatgagctatcaagtttatttacaggaagtagaaaagccagcagaagagacgatttctccgaagaaaaaagagatgttgctccaagtgacggagatagaatctttgctttctaataaagaactgacattatttcatttaattaataaagatttatgtacttatggagaagcagcagaacaaatgaatctagctgtgggtactgttaaatctatgtcacagcgaattaaaaataagatcgacaattattttgaatatggtcatcaaatcaatctatttgaaatttgctaaaacttgtaaaccattcccacctataagtgaagacaattaatagattagacactcacaagtttattcattcttttattctgaataattgttcttcaaaaataaaatgtaagggaggaaatctccctcatcgttttaaattaagcttcgatagacagcagcggaaatattaagaataaggatgtgaattcaactccttctgaattctttgtatgctgctgtctattaaattatttaaggaggggattgtatgcatcattatattacgaagtatagaaacgagcataatgaacgaaaagcggttgcgtggattcagttaaatctttttggtaaagcatattgcttattcaaaagagaaatcgcaatttaaaaaaaaccggtgagcggtctctttacggttttaaccttttctaaaggttgtgtactcctcctaaattcttcatccgttgttgtctattaatttatgtattggagggtaagaatatgaaattatcgattgaaggtacttcaggagaaataaaagagttgctccaagctaatcaaggtagcgaggagcatggctttttgattattgattatcagaagattggttctcatttgaatgaagccattcatgatattcacgtaaataatgaagtgtgatttgcatactcattgttacggaatatgttgctaaatctttaatgggaatcgcgttactattttctgtaaaagactttgtaagactatttgctaaatcttcataataatttttgtcgaattgatttacaaattcatcgaatgatttttccatgaggaataccttcttataatttatttcagcggaccactcgctgataattaaaattatacgcttagtatttattttcacaatattaacttgtcactgtggcggaaagggtagacgctaagcatgtgtgctaggtcaatgcttcggcaaccatgcaatgttcgattcattgccagtgactttggcaaccgaggcatcggcggtttaaaaatataggggtgcgcaatttcgtacgcgttttgtgcatcgtgtaggttgctattacatattagatcactctttgagtggtctttttattttacttaaaaggagaataattatatgaaacaatataccgctaaagatttcgaggaaatgaagcgattaaagaaggactatgaagaagttgatatggagctaactgttggagtcattcaacgaagactgcgggtcggattagagacagcaaaggctatttacaatgatctaaacgctattgaagagaagaatggctaatgaggaactactggtatgtatcgctaactaatgaatatcctcgaaccattgatgattgttcagtgcgtgttgtgcgttctgtacaaatcaaagggaagtactctattgttgaaatggggagagaagcaacaccaaaagagattgataaatgcaaacttctttattgcggtcatggtttctattcagataaacacatacaggaaaatctttcaaagtatatttaagtacaatcaagaaactgagaggtggtgagaatggttgaactaaaaaataataaacaagaacaatttgcaaaagaatatctaattgatcttaatgcaacgcaagcggccattcgagccggatattccagcaaaactgcatattctcaaggacaacggttgttgaaaaatgttgaaattcaaactcgtatttctgaattaatgaatgaaagaagtcgtagaacagaaataactgctgatcgtgtgatccaagaaatagctaaaattgctttttcggacatcggagaatatatgacttgggatcaagatggaaatataaccatgctttcaagtgataatttagatacgagtgtaattcaagctataaaaagtaatcgaactttacgaccgattggcgatggagaagaagttatagattcatctttagaagtgaagtttcatcctaaacttaaagctcttgagttgctttataatcacgttaatggttcagacaaactatctaaggctcaggttagaaaggcaattgctgaagcaaaaataattgaaaataaagcagataagttaactgctggaggaaaagtcaataatctgcttcaagctctcttagatgttaaatctggaggtgatggaagtaatggaactgaagtttagcccgaaacagattagtaatattaatcaagtggttcaagggattacttttgaattgaatgaaggaacacctcgtagtgggaagacaacttccgatatttttaaaatggctgatttttatttgagatcccctgatcaaaaccatcttgtaactgcttataaccaggaacaagcttatagaatgtttatggatggagatggattaggcttggttcatatatttgatggttgttccgatatacgacacgatgaacatggtgatcatctgttgttatatgctccaaacggtgaaaagaaaatttattataaaggcggagggaagataaactctgttggggctatcacgggtatgtctttaggaacggtgacatttctcgaatttaatctattgcacaaagactttatcaatgaatgctttagacggacatttgccgctgaatggcgttaccacttaggagaacagaacccaccagcgccaaaccatcctaatattgaattgcttgaacgttttgagaagtcaggacgttttttatttcgtcattggacaccgaacgacaatccaattttaagtgaggagcgaaagaaagaacttttcgatgagctttctagtagtgaatatcttctagaacgtgactggtacggacatcgagtattaccgcaaggtgttatctatgctatgtttggcaagaacaacaaagctaccgagataaaggggaatataattgaaactttttttactgcagatggtgggcaagctgatgctacgacttgtgctttttgggtggttactcatcacgaaggaaagttttatttgtatcgtttagctaactactatcatagcggaactgagactggagaaaccaaggcgatgtctatatacgctaaagaaatcaaaaagtttgtcgagtggtgctatacaaaatggaaacatcttcctcgatggaactggttctttgtcgatccagcatgtaaaacactaagaacagaactggatttaattggtattgagactgataaagctgataataatagttctgacaaagtttcgagtaatggattgaaaatcgaagtcggcattgaacgtctccaaaatacgatgactagtggacaattcatcatcttggaaaacggcgaagaatatgatcactacaattttgaaaaagaaatatctatgtacgtaagaaatgacaatggattaccgattgataaatataatcacgctctcgatgaagcgagatatggaaacaattatttctacaaaacttacatcgcctagaaaagaggtggacaaatgttcgacaaattaaaagctttgtttaggattggaggtgcaaaaacaggaatggttgaaacgttgaatagtatcacagatcatccaaagattgctatgagtgatagcgaattaagtcgaataaggaacaataaagaaatttatagaaacgtttatggggacatagaatatatcaatagtgatggttataggcagacgcgtccttttcactcgttgaacgtatccaaagtagtgtccagaaagttatctaagctagtattcaacgatggatgcaacatcagtttggatgatgaaaaagctgatgaatttttgcagtcggtatttgctgacaataaattcaggaaaaacttcggagaagagctagaggctggttatgccattggcggtttagctttgaggccttacgtggataccaattcaggtaaaatcaaaatttcgttttgtcgagctgatacatttttctctctacaatccaataccaatgatatttcagaagcagccatcgctactgtaactcagcaagccgagggacaaaagacaatctattatactttgctagaatttcatgaatgggttgacggaaagtaccgcatcagaaacgaattgtatcgatctgaagaacaaaagcaagttggtgtgaggatccctctcaactctttagaaaagtacaaaaatctgcaggaggagacgatcttagatggttttagtcgtcctctttttgtgtatataaagctagcgggtaaaaataatattaatttagatagcccactaagtttgggtgtgatcgacaatgctaagcgacaattggcagatatcaatgaaaaatacgatgagtttatgtgggaaatagaagaagctagaagaaaaattttagcatctgatcactttttcagagttaaatatgacagcaatggaaaaccagtgaagcggtttgacagtaaaacatctgtttttcaacggcttaaatctgatgaaccttttattgatgaattcgctccatcgttgcgatcaactgaatttatagcaagtatcaatttcattttgcgaattattgagctccagacaggcttttctagtggaacatttagttttgatggccagtctgttaaaacagcgactgagataattagtgaaaactctgaaactttttctactcggtcagataatgttcttattgtagaagaagcgttgaaagaattgatcactacgatttttgaacttgctgaggcatacaagttatttaatcctgtcaaagaattaggaataaatatcgactttgatgatggtgttttccaatcgcaagatgccaaggctgattattactctaaactagtaacagctggcttaacatctaagttaactgctattcaaaaacttactggagttacagaaaaagaagcaaaaaggatagtatatgagattagggctgaaactcttgatatggattactcagagcatgagcaaaacataattgagggacaattaggaagtgaagaataatggtttctccacatcagttagacttatggtcttctaatatggctcatctatatcaatcgttagaaggcgaattaatacgtattatcatcaaacgattgaatagtgggcacgataatattttagattggcaaagagaaaaactgcaacagttgcatctatttaataaagaaactgcaaaagtgatttctcaaataacaggaattgctgaatctgaaattgaaagtatgtttgatagctcaggagaaaagataatcagagacttagacaaacaactaccttacgatcctaagcctttgccatcgaacctagacaatgtcatgaaagcttatcatgatcaagtatggtctgacataaacaattatgtgaatcaaacgttactatctaccaattttggttacggaacagctaccactcaaatgtacacagaaataattaacaaaacgactgctgcatttaacagcggtctttttacattcgatgaagcactagaaagaacgattcaaggaggggctcaaaaaggtattaagtctacttttattgataagggagggcatacatggagcttagagcggtatgttagagcagtcttaaagtctaccctgtcaaatacctatgacgcattaagaaaagaccgcatgagcgagtatagtgtccacacagtgctaatcacaagccatacgggagcaaggcaagcatgttcaaagattcaaggtcatgtggttgatttacggcccgtatctgaattgcctcttaattggaaatatagaagtatctacgacccgtattggcaagcagaatatggaactgcaggcggtcatcgaggtgtagaatgtcaacatctgcatatcccatttattcctggtgtcaatacaaataatcaacctaaattcaacgaaaaagaaaataaaaaggttgcagaattaactaagaagcaacgctacctagaacgtcaggttgtgaaatataaaaagaatagaatggtctcagaagctctcggacaagacgaaaacgcaaaagagtgggcgaagaaaattagagccgcacaaagtcgattgcgtactctagttgattctaatgagtatttgaatagaaattacgtaagagagaaggtatacacacctattaacaccttactgaaagattttcactatgatgatttctaagtctaatcaacgattaggcttttttattttgcctagacctgctcggaagtctctaaaagacggctcacagtgggagttgccactctaaaaacacttaggaggaaaagaaaatgaaaaaagaagatcttatcgctttaggaattgacgaagaaattgctaaatcagttatggctttacatgggaaaactgttacgcagttaaatgctcaagtagctactgcagaacaagaacgtgatcagttcaaagaacagcttaactctaaccaaacagaactagatgcacttaaagaagctgcaaaaggtaacgagggactgactcaacaacttgcagatttacaaagtaaatttgatgctgccaaatctgattctgaaacaaaacttgcagagcagcagaaagatttcgctatcaagttagctttaaaagaagcgaatgcgcttgatgaagaaattgtgcttggtcaactagataaagacactattaaagttgtcgacggtaaattacaaggttttgaagaacaattaaaaggacttcaagaaagtaaatcattcttatttcaagaagcaaaagaccctgaaccaactccgccgacaccaacgattgttacccctggaaatcctgctggttctacagtgggtggtaaaagtattgtacaaaaaattcaagaaagattaggtgaataaatatggctttagtattagactcaaaagatttagcaaccattgacaaagaatttagagctgattcccaagtgtgggatgtcttaacacaaggtgcaaaaagtatcactgcagctgactttgtcggagcaaacgaagtacgtatcaacaaaatgtcaggattcgtggatgcaacacaatacaaacgcaatggagaaaatgcacgcaatcaaattagtattgaaaaagagacaatcaagcttactcatgaagactggttcggttatgatgtagatcaattagatcagtccgaaagcgcagcgttgactattaataatattgtcacagaacataaacgactaattacagttcctcatcgtgataaagttgctgttcaagtaatgtatgacaatgcaggtaaaaaagtgaacgaaactttaacggaagacaatattctagctgcatatgatgccgctgaagaatatatgactgacaatgaagtacctggtggctacgtaatgtttgtatcagcagctacttatcgtttattaaaaaatgccaaaggtgttagcaaaacattcacgacaaaccaaatgtctattaatggaattgacagaacagtagctcagattgatggcggtgttcctattctaaaagtagcgaaagatcgtttttccggaataactattgaagatacacttaacttcattatcgttccgctaactgcagtggcacctattgttaagtttggtacagtcgacacagtgccggcatcacaagatcgaagcggctatcgagatacgattaaaggtttagattactatgatgctatcgtattcgataacgctaaaaaagccatctatgtttcttacgtcccaaaagcgtagccccttcaagtgttacgttgaacaaaacaacactaacgcttgaagtaggggcaattgaaacattaacggcaactgttttgcctgaaaatgcagctgataaatctgttcagttttcttctagcaatacagcaattgctactgtaactcctgtacaaggaaaagtcacaggtgttgccaaaggaacagctacaattactgcgacaacagtaaatggtaaaacagcgacatgcgaagttactgtaacagaagcaggaggaggggcatagttccctcttcttttaataaggagggatattatatgcattatattgaatttgaagaattcaaagatcttactgggaaaacagatgactttaaagctgctttcgaaaagcatttgtcaaaagcaactgctgttctagatagcatcactaactatttttatcaatttaataaaattgaggaagatccaattggttttcgtgtaaaacaatttaagctagctttatgttcacaaattatatatttcgatgaagttggagcagatacttatgaaagtatcaataatacaccacaaagcttttctgctggtagaacaagtatctcaaactctagtagatataatccttcaggaaaaaatgagagtaaatcacttgttgccgaggatatctatatttatttagaaggaacgggtttgttatatcgaggtgtactatcatggtaatgcctaaacctccagtacaatttctagtggattcttttatttatcgagaatatttaggagaaggagactataaccaacctatttatggagattatgtaactatcgaaaattgtcggattgaccgaggaagtcagtattctttttcaccaagtggcaagcagttgctctatagtgcagtaattttttgttataagactttaactacccctttaccgaattttaaagaacaatcattagttatttatgatggtaaagaacatgtcatcactaagatcgatacaattatagaagcgtattcagatgctatctattcatacgaattagaggtgatttgatgagtattaaagttaatcttgatggagttagagctaaagtcagcccacaggctatgaagcgaggaagatacgcattagccaaccaagcaatggctgacatgaactcatttgtacctaaaaagaataatatccttcgccaaagtgcgcatatcaaaagtgacggcagcgctattctgtatgaaacgaaatacgcaaggagacagttctatctaaatggaaaaaaatatactactccaggaacaggtccaagatgggatcttaaagcaaaatcactgtatatgccttcttggaaaaaagtgtatctgaaaggagctggtatccaataatggattttatcgatcggataaaagataagattaatagtattccagaactgccgttaaaaatgaaaaaaggctatctttctgcagacgaaagcttagtaatttacccattaccaggcgggcaaaatcttgtggaatactatgacggtattaaagatatacaactaaattttgaaattgcgatgaagtcaaaagatggtcatagaattgagcaaacgctttggcttatctctgattcgttagagcgtgtgtcagacgttgctagctctgatggatcttttgaatttaacaatttaactataacgagcaaacctttcatcaatgatgctgatgaacaaggttggttcgtttttttattagattttcaaacaaaattaaccacatttgagggggaaaataaatgagacgcaaaaatgccttacaaagctattttattcaattaattacaactactaatgctgatacaccaagcgaagacggttggttggagttagcaaagtggatttccaacgttgatgataattcgaacgaagaatctgaaactactggctactatgatgggaacggcgaaggggagacagacgttacttctcatcagttaggttattcatttacaggcttatacgatgaagatgatgctgcgatggcggctattgagggcatgattggaaaatcaggagatgctcggaaagtgtggttcaaagtagtgtctgcatctggtaaaaaacaacgtattggtaaagcaacagtaacagagccagttgctcaggtcggcgatgctactgcatacggtgatttctcatgcggtatcgcatttgatagcacaccagaagcagaagatgttcctgttacacactaatgcaccccagaacgtaactggggttttgaatgttgatgggtcagtttctctttcttgggatgcagtgcccaaagcaaaatcttatattccacactataccgatgcgaatcaaacagatccgcacgatgccaacaaaatgggatatacggaaacaaattcttggacgttaccagcagcagatatgccacatctagaagctggcgatgaaatccgtttctacatccaaacttacaacgaggttggccaaggggctaatgatatcgagaaagcacgctatctgcatgacggtgaattcttaggttctgcttggtccataccagtagtattaatcaaaaaataagtcgaactgtccgtctgggcagcttttttaggaggataacatgactaacaaattatcatttcaaatagagaaaaaaggttttcctatcaatattggagaagtagagttctttttcggtactactccagaagaattgacacgtttttttgatacccaagctgaatttgaggaacaggttaaggaactcaaacaacaacttaaacaaatcaagaatatcgaacaaccagaaaaggaagatgctattaagattattgatctaacaaaaagtttagctaaagcagaatatgattcgttgcttggtaaaggatcatttgaaaaaatttattctgtttatcgtgatgttgagcaattaatagacttgtttgatccgatttcttttgaagttgcggaagcaattgaaaaagaagctttgaaacgtaaagatactctttctaagaagaaagccgatttattgaaaaagaaagcattgaaaaataagaaaaagaagtaggtgattaaatgcggttaaatgacccgttagtcacttcgatagagtttgatggtacagaattacctatcgatttaacatttgataatgtactagatgtttttgatattttggaagatagtgatttgtttccagaagaaaaagtgaatatgtgtttagaactgttgatcagtgactttgaaaaattttttcaaggctcgtctgaacaacagtttttattatttaatcacattttagaaaattatatttctgtaggagatagtgatggtgttgaaactgatcgtttaggcaatcctatgcctaatgcagttaaagaaaaaaagaccatcagcctagttcatgatgctaaatacatctatgcatcgttcagacaaattggcatcaatctatttgaagagcaaggacggatgatgtgggaggaattccaagcgctgcttgagagtttgccagatgacaccattcttgctcgaatcatccagattaggacatgggaaccgagcaaaggagaatcaactaaagaaaaagaacgcatgagaaagctacaacaaaaatatgcattgcctgattcggaggtaggtgaagacgatggctgatggaagagtagagatagaagttgatgtggatggcaaaggcgttaccatacttaacaagggtcttgatcagttagaaggtaagagtaataaagcaggagcctcaattaaaaatttagttgtttccttaggcctcgttaaagttgcagcggctgcttttaatgttttaaagaattcgctagattccgcaattagccgtttcgatactatgcaaaaattccctaaagtaatgaaagctttaggttttagtgcagaggactctcagaaatccattaacaaattatccaatggaattgatggcttgccaacgaaattagatgatgttgtagcaagtacacagcaaatgacagcaatcactggagatttagatagatccacagacactgttttagcattaaacaatgcatttcttgcgtctggcgcttcaacagaagatgccagtcgaggtatgcaacagtataaccagatgctttcgactgggcaagtcgacttagagagctggaaaactttacaagaaaccatgccacttgctttgcaaaaaacagctgaagcaatgggatttgttgggaaatcagctcaaagagatctttataatgcgcttaaagaaggaacagtaacatttgatcaattccaagataaactgattgagctaggaactggaacaggaatgttggcaaccttggcaaaggagaattcgctagggatcgctacttcattcggaaatctaagtaatgctgtttctaaaggtgtagctaatcttattactaagtttgatgaactggtgcaaaaacttactggtaaaactattgctcaaaatattgatagtatgaaatctattattaataaatcatttgaagaaatgtcaaaaataatggacatattgatagataatactgatgatatgatttctgcttttaaaggcctattagacattgtggaattgttagctccagcttttattgcagccactggagcgtatgtaggcttcaaaacagcattagctctaggtacattaataagttttataggaaaaatctatggagtgataacggccctaggtagtatggtcagcatgtttggagtatctggaacagcttacgcattgttatctgctattattccagctggtctgacggtatttcaactactttcaggtgttataggagcagcagttgcagctttcatctatttttataaaacaagtgaaacgtttcgaaatggtataaataaaattattgaagttgtaaaatctggactgattaagtcatttgaatatctaaaagaagtctttatttctatattacctacacttcaaaaagtagctgatacagtaggaaactatcttgttaaaggatttcaaaaagttgtcgaagtcggatcagcaattgcttcagtagcggtaccagctttttttaattttgttgatgcagtaaaaagaattgtttcttctggcatagaaagatttggctctactctttcgcaaataggctctgtattgtcagggattttttcttctggtatagaattggcaggtaatctgctggaaaaatttggaggagtttttggtaaagtcggcggagcagtttctctagttatcggcattttgactaaagtagcaatagcagcactagggcttactggtccattcggattagcagtttctttaattatttcatttatatcagcgtgggctaaaactggcgattttagtgcagatggaatcacaaaagtgtttgatcaattaagtgaaacaattagtaatgtggcaggttctatctctcaatatctcccgcaaattatcgaaagtattacttctgtgattacaagtattgtcgacaaaatagttgaaatgttaccgcaactaacagagatagctatacagcttattcaaacattgacggatgcaattgttacttatttgcctaaattgattgaaatagccacgaaaataataactactattgtacaaggcatttcattagctcttcccgcactgctgttggctgcaacagagataattacaaaactcatttctgcttttgctgagcttctaccaaaaattattgaagttggcacaaatttgttaactatgcttattcaagggatcgtagcagcactacctacgataattgaagttgtcattcagattattaatacattgattgatgggttcttaacggtactacctatgctgttagaagttggattacaaatcattacttctctcgtgaatgcgataataactgcattgcctcaacttgttgaagcatctaccgttatcgttactactatgctaacaacaattattgaagctttaccgacattaatttctgcaggaatacaaatgttaatggcgcttatcggaggtataatttctattcttccgttgttaataaatgctgctatccaaatcacaatggctttgattagtgcattaatcagtgcacttccgcaaattattgctgctggcattcagctgttattagcattaatacaaggaataatctcgatattaccacagttggttgcagcggcaattcaaataactattgccctagttaatgcgttgattagtgctttgcctcaattgatatcagcgggtattaaattgattgttgcgttggtagatggagtgatctcagtacttcctcaattagtatcagctgctattcaattaatggctgctttgttcaaagctttagtaggtgctataccacaacttttatcagctggtgttcaattgatcaacgcacttattagaggaatcttgagcttattgggacaattattatcagctggagcgagattaattactggattattgagtaccatagctcagtttcttggacaaatggtgaatgctggagccaatttaattagaaacttagtttctgggattcttagtgtgacaggaacagtaaccagtgcagtatctaatataggaaactctataatagatactttgagtggaattgatttatttgaaattggttcaaacatcatacaaggattaattaacggtatcggttcaatggttggagcaattgcttctaaaatttctgaagtagcgggaaacattaaagacaaaataactggcgcgcttggaattcattccccatcacgttggatgagagattacgttggtaagttcattcctcaaggaatagctgtaggtatcgaagcagatgcgaaatctgcatattcagcaatgaataagctttctaatggtttgatgaattctatcacgccagaatcagctcttggcacttcaaggatggggatggcatctgctggatcacagatagttaataatacctacaacaatcagaagcaatttgacgttgaaaagcttgcacaagtaattgcaaaacaaccagtacgggtctcaagttatttagatggaactttagtaggggataatatggatcaacgttttggaaaagtattgaatcgtagatcgtacatgagaggaggatagtttaatgaatgagaaaactcgtgtatatcttgcattttctgatgaaattgtcgaattgacaaataattcttatctgaggttgattgacattaatataggtatgccagtggcaaaaaatgagtttgttgaattttctggcacgaatggaaagcgtctttcgaacagctcgtttgacgcttttcctattactctctcatttgatattcgaagtagagagcaatcgatgtttgacttagttttacaaaagacggaactccgcgaattgtttactagagaaccagaattttatctaatttacagcaaagagccaggtaaaaaatatcgagtagtttatgattctattgacgatgaaagaaaaggcgtaatttacacaagatatactgtaaatctggaagctatcaaaggatattctgaatccatcgcaaccactttaacggatttcaatctagaggaagaatggcaattctcgcaagggctagtggcggaagattacaagtacacgcatcagactagtcacttcattatttacaatgctggaagctttgaaattgatccacgtgaacattatctgcggatcgcattagaaggagaatcagaaggaaatgtgacgattttcaataaaacaactggcgatcgatttatttactatccatcactttctacgagtctcggacagacattagtcttggatggcgtgattccaaaattgaacggtgtaagttgtgggatcaatacgaatcatggcctaatcaatttggttgagggtgtcaatgaaatcgagatccaaaatattactcgcgtgaaatcttcatgggatttccgtttcttatataagtaggtgattgagtgactgatttaattattcgaaattatgaacaaaccaaagaagaaatccttgtcggttatgacaagggttctttttatgaaaactggcaacaaaatgaaacgtgggagattggctttaccgttaccagcgattcgttgaatcaagaagtatttgatttagtcgaatacgagtcttctgttttctacaacggacaggaatttgtgatcaaagaaatgactcgcaaagcacttggacaattgctgacgaaacaagtagttgcgacacatatctattacaccgttcaagatggttatcagtacgatacggtaactggcgcgagatctattagtcagttactcacgcatgtatttagtgcaggtagtcgcggctttacatgggaagtcattgatccaaacaagaaattccttacagtcgaacaagaaaactttggtaatgcgaattacttgaagctgatcaatgagattctgtctgactataatgcagtcgtgattccgaataataaacatctaactttttatcctgccagtgagtacggccagcggacggaagaacagattcgttataagtacaatacagatgaagtttcatttgatattgatacgtacagtctaaaaacacaaatcaagggttatggaaaattaaaagatggagcgaatactgaggatcctaaagatagtgactatagatttactcctatcacttacacaagtcctgaatcacagaagtggggaatcaggatacaagatcctgttaaagacgaacggtataccgtatcagagaacatgctcgagcggttaaagacagacttgcaagactatccaagtatttcgggatctgtaacgttgaaatggaaaatcagtcccaacaaaggcgatcacgtcccattcatttatgaacctttgaatatcaatacgtacattcaagtggtaggaatcaagacgtatccagcgataccaaataagccaccagaaatcacattgagcaacacaaagaaaacaatgacgtcgatactcgctgaaatggcgaagaaaggagtgatttgatggggttattaaaattaatcagtaaccgtatctctacggaatggaaagagaaatttaatgaaaatattgactacctcaatgatcttgaaaagaagctatctgatcaagacaaatcaacgaacagtcgtataaacagtttttttgactagggaaattcctaatttaaaagtaaataaaacagtaacaagattatgattaatcgttttcatttttatttcctcacttttcatgagcgttttgaaaattctagcaaagaataaaataacaaaaattattaaaatagaattaataacagctatttatatttataacaaaaaaacagagacacagcacgtttcgtgcatgctctctgtttttcaaacaaaagattattttgtgatgatttgatccaaacttgctaatgacaaagccatggcagctatttgactaagttgtgttagtcggttcttacgtactgctggttcttcagccatgaccatcgtttgatcaaaataattttcgatcagtggacgaagagcgacaagttggtcgtagttttcgtggatcgtttggtcagcaaaacttgctttcattgcttctactgctttgtgtaattctttctctgcgtcgttttcgaacagctcagggtctacttctgattgtttttcaagctgagcttttttcgctaaattcacgacacgtgtcaaagcttccattgacggtttgaagtcttcatctgcaagatgttgtttgaacaattgtgctgctgcaaatacttttgtcaaatctttttgttccgcattcaaaacagcatcgatgacatcatgacggatgttcttcgttgtcaataattggcgcagacgacctttgataaagtcaatcacttgttgttgcccttctgataaaccaatgccgaaacgatccgtatctttactgataacatcactaatcgtttcttgcagaacagacaaaggaaaggcccattttttcgattcgatgatccgaacgacaccgtatgcttggcgacgcaaggcataaggatcgtttgacccgcttggaatcatcccaactgcaaagaaagaaaagatgctatctaatttatctgcaatcgctaaaacagaacctactgtagactgaggtagctctccttcactggatataggcatgtaatgctcacgaatcgctgtcgctacagcaggtttctcgcctttcagcagagcatatttttcgcccatgatcccttgtagttcaggaaattcccctaccatgttggttactagatcaaatttatagatttcagcagctcgttgcaaatccatcaattcttcctcagatagtcctacttgttcgccaatgatacgggcaatgacttgtacccgttgcattttctcatagatactaccgattttttcatggaaagtaacagtttttagtttttcaacgtattggtcgattgaagctttcttgtcttcattataaaagaattccgcatcttctaaacgagccgtcaatactttttgattgcctcgaaccacattttccaattttacccgatcaccattacgagcagaaataaaatgaggaagcagcataccttgatcattccgtacctcgaaataacgttgatgttctttcatagaagtgactagtacttcttcaggaacagaaagatatttttcttcgaagtcgccagaaaagacagttggatattcgactaaattgttgacttcttctagtaaatcttcgtctagatcaataacccaatgatttttttcggctaattcattggcttgtgtaacgatcatttcttgtcttttttgcggagacgcaatgacgaattgttcattcaatttttcttcatattcttttgcatgcgcaaatgtcacatcttcgcctaagaaacgatgacctcgagaggctctgcctgttttgacatccaagatttcgaatgggattacttcgtcatctaacaatgccacgatccagtgaatagggcggatatattcaaaatcgtattctgcccaatgcatcgttacagggaaagtcaaacttttgatcacccctgctaagcctgtcaatacttcttttgcttccttaccatgagtgtatttcgttacatagacatattccacaccttttaattctctaaaagtgatagcgtctgtcgtcagaccttgtccgcggacaaatccttccgctgctttcgtccagtttccatctgcgtccaaagcaatttttttggctggtcctttgacttcttcttcactgtccgcttgtcgttctggaatatttgttactttgattgctaaacggcgcggtgtggaaaatgtttcgatcgtatcataagtcaattggttttcatctaaaaattttgctgttttttcttctaattgtttcatgcttggtgtgacaacatgggcaggcatttcttccagcccgatttcaagtaataagtcttttgccatcttattcagcctccttcacggtttctggatttgctgtgtttttattcaacaaagggaatcctaatttttcgcgttctgccacaaagattttggctacagcacgagccatgttgcggatgcgagaaagataaccggcacgctctgttacggatactgcaccgcgggcatctaataagttgaatgtatggctgcatttcaagatataatcatacgccggatgaacaagattttcatcgatacagcgttttgcttctttttcaaaacgatcaaagttgcttagtagcaagtcttggtcgcttacttcaaaagaatatttggaatgttcatattctggttgtttgaagatctcgccatatttcacgccatcagcccattctaaatcatagacactttcaacttcttggatataagaagcaagacgttctaatccataagtgatctcagaagtgactggtttacaaggcagtccaccaacttgttggaagtacgtgaactgtgtgatttccattccgtcaagccatacttcccaacccacaccggcacagcccatggatgggttctcccagttgtcttcaacaaaacggatgtcgtgttctaatggatcgattcctaaaaggcgcaagctttctaaataaagctcttggatattctcaggtgaaggtttcatcacgacttggaattgatgatgctgatacaaacggtttgggttttcaccataacgtccatcagctggtcggcgagatggctctacgtaagcagcattccatggttctggtccgattgcccgtaaaaaggtatatgggctcatcgtacctgctcctttttctgtgtcatacgcttgcatcagcatgcagccgtttgatgaccaaaatttttgtaatgttaaaatcatatcttggacggtcaattttttactcatctgttttgcccctttcaattttaaagcgttgctgtcaaataagaatacaggaaagaaaacgacaaaaaatccctatgtctgattacagacatagggacgaataattcgcggttccaccctacttccgaataaagattcggcagcttcatttatcgtactcgcaagtgcctcttcaaaaatcgtttgggtccggctcccactctcccgaactcgctaaaccacgtgttttttactgatcttggtcaatgtacgtattcattttgcagttttcttgtttctataatagatcctctcagtgaacgatctatttgatctacggttaataatagacggaactccctgtgtttgtcaaatggttttgattttttgttgtatgtttcatttactattcttcttttttaggtagatctttttcagacatgtctttctctggcgtctttaatacgtgtgcccaagacttcatttgatcaatgaactttttgcttttcaaatggataccgacatattcatcatacagctggtcgatgagttcacggattgcttgtttggtttcttctttcagatggattccactgattttatcataagaaatagctgaaaacatccgaacgaaataaacagctcgaggatctgcatgataacggtgatcatccatcgaccagtgtctttcgcatatcacaccaccatatttggaagaatagtcaaattttccttttgtttccccacatacgacgcagtgtgtccagattggtgcaattccgaagcgttgcagtatttggacttcaaaaatattcgtgatgatttctgcatcatctccttggtccatccgttgcagtgcttgttgcgtaaactggaacaaatgcgggtcgtactgatgatcttcgattgccgcatctactagattcaataaatatgtgccatagccgctcaaaaagatgtcttcttggatgtgtcgaaacgcatgggcatctttgacactgcttaaaaatgacagaccttcacttcgaaaattcccgatataaactgcttcagtaaaagggagcaaagccggagctaatggctgattttgccgatggatccctttgatataaaacatcattttgccagaagattccgtaaagatcttgactaatttatctttttctttgtaattacggctagataaaatcaagccttttgattctgcaagctggctcatattctccctcctaaaaaataaatctggaaaagcagattctgccgatccagatcatttatgttgcgatcttccgcagcttttctcaacacgcggatttttatccagtttatttctatacctaacttacaagaagctcagaatatcagtattcgtcttttcggtagccgaagtcttgcagatagacttttttgtctcgccagtctttttgaactttgacccaaagttctagaaagactttgtctcctaaaagattttcgatatcttttctcgctttcgttcctacttgcttcagcatttttccgcctttgccgataatgatccctttttggctatctctttcgacgatgatcgtagcctggatatggattttatcattctcgtttcgcttcatcgaatcaacaacgactgcgacagaatgaggcacttcgtctcgtgttaaaaacaagactttctcacggatcaattcagaaacgatgaagtattcaggatgatcagtcacttgatcatctggaaaatattgtgggccctctggcatttcactgactaatacatccatcaaacgttcgacgttgtttccttctgtagcagagattggaatcacttgtgcaaagggcatctgcgttgaataatcttcgatgattcccaacaactcgtctggatggattttatcgattttattgataatcagataaacaggagaatgcacgttttttagacgttcaataataaaatcgtctccccgaccgcgtttttgatcagcgctgatcataaataagaccgcgtccacttctttcaacgcactgtaagctgcttctaccataaaatctcctaaacgatgctttggtttatggattcctggtgtgtcaataaaaatcaactgagcttctggtgtagtatatactccttggattttatttctagttgtctgtgccttatcactcatgatggcaattttttgacccacgattcgattcaataaagtggattttcctacattcgggcggccgacgattgcgacaaaccctgatttatgttctggcatatacgttctcctttttaattaaacaacaaatgatatattttaggaacaaataaaatcaacccaacgatgacggcaaaacaggcggtcactaaaactgctccagctgccatatctttgatttttttcccaatcggatgaaaatgaaaatccgtaaacatgtccacgacattttcaaaaacagtattgatgatctctactatccatacgagaaaaacagctaaaagcagccataaccattctatccgatcaagttggaaaatcacgcccataaacaaagcgaggattccgaacgcaacatgtttcctcatgttgcgttcttcctcaaaaacagttttgactccttggacggcaaattccacggacatcaggaaatgtttgtttttctctacgtttttatcttttaagtccataggcatctaagatctctttctgtaaaccaaacatttctttctcatcctctggtgtcatatggtcatacccgttgatatgcaagaatccatgaaccgctaaaaagccaagttcccgatcatacgaatggccgtaagcttctgcttgctctgcagcacgttcagtagagatcatgatgtctcccagtacacgaggcaatggattctctccatcttcaaaaatcactgggatttcgtcttcgccctcttcttccaaggcaaaactgatgacgtctgtcggtgcatcttttccacggtaatcacgattgattacttggatcgctgcgttgtccatgaaagtaacagacatttctgtttcttctggcaactctaaatatgatgctgcaaattgcaacaagtcgtcgatttctttcattttctcttctgatacttggtttgtttcatccatgaaagtaatatccattatacatcgcttctttctattcttcttgctattcttcttgttcttcttttatcttctcaacttccgatttcattttaggatatttgatccgagaatggaaggtactgcttaaaccgctgatcaatgatttttctactttacggatttcttttaacgtcaatccactgtcgtccaattgtccatcggaaatacgctcttctataagattatggacaaaactttcgattttttcgctcgttggatggtccattgcccgtactgccgcttcacaactgtcagctatattgacgattcctgcttcacggctttgaggttttggtccaggataacggaattgctcttccgtgacttccgggttgcgttcctttgccttaacgtagaaataacgcatcagcgtggttccatgatgctgtctgcaaatatcgatcaccatttgcggcatattataatcttccaatattttggcgccatctgtcacatgtccaaagataatatgtttactgtcttctggcaataagaaattgtgcggattttccgctcctgaaggcaagttctcaacgaaaaagctggcgtgtttgatcttgccgatatcatgataatagcaagctactcgagttagtaaagaacgtccaccgatttctgctacagcattagcacttagattggctaccatcatgctatggtgatacgtgcctggtgcttcttccagcaactgtttcaataaaggatgattaggattgctgagttcatttaatacgatcacactatcatcattgaccatcaattcaatataggggtgcagacctatcgtcagcaagaatgagaacagtgcacctgtgaatccgcagactagcgttaaccaagtcgttgcatctccaaagctcattccttggtagataatcaaaatgacatccatcatcacagggaaaataatgacccacatagcagcggataacccttgttctgagatccgtttgcgtctgacgatcgttgccatgagaccagaaaatacataggacatcaaaataactgtcagaaagttcgtgccaatcgaatcataaaaaatgaaaagtgcggatactgcttggaaaataccagccatgatccctgctcttcgattcaagaaaaagcttaaaacaagtggagcaaaagccgcggggtaaaacagcggaatataagcagcttgttctgtttggaagagttggaaaaatttcattagtactacgctgactgacattgccgtcacgtagaaaagtacgtattttgttctttctcctgcattttggaattgaagtgaattataaatcagtacaccgatttgaagcaaaacagctaaaaccatggcaatgagtgggaaaatcgaagtcgtttgattcgtcaatcctagtaattccaattttttcattgctgaagcatcaatttgatttccttcgcgaacaatgatttctccttggaagatcatcactggttgtacagcttctcgtgcagattgttttaattcttctgtctttttctcattcaatacatcattgactacaattccttgatctactaagtagcgaatcatttgttgctgctctgttgtgacattcaaatattgaatctgatcttctgcttcttgtttaaaagcttccaattcgctttcacgaacttgtttactcatctgttcgtcaatgagcttcaaactttcatccctaactgtgtgaatttccgtttcagtcatttcaaatatcgtcgaataaaaattgttcggcagtttttggtaaaacgcaacgttttctgcattcacgttttcaaaatttttcttcagtgtagcaatccgctcttctgtagtaggtttcgggatattttcatcttccttcgccttatctaccttgtcattataagatttgttgatggtatcattcgtcttatcgatcaattcgaataattgcttgatccgattgttctggtcatctgccagatctttttgataagtatattctggagtcactgcttctgctgccagttttcttctttgttcggtttcttccgtgttctcgatcgttttattcgcacggatactctcttctgctacttggccttctctaaaatcattggccttttgtttgacactactaaatgtaacgccgcagacaatgataaaaaacaagaacagaaggaaaggcaatgctgcctttccgagtttttcttgtagtttctgcagtgttttattcaacatgtgcttatcctcctaagcaaagcttattcttgatgaagatccgccttttcataagctttgatgatttcggcaactacagggtgccgaacaacgtcacttgcttcaaaattaacaaaatcgatttttttgatttgctttagtgttcgttctgcatgaacaagaccacttgtcgtccctcgaggcaagtctatctgacttgtatccccattgacaatcatttttgattgataaccgagacgggtcaagaacattttcatctgagcgactgtcgtgttttgtgcttcgtccaagataacgaatgcatcatccaatgtccgcccccgcatgtaagctaaaggtgcgatttcgatcacgcctcgttccatcaatcggttcgtatgatccaatccaaaaatttggtataaagcatcataaacaggccgcagataaggatccactttttctttcagatccccgggtagaaagcctaggttttcccctgcctccacagcgggccgcgtcaaaatgattttttgcacttcgcctttttttaaggcagcaattgctaatactacggcaagaaacgttttccctgttccggctggccctacaccaaatacgatgtcatgtttggctaccgattcaacgtatttcttttgaccgctgttttttacccgtataggttttccattacggtctttgacgatctcttcctcatacatctcaacaaaataatctaatgtacctttttgtcccattttcaatgccgtcacgacatctggtgtacttacgtggattcctcgtttgatcaattcctgtaatgtccgaatgactgaggcagccaaggaaatctgggattgttcaccaatgatctgaatgatttctccacgtgtatggatggttgtttccgttgtttcctcgatcagttttatatgcttgtcgtgtgcacctaaaagcatgctgacatcatcagcagctgtcaatctaatctctaaagaactagactcttccgtcaaaaatagacatcccctttttttcgattcattctttcctattttaccatactcagaagaaactatatagcaaataagaaaaggttgtaaaagagtcgcttaaccatacgtaccaagaaacgttaaaaaatagccgtttccattcgctaaaggtctcgttttgataaaaagaagctgagaatgtaagttatatgaaagtggagaacaaaatatttcgtttcattcaacaagtattctctaggtatttttcctgtttcaaaaaaagaaaacaaaatagttaaaatattcttgcatttcaaaaaaaacaggtgtattattacgtcaacaaatgaacatacagcaaagcgtcgaggaaaacagtaggctattcaacgatttattcccagtgagtcatgtaagtgagaaatgacaataaatcgaatagacgaacatcatttccgagtcaatgtcgaaaacgtagatcattgtggctgcctccattatcaggctagcggataactttatcaaaaagcgtccgtgaatgaagaagcttttttaagcgaaaaaaggtggtaccgttctagaatctagagcccttttcccaagtggaaaagggcttttttttattttaaggtggtggttttcatggaatctgatattagtggcattactaattgctgcaacgtttatatcgtcaatcaaaatgataattattggaggaaaaatttatggaagaaacaaaaacttattcatggaaacaactattgatggtcagttcacttatcttcgggatgttcttcgggtcaggtaatctaatctttcctgtccacttaggtcaaatggcgggcgcaaactgggtcagtgctggcgtaggatttgccatctcaggcgctcttttcccattactagctatcttagctgtagtagtgacaaaaagtgatggtctgtatgacttagctaaacctgtcggaaaatggtatgctgccttgttcttaatccttgttcatttgacgatcggaccatttttcggtacaccacggacagctgctactgcttttgaaatggctgctaaaccatttttgcctgaaaaatataattcattaggtatgtttttattctctgctcttttctttttacttgcttatttccttactgtccatccaacacggttggtcaaatacgtcggaaagtatctaaactccttgtttcttgcattattagcaatcatttttgtcgtttctttattccatccaatgggaaatctaaatcaatctgctgcagatacttatcaaacaaacgctttaacaaatggtgtcctagaaggttataacacggttgatgcagtagctttgcttgccttaagtgtcacttttgtccatgcagtccgtgaccttggtttcaaagataaaaaagtcacagaattaacggcaaaagctggtagcctgagcgttgcgctagaagtcatgatctattttggacttgttcttctcggtgcgatgagtttgaataagatgtctttatcagaaaatggcggaactgcactttctcagatcactaatttttatttaggtaacttcggcgctagcttcttaggagtgatggtcacattaggtgtcttcactaccgctatgggactcgttgtttcttttgcgcaagatttccataaactgttccctaaagtcagttatatgacatggctgcggttaacgactttcgtctcttttgtcgttgcaaatgctggtttagacaatatcatccaatggtctttaccagtattgatgcttttgtatccattgtcgcttgcgttgatcttgctttccttaacagcaaaatttttccaaaagacaccatttgtctatcaagtaacgatgttgtttgctgctgttcctgccgtattggatatgctggcaaattcgcctgctttagtgagtcaacaaagagttgtagcaagcatgctcgaattttatcatcatcacgttccttttgctgcattaggacttggctggatggtcccaacgttacttggttacgctggcagcctactgttttattacgcctatcgcctatcagggtataaacaagaagcaaatgaactaccagaagaataaccaaatcaaacacaatttaacataagaaatattaaacaggaaaaaaccagctagatgaaagaatcctattctttcgtctagctattttttagttctcttttttacgcgcacaaaaaaactgcggacaatgattgtccgcagtttaaatgataaaattaagattgtaatagttctttcacaatggcatttacttggtttccatctgcttttcctttgactttaggcatgatcgcacccatgactttgccaaattctttcattgatgaagcaccagtttgtgtgattgcttcttgaacaagttgtcgaatttcttcgtcggaaagttgttccggcatgtatttttcgactatcacaatttcactttttactttttcagctaaatcgtcacgtcctgcttcttcaaactcatgcaaagaatcacgtcgctgtttcatttcgcgagacaacaccgttaattcttcttcttctgtcaagtcgtgaccttctttaatctgctcgttttgtatagatgacttgatcattcggatgacttgtaaagattccttatctttcgctttcatcgctgttttcatgtcatcgtttaatctacttagtagtgacacactaccaactccaattcatcacagaactagaattttttgcgttttctagctgcttcagattttttcttgcgtcttacacttggtttttcgtagaattcacgtttacgagattcttgtaaagtacccgcttttgacacggaacgtttgaagcgacgaagagcatcgtcaagtgattcgtttttgcgaacgactgtttttgacatgttaattccctccctccgagcttaaaaagtaaccgtaattgttattgaaatatatctcaaaaaacaagactgtcctgtaaatattatatctaatgctgttttgaccgtcaaggaaatcttgcttttttttaaaattatcaaatgttattttatttaaatccttattgacaattttcacatcttccgaaaatctcgaatctatgcccttcgatcgtacatccaccgagctgttcttcgaaataattcattggacacatatggatttctttcgttgttccgcacaccgtacagataaagtgatggtgatggccgatttccccttgacagcaatgaaaacgaaacttcatctctccatttaaatcggtttcttccagtaaatcgatttctgcaaaatcatggagatttcgataaatcgtatcgtaacttactcctttgaattcctgattcatatagtcaaaaacttctttagcggatacgtagcgattgcgcttcactaaataagttaacaatgcttctctttttttagtatatttaaaaccgttatttttcaatgtttctagtgattgttcgatcaatgtctgttttttcatgacttattcctccaaatcaaaatgattacgaagtacacattctagagtatggtataataaacataaaaaaaatgcaagtgaggttttatccatgtcttccgattctacagaaatcgttactttttttgtcatctccgactctgccggagaaactgcgacaaaattagcgcaagccactatggcccaatatcctaccgttgagttcaatttattccgcagaacatttgtgacagatgagaaaacattgatgcaggcactgcaagatgcactaaaagaaaaagcccttgtcctacacacattgatcaatcaagaattgatcgagatgacgcgttctttttgtgaagaacatcaattatttagttttgatgtgatgactccgccgatatcagaaatcgagcgcttaactggtatcaagcccattcggcaacctggcgcccttcatttattgaatgagaactatttcaaacggatcaaagcaatggaatttgctgtaaaatacgatgacgggaaagatcctcgtgggtttctagaagcagatgtcgttttgctaggcgtatccagaacttccaaaacgcctttgagcttgtttttagctaacaaaaatttaaaggttgccaatctacctttgatcccacaagcacatattcccaaacagctttgggagatcgatcctaaaaaaatcgtgggactgacgaataacccagatattttaaacaatatccgtaaagaacggatgcgctcttacggattaaatcctgatactgcttattccgatatcgaaaaaatacgagctgaactcgattttgcgaatgatctttatgaaaaattgggctgcgtagtaatcaatgtcgcttctttatctatcgaagaaacggcttcacttattttgaatgctttagacctagaagatcatagttattatggaactgaaaccaccgaagaaacagactaacaatttttctttaaaaaaactggactgtgtcagcgaagaagattcgttgatacagtccagtttgtctctatttgcacctatcgttattgatgttccacatgtttgagcgtctggttcaaaatatccagtacgtgagaatcatcaagactatacaaaatcgcttttccctcacgatgggacttgacgacatggttttctcttaataaacgcagttgatgcgatacagcagattgttccatttctactgcttgggtgattgctgtcacattttgttccccgtctttcagatacagcagaattttgagacgagtggggtcactcaacattttgaatagttggctgactttctctacttttgttttttgcgtgtctggcaatccattcacctccaacttgaaaaaagactgacttctaaagtttaccactttttccatcagtctcaagtttttttattcttctgtcatttttttgataatcgcttcataagcggctactttttcagctgcgtcttctgaagagtttccttttacaccgatataaaatttgattttcggctcagttcctgaaggacggatagcgatccagccattttcttccagcgtatacttcaatacgtcagatggcggtgtcgttagtttttctacgtttccttcacggtctgttctcgtcaactctttgaagtcttctgtttggatgacttttgctccggcaaattctgtcggtgcttcttcacggaatttttccatcaaagcagagatttttgcagagccttcttgtccgctcattgtcacagaaatcgttttttctgcgtagtagccatatgtttcaaaaatcgtttgcaagccgtcatacaatgttttgccttgttttttatagtaagctgctacttctgctaataagagcaatgcttgaatcgcgtctttgtcgcgaacgaaaggtttaactaaataaccgtaactttcttcgaatccgaacataaaagtatgggaatgatcttcttcaaattgttgaattttttcagcaatgaatttgaatcctgtcaatacattgaacatggtagccccatagtgttccgcaattgctgtaggcaattcgctagaaacgattgatttcaataccgctgcattttcaggtaaagtgcctcgcgattggtgtgcttccaaaatatattgagcaaacagggctccgatttggtttcctgtcaatacttcataggagccatttggcaaacgaacggctgcgcctaaacggtctgcatcaggatctgttgcaatcagtaagtcagcgccttctttctcgccaagtcgcatcgcatactcgaaagcagagtgttcttctggattcggtgatttgactgtagtgaaatccgggtctgcgacagcttgttctggaactagtacgaattgttcgaatccagcttgtttcaacgcacgttcgcccaacatttttcctgttccgtgaagtggtgtgtacacaagcttcaaatctttacccattgtttccaccaattcatgatcaatcgttactgctttgatttcttctagataagcggcatccacttcttctccgatgatcgtgatcaatccgctatgttcagcttcgtcgtcagataatacttcaacttttaacggattgctgacttcacggacatatttcgtcaatgcatctgcgtctgcaggaggcatttgtcccccatcttctccgtagactttatatccgttgtaagctgctggattgtgggatgcagttaccatgattcccgcaaacgtcttcaaatgacggactgcaaaagaaagctctggtgttggacgtaaactttcgaatacataagaagggatattgtgatgtgctaatgttttggctgcttccatggcaaattctggtgattgatggcgtgagtcataagcgatagcgacacctcggcgttttgtttcttcaccttgtgtatccatgaaacgtgcaagtccttctgttgcttgtcttaccgtatagatgttcattcgattgatcccaggtcctaagattccccgcatgcctgcagtaccgaattccaacggtgcataaaaagcatcttcaagtttttcaggatcttcacccagatcatttaattgtttttttaagttttcttctaaattttcttcatgtacccattgttcatacacttgttcccaagacatgaaaataacacctctttctgaaatatggttcttaataagtatagcattcacttattagatatgaaagtatgaggaccaaaaaacgcttaaatcaagaaaagattcttttatcaagcacggttacaagtattcgcataaatcggattcagtagatttcacgcaaaaaaaagagtaaaagaacaattgaaaccgttctttcactctttttaaacttatgcagttgtttcttctaaagattccaagtatttatacacttgttgtccagcaatcccaccatcaccaacagcagtagtgatttgtcgcaaatctttttcacgaacatctccgatggcaaaaacgcctggtatattcgtcttcatttcgttgtctgttggaatccagccggcttcgttcgtcaacccagcttctctaaatggtgcagttaatggatccaatcctacatagatgaatactccgtctgctgccaaatcaaactcattgccagttttgacattacgtgctttcacacctgtcactaccatttcatttccaacgatttcgtcaacgactgtatcccacataaaggaaattttttcattcgcaaatgcacggtcttggatgatcttttgtgcacgtaattcatctctacggtggacgatgactacttcagaagcaaattgtgtcaaatagatggcttcttctactgctgagtctcctcctccgatcactactagacgtttgttacggaaaaatgcaccatcacaaactgcacagtaagaaacgccacgtccagcaaattcttcctcgccaggtacgcctaatttacggtggatacagcctgttgcgataatgactgtttttccttcgtaagttttatcttcacaaataacttctttgtggctgccgtgatccttgatatcttgcacgattccataagcattttctgtcccaaatcttgaaacaccttcatacatcttataagctagatcaggacccatgattgaatcgaaaccaggatagttttcgatttctgccgtattgttcatttggccgccaggagcgccttgttcgatcatcaatacggataagtttgaacgtgaagcatataaagcagcagtcatcccagcaggccctgcgccaataacgattacatcatacatatgtagattctcctttacttaatcaagtaagcatactttacagccaatgcgaaaaaaagtctattgttctgcttgcgtttctcgaatagctttattatactcgaaaaatccgctgaaaaacaatagacttttataaatcattgatcaatcgttcgaaagattttctccatttgaatcaattacttttttataccagttgaatgatttcttcttcgaacgggctaatgtgccatttccttcgttgtcacgatcgacataaatgaatccgtaccttttcttcatctcacctgtaccagctgatactaaatcaatacatccccaagtcgtatagcctaatagatcgactccatctaattctactgcatctttcattgcctggatatgtgctgccagatagtcgattcgataatcatcttccacataaccattctcatcgggcgtatcgactgcacctaagccgttttctacaataaatagtggtttttgataacgatcataaatatcattcatcgttattctcaagcctaatggatcaatttgccaaccccattcacttgcttccagatatggatttttgacagaagcaaagatatttcctgcagtctgttccaagagttcgttgtcagtagtcgaaactcgagaagaataataagaaaaggagataaaatcaacagtatgttctttcagcaatgcggcatccccaggttctattttgatctgaatgccatttcgttccatttctttcaatgcataagcgggatattctcctcgtgactggacatcaatgaagaaataattttctcgatctgactttctagaagcccaaacatcttcaggattgcaagtgtatggataatatgctcctgctgccagcatacagcctactttgttctccggatctacttcatgagcgatcttcgttgcgatggcacttgcaaccaactcatgatgtgccgcttgatatttgatttgttcttcattttctccttcttcaaaatacagccctgcgcccatgaatggtgcatgaaggatcatattgatctcattgaatgtcaaccaatatttgacaagtcctttatagcgattgaagatgactcggcacagattttcataaaaaccaacgagttctctagaacgccacgcaccatattctttgatcaaatgcatcggacaatcaaaatgtgtaatcgtcacaagcggctcgatcccgtacttttgacattctttaaagacatcctcataaaatttcaaaccagattcatttggctcattttcatcgcccattggaaaaatacgactccaagcaatggacatccgataagtcttgaaccccatttctgcaaacaaagcaatatcttccttataatgatgatacatatcgatcgcaatttttgctggataaaaatgatctttatcaaattcaaacattttcttttttccagtaatgacaggaaaacggtcttctccgattggcacaacatctacgttcgctaacccacgtccgccttcatcataaccaccctcgcattgattggctgctgtagcaccgccccataaaaaatcttttctgaatcccatcatacttcctccattacatgtgtattgcttgacaattctcttgccagttcatcttggacttcgattccttctgcttttaaccggctgattgtttccttgaattgcggtaaatactgctgatgtgcaataaacaactcatccatgatccgttttgctgtctttcctgatcgtataagcggattgatcgtaaacgcttgtaaagctgttccataatcaccagtcacggctgcttcgatcgtcagcaattccatattcttcattacttgcaaccagcctctttcagcagcaggaagggaaccaaacgctacatttcgtgcgccttgtgcgccaacataggcagtgacttctactacacaatctgccggcagatcaggaacagctccatcattctttgtagacaccacgatctgtgtttctttatttccatagatcgaagcaatcgtttcacaggcagcatctgaataataagcaccacctcgttttttcaattgttcaggtttatgatccaattctggatctttgtataattcaaacagctctgcttctgtttctttcacttgttgcgctcttgtaccaatcgtttgatattcttctaaagcatgttccaacatttcttcttcacggtagtaatagcggtggtagccacaagggatcatgttcatttgttttaattgttctttgaaaaacgggatgtcaaagatatttttcggcaatccattgtcttcatcgtataaacgatcaatcaaatctgctgtgcggtcatttcctttattatctgctactttgtgccaatggaagtgatttagaccggcaaacttgtagatcagctcttcttttttcttgccaagcattgctggttctgtcatcgtcgccattactggcacattgcataatccgatcactttatcccatttgccatatctgataactgcttctgtcaccatcccgcttgggttcgcgaaattgatcagccaagcatttggacataaacgcttcatgtcttcaacgattgccaaaaccactgaaacggtacgaaaagctttgaatatcccgccagcaccatttgtttcttgcccaatcatcccataataactagggatccgctcgtctttgattcgtgcatctaattgaccgacacgaaactgagtcgtaacaaaatccgcatctttcaatgcttcttcccgatccaaagttgcatagatcttgacttcatacggagaagcatcccacatacgctgagacatctgactgacgatctcaagcttttcttttccttcttctacatctacgagccagatttctcgtatcggtaattcctcatatcttttgataaatccttccatcaactcgggggtgtaactgctgcctccaccaatcgtagcgattttgattccttttgccatgttctcactcctttgctttttacacttttattatcttttttgtaaacaaaacaaacaatagaaattcgtttctttccagtaacatttacaaaagttagtgttttctactggatttttgtaaatatcttgtcaaaaaatgactttattaagctatataacataaatccgtttacaaatcattttcaaaaaagttataatttacgtaaaaaaactagaagaaggtatctacatgttattacgtgaaaaaatcaaagaaatctccttttctccttcagaaaatgaagtgattcagtttctcttaagcgattctccagcacttggcgaaatgaccatccaagagattgctgagcgatgttatgtccacccgtccacactcatccgtgtagcaaaaaaaatgggttttgatggctgggtcagttttcgtaatgcttttttagctgaaacagcctatcttgaagggaattttcaagacgtagatgcgaatcttcctttttccaccacagacggtattatgacgatcgcaaataaaatggcttctttagaacagatgacgattcaagatacactttctctcattcatcatgaccaactgcaaaaagccaaacaactaatgcttcaagcaaaaaaaatcgtgattttcgccagtaactcgaatactttgatttctcaagatttcatgctgaaaatgaagcgcatcaaaatggatgtcacgattgtcaccacttttggtgaatcgttctatgaagcgtacaattgcacgagtgatatgtgcgggattctgatttcttatacgggtgaaaacaatgtgatccttcgtaccgcagaaatattgaaacaaaatcatgttccaattttagcgttgaccagtatcggtgattcaacgctatcctcaatgagtacagccgctttgcgacttacgacacgcgaacgactgtattcaaaaattggtaattttacgatcaatacatcgatttgttatcttctagacgtgttatatagttgtgtttttgcagaaaattatcaacagaatttagtccatctaatttctgtaggacaaaaatttgataaacgccctatcagctcagccatcatgaaagagcctttcaattttgaaaataaagaagtggactaaaaagaatagttaagtctattccattctttcacctaaccgttcaggtcagtgcggtgataagtgcatcgtctggcccgaccgtctccccttgattttccaaaatatccaaataatccatgtaattggtgacgattacaggtgtttctaaactgtatccttccttttcgattttctttttgtcgaagcggagcaacagatcgccttgtttcactctttctccttgctgcaccaagctttcaaaatatttcccttccaactgaacagtatccaatccgacatgaatcagtaattccagacctgtttcagaaaccattccgattgcatgtttcgtggggaacagggtcatgactgttccgtcaaaaggggcacgtacttctcctttttcagggtagatcaagattcctcgacctagtgttccttgtgcaaaagctgcatcctttgctgctttcagtggagcgatttgtccttgtatcggtgtttttacaatttctttacctgatcttttctgtctgtcatctgtttcacctgcttcctccttccaaaagaaaaaagtcagcgcaaaggataccaccatcgcaatggcgatcccaatcaatacattaatcacatctgttaaatcaccatctggtctaatatagttgggaattgtaaagatgcctagtccaccttgattccaagaagttaaattcattaacccactatacgcgccccctaacgcaccaccgacacaggtaaaaataaatatttttttacgtggtaatgtaaacccataaatagctggctctgtaatccccacaataccagaaacaatggctggtattgcaattgctttgtcttttggatttctaagcttaaagtagagtgcggtaagtgctgcagtttgtccaaaagacactactgcaacaggtgtcataatattttgccaaccattcacagaaaattgcatcaatcccattggtacgattgcccaatggagaccaaacatcaccagaatttgccagaagaagcctacgattgctccataaataactggcgaaagtgctaaaagtgtttcaaatccagccattaaaatatcagttgcgaatgtgaatactggtccaacgagtaaaaaacctaaaggcattgtaataagaacggtgaagaatggaacgaagaaattcgcgatcatctcaggtactaactttttaattggtttctgaatttggctagctaacaacacaataaagataatgggaatgacagaagaagcgtagttacgcgcaatccagggaatgccgaatactgtttgataaataggtgcttcaaaaatagtgccagaaaatatggtcgttagtggtgcttctgctgcaccactcaaagcttccagcgacaagctaggattcattaatgctgcgccaagcaacatccctacgaattcatttactttaaatttacgggcagctgttaaaccgataataacaggcataaattggaatacagaatcaccgatattatcaaacataacaaatgtgccagaaccgcggtcaaacgcgcctaagaagacaaggaatgctgtcagtccacgaatcatcccgccagcagctaagatagcaaggaatggttggaaacagcccgatattccatcaataagcatatcaaacggtctcattttttctgttgaaacagcctcatcaaaagtaaggtttcctgcttttataacctcttcaaacacgactggcacatgattcccgatgacaacttgatactgccctcccgctcgcattaccgttacaataccgtccatatttttcaagatctcatcatttgctttttcttcgttttttaatttgaaacgaagccttgtgatacaatgtgtcaaaccattgatattttccttcccaccgacattttctacgatttttctcgctaattcttggtattttcccatttctattccctccaatatattagtggaaggtttagccaactgaatgtcactacccttatttcatacgttcttgttaatttatcctcctttttttatttatttacaacgattctcatgcactaaacgcgcagtatggatcgttaaatacattttttcgtccgtggacatctggtagttgaacgtctcggctaaaaagtctgctattttctcaacgcaaccaaacgtatccttatatttttttgaataacctgaaacaattcctcagaaacttctcccacttctgttttttctccatctaggacgcgtgtcagaaaaaaacgtaagtgtgtgacgaatcgaaaaaaatggactgaatcttcatcaaatgtaatcttatagtaatagcggacgatatttagaatatcctgtattgttatagtaaacaggtaggtattgtcttgttggctttgaatgccttgtgcattgactaaatgcaatgcgataaatccggcttcatcttctgataacttgatgtggtatttatccgagattttcttcactgtttttttcccgatggcatactctttaggaaatagttgtttgatatcatacagcaatacatttggtacaaatattcccattttgtgacgttcgatagccgtatacaaatgatccgtcaatgcaatatacacagaatcattcaactggacttgtagagcctcttttgtatattcaatgatttcacaagaaatttctaagtactcaagaggaatcgcttgtgccaattcttggaactgttgtgaaagcccgtcatttgtcaactgaaattttttgtcgatgcatgagtcaaaaatcgggtcacccactttctttttgaatgccaaaccttttcccatcacgatcatttcctgatttctttcatccctggttattacgacgttgttattcagtactttctcaatcagcatgttttgctcctttccatgatatatagggctgtatccaaaacaaaaagaaaaacccaaaaagccgtccatggaaccatgggagactcatcaggtttagcttgcatcaggcaatcactatccaagttgtatcgttttctttatattatcgaaagcaaacgcttttgtcaacgctttcttagtggttattagccgcttttgactagctgtcgtcgtcttttttaaatcgggtgactacgccactaacgctcacagatgaagaatctgggaagctctgttttattttcactctagcgcttagggcaaaatgctactatgctactgtcacaacctctttttacacaccactgctttgcagtttgtacatatctgcatacaaaccattttgcgctagaagtgtttcatgattcccacgctctactatatgacctttgtctaaaactaaaatcaattctgcatcccgaatcgtggacagccgatgggcaatcgctatcgttgtccgtccttgtcgcatttttgccaatccttcttggatcaatccttcggtttcagtatcgatatttgctgttgcttcatccaatactagtattttaggatctgtcacgattgttcgcgcaaaagtgatcagctgtcgttgtccactagaatagctggcaccgtgttcgatcacttttgagtgatatccttttggtaattcatcgatgaacttgtttgcttgaacaaactcagctgcatggcgaatctgttcgtctgtgatagctggattcatcatccggatatttcctgcaatatctccataaaacaagaaggcatcttgcaagaccaatcccattttcttacgtaactcttccattggatattctcgaatgtcatgatcatcaatcaagatctggccttcataaaattcgtaaaaccgcatcaatacgttgatgatcgagctttttccgcttccggtgtgccccactaatgcaacggtctcacccggattagcgacaaaagagatattgttcaatacattgtgctctccatcataagaaaagcttacattgcgaaactcgatcttacctgaagtaatcgcttgatctgctccaggattttgttgcggtgcatattcttctgtatccatgattttcaaaatacgactaccggcaaccatcccatctgtaaaggtgctcaaaaagtccatcatttgagacattggattaaaaaatccctggacataggtcgtaaatgcatagatcagtccaacttctacgggagaatgcaacgcatcgatcccaaacaaagtcaacgccaacgcaatcgccaatgcatagagaaaattgatgatcggacttaacagaatcgaattcgttttgatcatcgcatagcgcgtgtctaaatactcgttgttcacttgttcaaattctttagctaaacgagcttcttggcgaaactgctggataatacgcatgccggaaatcgattcattcaatttcgtgttcagctgacttaatttttcccgcatatttcggtaaatacgagaactgaatttctggtaataccagatgacgattcctaaaatcggcaagaacaccaaagtccacaaggcaatttctccattgatttgaaacatggcaacgaaagaagaaacgactgcaaagatcccagtcaataccatcaaaaagacataccaaaattcaaatagcgtttctgtgtcattcgtcactcgagaaacggtcgatcctgccggtgtctggtcaaaataacgcatacctagtgtatgcagcttttcaaataatcttacccgaacatactgataggtcttcaatgaagccatggaatacaaataccattggaaaaaccaaatgatacttttgactatgactccaaacaagtacacaccagcaaaaaacaaaataacttgtgtcgtagctgactgtttagccagatgatcatccataaaagtttggatgatccttggcaataggacattgatcacagacagggcaaacgcaaataagatagcaacgatgaacgttcttctaaaaggtttggcgaacttcatcagtcgtttgatgatcttcttctgttctttaagtggaatcgattttgtccattccgattgataattttcatccatcaggcctcgcctccttctatcttcgcttctaattgctgtttttcccacattcgttcataccagccacctaatgcaagcagctcgtggtgggttcctcgttcaatgattttcccttgatcgacaacaatgatttcttttgcatgcatcacgctgcttaaacggtgagctgcaatgatggttgttttctcttttcttatttcttttaaattatgcaagatagcttcttctgttttggcatctactgcagaaagtgcatcatctaagatcagcaattcaggatttttgatcaatgctcgagcaatcgaaatcctctgtttctgtccgccagataaagagactccacgttctccaactaaggtatcataaccttttggcaattccttgatttcattgttgataaatgctaaagaagccgcatgctctacttcttcttctgaaagttttggattagaaaaacggatattatctcgaatggtcatcgaaaacaagaagtgatcctgaggcacataaccgattgatcctaataaagcattcaatgaatattctttgatcgaacgtccgccaaattggattttcccttgataatcatcgtattcacgcatcagtaatttgatgattgtcgtttttcccgcaccagttttcccaacaatacctaatgtttctccttcttggatcgcaaatttgatttgttctaatgctggtgattcttctttcggatagttaaaagaggaaatagctacattcagctcgccttttgccggggtctgcactgcacccagttgttccacgatatgcgtcttttcatgcaaaagttcattgacgcgatcataagaagcatttcctctttccaatacgttgaacaatcgaccaatcgcaaacatcggccaaacaagcataccgatatagctaataaatgagaccatctgcccgatcgagatcgtgccttccaatacatactttccacctaaaataattgttgcaacataagacagaccgataatcaaggtaatgaatggatcaaataaggagtctaaaaaattgactcgtttgtttttaataattgcatcttcaatcttttcttcaaaatccgcgagatcttctttttcttgtccaaatgttttaatgactttgatcccagtgatactttcttgtgtcttatcattgatactagaaaaagcttcttgcgaatcacgaaaagcatcgtggagttttgaccccagcactcgtgaagtaacggctagcaaaggcagaggaatcagcgcaatcagtgttaagcgccaatcaataaacaaaatcatcgcaatgatcgttgttccgcccgtaatcactgaatctgcaaaggtcaagattccagctcctgctacattctggattgcattcaaatcattcgttgcatgagccatcaaatctccagtccgatatttttggtaaaagagattgtccatttctgtaaaatgtttgaatagctgctgccgaagttctttctccaaccgagctgcacttccccaaatattcgtccgccagatataacgaaaaagatattgtaagaaagctgcaatgatcaatagtaagatccaccaagaaatgatctttattgataaattcttatcggcgatctcatcaatgatgatcccaatcacttttggaggaactaactgtaccaaggccactgcgaatagggagaaaatcccaattaaataatgtttcttttcctgacgaaaaaaccaacctaattttctaaaaatcgacattttactcctcctttgtctttatcaagagcataggattgtctgtgcttgtcttttttgctgaatagtctgaatagtctaacaaattatgaaataaaaaacggactgaaaaaatcagcccgcaaaaagtctttgggtcagaacctattttttcccttggttcttcatttgctgcatcatctggcgaattttcttctcagatggtttttgccccattgacatcatcattgatcgcaacatgtcctcattaacgggaggatttttttctaaatagtctttcatatatttacgcgctaggaaaaagccacctactgcgccgattagcaaagcaataatagcaataagtacgacaatacctgttgataccatataaatctctcctttctatttccgaattgctctcaatgatttattttactaaagtttattgaaaaaagaaaggcgtattctttagtttcatgcaaaaaatagtggtttttttagagaagaacaaaatttcttttattaaccagcaagacacgccacgaaaaaaaattaggcataccgaatctttttctttaattttttctttctgaggtgtagaatgtaatcgtagataaataggaaaggtggttttttcttgaataatcaatccaacaaacaatttcataagcatcgacttattgaacatacaaatggtttatctttagctgaagtaaatggaacagtggatgtaccaaagggaaaaagtttttttaaaacacttcttgcttactctggaccaggtgcattagtagcagttggttatatggatccaggtaactggtccacttcgatcactggtggacaaaatttccaatatttattgatgtcagttattttgatgtctagtctaattgctatgcttttacagtatatggcagcaaaattaggaatcgtgacccaaatggatttggcccaagcaatccgagcacggacaagtaagacattgggtgtcattttatggatcttgactgaattagccattatggcaacagacatcgcagaagtcattggtgcagcaatcgccctctacttactttttgatattccattggtaattgccgtatttatcactgtgttagatgttttcgtccttttattgctgacaaaagtcgggtttcgtaaaatcgaagctttggttgtctgcttgattttcgtcattttattcgttttcgtctatcaagttggcttgtctaaccctgattggcacagtttatttgctggctttatccctaacagtcatacattctcagactcacctgtcataggtggtgaaactccgctgactggagcgttagggattattggtgcaacagtcatgccgcataacttatatcttcattcagcagtttctcaaactcggaagattgatcaccaagacgaagaagatgtagcacaagcggtacgcttttctacttgggactctaatatccagttgtcaatggcttttttagtcaatgcactgctattgatcatgggtgtcgctgtattcaaaaccggttctgtccaagatccttccttttttggtctgtatgaagctttatctgatccatcagctatgagcaatggtatcttgattgctgtagcaaaatctggtatcttgtctactttatttgctgtagcacttcttgcttctggccagaactctactattactggtacgttgaccggtcaagtcatcatggaaggcttcatccatatgcgtatcccgatttggctaagaagactagtcacacgattgctttctgtgattcctgtattgatttgtgttttgtttacaagtacaaaaggaacgatagaagaacataccgctttgaataacttgatgaatgaatcccaagtttttctggcttttgcattgccattctcgatgattcctttactgatgatgaccaatagccaagcggagatggggagccgattcaaaaattcatttgttgtaaaactacttggctggttctctgtgattagtctgacttacttgaacttacgaggattaccaggtcaaatcgaaagtttcttcggcgagcaagccacctcagctcaactagcattggctgatcaaatcgcttatgtaatcattgttcttgtccttctcctgttggcatggacgattggtgatttatataaaggaaacaaaaaatatgaacagcgtttgcaagaaacgatagaagaaatcgaatagaaactgattcttttacacaaaggaggttgtgacagaagtgggcagcttcaagaaataagaaggaatttaagaaaattgcttttcaaatttttgtgaaatttcggcttatttccgaagaagttacttctggaacaccgtgtatcagaggttgtgaaaaagctgccctgcatcaagtaataagaacagccaaacaaaaatagttcctcatattttacgtttggttgagcttattaccgcagatgcaagcttttgagcaccgtttattcggaaaaaggaactgcgacaagacttttgtcacagttccctttttatttggaagataaagcttttttcagattcaatttactgaaaactagcatgcttgttactgcgatgaattgcgttaatggcacgcctgcgccagtgtagacacttaaaaaataatcctttttttctggcgcataagaacaaaaccacgagacaccgaaaagaaaaaccaattgtgtcagtattaatccgatgactacaatcaaagaggaactataataggcacgatcagcttttgcaaatacggttcctagtatcataagtaatatccctgctattgaagcaatcagcacgggaatggccagaacttggtaaatttttatcatgacattcgcgacttttgctgtttttgtcaactggaaatcaggtgttctcggatcactgctatcgatccaattatccattagtggaagattcaataattcttgtgcctgttcgacttgttcttgcgtcccaaaactataattccccccttgatggaaatctttgtatcgccatgcataagcatatcctgatttcagaaaatcaaatacgattggcagatcattcatcgtctttccatcccctgatcccatcagatagaattcttttttctttttgatagttcccttttgataggcttcttctaattcttgattgacttttttccaaaaatcattggtttcttttgcattgttttggtaataaccagattcgcttaccacatctcgcaatgcccaaaaaatgatatctcctggtaattcttttacttttccgccttgggtccacgcatgagtcgtatacaattcgtcaatacgagtagaaacagtatgaaatgtaggagatgcgtctaaagctttatttaatgcagcatgcgagacccatatctcactgttttctttatttaagtttgtttcgtcatctattcggatcagctgtttcatcaaacgtccaaattcgccactcgaacggtcattgatggcggcaataccatatgttgtctcgtttttatattcgatccactgatagacgatggagaaaccgactagagggagtaaaaacaatgaaagtttcagccattcttgtttcgaaaggagaaatggtcgttcttttaacttctttgcttctttgaaagaaaagtcttgtcctagcaagatctgaacgaaactgatgcctaacgcgactacagtaaaaggaagaagccagatggaatcttcgcgaatgaaccaaaagaaaggaaaagaaacagctagccctaaaaaccacggcagcaattttttgctggaactatatttgcggtaataaatagctagtaaacaagcgataatgatctcaacagtcgggatcacgagagcattacgatatgttcgagtggaatattcatgtgtaaaactaatcggagaaaacaaaaaataaaaatagatacttaaaagaagatacttgttcttcacgattggtttaaacgctagtgcaaccaatatactggcaagaatactgaacatgccgaataaaactgcataagaaagatgcagtttatgtgcaagtactaaaaacaagctgtaggaaatcccttttgaaagtgtcgtagtcgtgtactcccctagccatttaccatccaaaatattttgagcatagtgaatcagcagctgatcatcataggtcgccgacatatctgttccatagattgctttactatataaatacaaccgaataattgtaaataatacggctatgccaagaataaagtatgtgtgtttcttttttagttggtcgatcaaggggtttaaaatgttcagcatcttttcgtcctttcaatcacgttttgctacttgtttgtgaatcttttcgttttttacttttctatcagtataccctgtttgtctgaatttaaaaagagggggcaaaaggagcatggcgaaaacgaatgcaaaaagcactcctttgtttcttaaacaaaaaaggacaaggcagactgcccaatccttttttgttgctgtcaggtagaaaacttaaagtgtgacttcttctgctaataactcagggaacacttcgggatcgaatgcttgcgctttgaacatggaaatttcttttccatatggtgcgtaagctttctttttatctttaccgacatatggggtttctaatattttcgaaatgttgtcaaacattggatcatggacgatcttattcagcgtgtcgaatccgattgttccaaaaccaatattggcgtgccggtctttatgcgaaccttgcggatttttagaatcattgatatggagtactttaagccgatctaacccgataatcttatcaaactcttccattacacctgaaaagtcttctttaatattataaccggcatcattcgtatgacaggtgtcaaaagtaacggataatttttcattcaattttactccatcgatgatttgcgctaattcctcaaatgttcgaccgatttccgtacctttacctgccattgtctccaaagcgatttgtgccgtctgttcttttgtcaaaacttcattcaagccttcaataattctagcaattccggcttctgttcctgcccctacatgagcacctgggtgaagtgtaatttgagtagcgcctaaagcttccgcacgaacaatctcttctctcagaaattggacggcaaaaggaaacatttctggtttgatcgtattccccaaattaatgatataaggggcatgaacgacgatatttgttagaccgttttctgccatgtacgcttttccggcatcaatattcatctcttcgatggcttttcttctagtgttttgaggggcgcctgtatagatcataaaagtcgaagatccataactggctgcttcttctgctgctcctaacagcattttctttccgctcatgctgacgtgtgagcctaataacatggatggattcctccttgaaaggcaattgtttcgaacaattcctatatattggtaagatgatgtacaaagaaaatgattgatttttctttgccctgttctccatagtaactgaaattttctctaaagaaaagcttaagaactcttttataaaaaagatcattttctcacgttttaactcctttaaaaaaagaaattcctgccaaaaacagccttgtctgtttttttgttctattatttgctataattagcgaaataaaaccattagttgaggtgacccttttgccacgcaaaaatactcgaaaaaaacagaatagaagaaaaaaagaaaaatggtttgttcctaagattatttttagagtttttcaatcattgactgtttttattactgttcttcttttgatgttcgcagctctaggtattggaataggcgctggctattttgcctatctcgtcgaagacacacaattgccgactaaaaaagcactgcagacagaactaggaaacattacagaaacgtcaaagattgtttatgcagataatacagagatatcaaaaatccagacagatctgatgcgcacgactatttcatctgataaaatttcacctttattgaaaactgcaattatcagcacagaggatgaatacttcgataaacaccaaggttacgttcctaaagctgttttacgagcgttagtatctgaagctactggtattggctcttctggtggatcaactttgacacagcaattagtcaaacagcagatccttacagatgaaacaacattcaaacgtaaagcaaacgagatcattctttctgcacaagtagaaaaatacttttcaaaagatgagatcattgctacgtatttgaatgtctcaccatttggtcgtaataataagggacaaaacattgctggagtccaggaagctgcaagaggaatctttggtgtagatgcaaaagatgtgacgctgccgcaagctgcttatatcgctggattaccccaaagcccgatcacgtatagtccatacacgaacacaggtgcgctaaaagaagatctttctgccggccttgccagaaaagattttgttttattcagtatgtatcgtgaaggccaaattacgaaagaacaatacgaagaagcaaaagcctatgaccttacaaaagactttctaccacaacaaatcgcagaacagactgacagagaattcttgtattatactgtgatgaatgaagcaacaagaatcattgcacaacaattggctgaaaaagacaacgctgatatgtctgattcatcggtcagtgacgcttattatcaaaaggcacagcaaacaatccaaaataaaggatatacaatccattcgacaatcgataaagatgtctatgctgcattgcaaaatggcgtagaaaattatggatacatgttagatgatggtgctggcagtcaagtagaaaccggaaatgtattgatggataacagaactggccgcatctacggattcgttggcggacggaattacagtcagaatcaaaataaccatgccttcgatacagaacgtcaagctggctcatcaatcaaaccagttcttgtttatggacctgcaatcgacatggggcttatcggatcagaatcccgtgtatcagattatgcaacaacttggcaagaaggagaaaatgctggcgagaaaatcgtcaatgctactaacgaaggatcgaacaccttccaaaccgtccgtgagtcactagaatggtccaacaatatcccggcttatcacttatatcaagatgtgttgaattccggtggatcgaaacaatatgcttacgagcactacttggcaaagatgaactacccggcaaatgacaattggggcgttgaatctgctcctttaggtacagtagatgtcacgacgcttcaacagaccaatggatttcaggctttagcaaacggcggcgtctatgaagaaggctatatcatcgattccatcacagataacgcaggaaatgtaatttataaacacgaaagcaactctgtccggatctattcggaagcaacggcatcgatcatgaatgacatgatgcgcagtgtgatcaatgcaaaaatcactacaccattcaaagatgccatctcaagcttaaacggaaatctaggaaaagcagattgggtcggaaaaactggttctaccaatgaataccgagattcatggctaattgtctctactccgtctattaccatcagtagctgggcagggcacgatgacaatactggaatggacagcaaagcaaggatacgttcggctaattatcttgccaatctgatcaatcaagcttaccaagcaaaacctgacatttttggcactgatgagaaattcgaattatcatctgatgtgatgaagaaaaaagtatctggatttactggtcaaacacctggaaaagttactgtcaataaaaaatccatccaaacacctggaaaaacagttgaatcgctatgggcgaaaaatggaccgaagaaaagcgcctttaaatttggcgttggcggtaccgatgaaaactatacagattactggaacaccgcttcagcttatgcaagagcgaatcaagcaaccaaagaatcagatgagaaagatgattgatttaatagaatacacagtaataagggattgtgacaatagtattgtcacagtcccttatttttttgatggtggtgaacaaaatgcagcatctatacacggattgttttatatacgataaatgtaatttcaaccactttctctcttttttaagacacaaaaaaaggattataacaaaattttgtcataaccccttttcccgaataaacggtgttctcctgccaactccgaatcacgagtcacaatattcatcaaacatgaaatgctgttttttgaaattgctccttgtaacgcagagttaaacggcaggctcacaacctctgaatggttgtccttttattattttgtagatcctttttcttcgattccataaggcaagataatcgttttttcttcgacttcttccttattcatcattttcgtcaataggcgcatagataccgcccctaaatcgtataatggttgtgtgatacttgttaaacgaggacgagctacttctgtcagtagtgaattgttacttgtgatgatttcgaattcttccggtactttcacgccacgatctaataaaccatccaaaataccgatggctaattcatcatctgaaacatagacagctgttgcaccgctattatggatccgatcgactagagatagaccatctttgaagttgtattgtgcttcaaagatcaatccttcgctatatggtaggttattttcgcttaatgcttctttatagcctttcagacgattttgtccattgataggatcgatcaacgcaccactgacaaaagcgatttttttattgccgctttttgccaatttatttactgcatcttttgttgcggatacataatcaatgtttacgctacctacttgttcatctggatcaatagagccagctaatacaacaggagtttttgaacgtgaaaattctccacggatttcgtctgtgatatggtgacccatgaagatcacgccgtccacttgcttagccagtaagttattcaatacattgacttctttttggtcgttgccatctgaatttgctaagataatattgtatttgtacattgttgccacatcatcgataccacgtgctaaagaagcaaagaacatattgctgacatcagggatgattaccccaactgttgttgttttcttacttgccaagccacgcgcaactgcgtttggacgataatccaagcgatcgatgacttccaagactttttttcttgttgctggtttaacgtttggattgccatttacgacacgtgaaacagtagccatcgaaacatttgcctctctcgctacatcatagatagtgattgtttgcttttccatttgtgttctcctattcatattttatatgttttctgaaaatacgtcttacatttctaaaatagaatatcaaataatctcaagaattgcaaccgttttatctctgttttcatgaaaatttttacttttttcagtttttagaacgttggtcttttaataaatcagtggtacaattattgaatacaaaattaatttagaaagtaggttgccaaatgaataacgtaaaaatcaatgaactacgtcaatggatggcacaacaccaagtcgaattggcttatatcagcgaccctggccacatcgcttacttttccggatacgaaagtgatcctcatgagcgtgtactagctctttttatccctcttgaacaagatcctttccttttcactcctgctttggaagttgaagatgctcaaaacagtagttgggcgtatgatgtccgtggctatttagacagcgaaaacccttgggagatcatcggaaaagaacttcgtactcgctatggtcagcctggcaatgtagggattgaaaagaacgccttgactgtcgagcgcttcgatgctatctctgatatcttgacgggaacggattcttacactgatctaacttccatcatccaacgtctacaactgatcaaaactctagaggaaaaagacaaactgatcgaagctggtaaatgggccgatgttgcatttgagattggctttaaagcagtgaaagaaggcgtgactgaacaagcgatcattgcagaaattgaataccaattgaaaaaacaaggtgtttcacaaatgtctttcgacacattagtccttgcaggagcaaatgctgcaagccctcatggtacaccaggaaatacgaagatttcaccgaatgaacttgtgttattcgatcttggcgttgtttggaatggctattgcagtgatgctactcgtacaattgcttatcaaaaaccaaccgacttccaagaaaaaatctacaacatcactcttgaagcacagcttgccgcacaagaagccgtccgtccaggtgtgacagcaggtgaacttgatcaaatcgcacgaaacgtgatcaacagctatggctacggcgaatatttcaatcaccgtttaggtcacgggatcggaacaaccgtccacgaattcccttcccttgtagaaggaaatgacttagtaatcgaagaagggatgtgcttctctcttgaaccaggaatctatattcctgaaaaagtaggggtacgtatcgaagactgtgtatatgtgacaagcgatggctgtgtgccattcacgactacaccaaaagaattacttgttttagaaaaataagagtaaaaaaggtgagagctagtccgctcccacctttttattctataaatttgtgattttagtgatttgtagatgaatctgtcattgtatcttttatttcttttttagcttctttcgcatcttcttttgccattttcatcatttcttttgagtcatctgcaactggttttgcttctgacattccttcattgacagtatctcctgctttaccagcagcgtcttttacatcaatcatgatatcttctgaagtatctttagcaatacttcctaattcatctgcaggttttttcatatcttctgccgtttttttgaaacgattagataagtcagctgattgttctttaagatttaacaagatatcgtcagattcacttcctgcttcatctgctgattcacttactttttgtttgacactacctgctagatcacctgcttgttgagaaagatcttgcgctttttcttttgcaatacctgttaactcagtcgatttttctttcgccatatctgtgtaatctgaagccatatccatcaaatcatccgcttgggcagctaattcatcccgaagttctttaccagattttggtgctaacaataacgcggcgattgctgcggctgtgcctccgactactgcacctaataaaaatccaccttttttagccatttttattttcctcctgtcgtttcagtatgttttttgtttttaaaaaatttcatcgctgtcccaccgacttttccggcaaccgtcgctttagctgtcgttttaccgattccgccgactttcgtcgcgatgtttttactagaatgattaagttctgatacactttcacttaaatcagcaactgctgtgaacaatggatcgatcgttgcgacttttccattgatatccaagagcagttcattacttttgaccagtaagccttctacttgtctagacaaaagatctacgtcttttgtgacgatttcgatcgtcgtatttgcttctgctacagtctgatctactttttctaaagttttagaaacttgcaacaacacacgaacgataaaaacgacaagtatcgcaaaggcgattgctgcgatcaatcctgcaatttctcctcctgacatgatcaaactcccttcttgtctctcttttctataaggatagcattttcgtgttttttaaacaaataaaaacgagcttcaactactttttattcaattagcagctgaagctcgttagaaaaaagggttattttttcttttcttctttgatttctgttattccttttggattatgatcgatcttgcttccttctgcttctaatgttttacctaaagacaggatgtactcacgtaaaggtgcacctacttctggatgtgttagaccatattcaatacttgttttcataaaaccaaatttgtcaccgacatcgtaacgtttacctgtgaatttacgggcaaatacgcgttgtgttttattcaatgtatcgattgcgtcagttagttggatttcatttccggctcctggttgttgctcggacaatacatcaaaaatttctggagtcaataagtaacgtccaataatagctaaatcacttggtgctttgcttggatctggtttttcaacaaagtttttgacattgtataacccatcttccaatacttctcctggattgataattccgtattttgaagtttcatcatgaggaacttgcataacggcgatcgtagaagcatgagtacgttcgtaatcatcgattaattgctgtgtcaatggtacttcgtcttccattatatcatcgcctagcataacgacaaatggttcatttccaataaaggctcttgcttgaagaacggcatgtcctaaaccctttggatgagattgacggatgaaatgcaagttgacatctgtcgtttcttctactaatttcaataattcggtctttcctttttcacttaggtttgtttctaattcaatatttgaatcaaagtgatcttcgattggtcgtttagcttttcctgtaacgatcaagatgtcttcgatacctgatttcaacgcttcttcaacgatgaactggattgttggtttatcaacaattggcaacatttcctttgccatagcttttgttgctggtaaaaatcttgttcctaatcctgctgctggaataactgcttttttaactttcatatacattcgctccttcaaaaaattgttaatgagaattcattttctttttttccatcacgtaacatgatttcttttgcggctgttttgatttctttttgttcatacagcacttcatagattgtttgagtgatgggcatttcgatttccatcatttgggctagttccatcgctgcttgggtagtattcacaccttcaacgaccattcccatattggctagcacctcttctaggggctgcccttgtcctaacaagttgcctgcgcgccagttcctagaatgaacacttgtgcaagtaacgactagatcgcctactccgcttaatccgataaaggtcagcgggttggcacccattgctacacctaaacggctgatctcagctaatccgcgcgtcatgattgctgcctttgcattatcgccaaaccctaagccgtgaatagcgccagcaccaatagcaataatatttttcaaagctgcccccatctctacaccgatcacatcaggattggtatagatccgaaaataattattcatgaacagctcttgtacatattttgctgcttttgcatctgtacttgcagctgtgatcgtagtgatgtcatgttttgctacttcttctgcatggcttggtccagaaagaacaacaacagcttttcttttttctgctgggatttcctctaacaagatgtcagagatccttttatgtgttccctgttctaatcctttacttgcatggatgatcactggctttgtattcaatttaggcactagttcttttgcaacagaacgtattgctttcgttggaatgacgaatagcaccgcatctgcgtcttttactgcatcttccatattggtgaatgcttggatggaatcgggtagataatgatctggtaaataacgttgattcgtgtgttgggtgttgatttcttctacttgtgaagcacgatgtccccaaatccgaacgtcatgtccgttttcggcgaggacttgtgccaaagcagtaccccaagagcctggtcctaaaaccgctactctataattcattttaccactcctgaaatttttttcatttttaacgctctaaaaatcagataatttgttgattttttcctaatgagcggtcataatccggtaaatttcctttttttctgcgccaaataaatagaatcaatgtaccgacaaataacacagcagataataattgagaaatacggatcacacctaaaaagtaaagactgtctgtacgtaatccttcaataaagaaacgcccgaaactataccacattagataacataaaaggacttcgccttttttcaaaaggtgtggtttctttcgtaaaaacaaaagcaaaataaatccaatcaaactccaaagtgattcataaagaaatgttggttgacgatagatcccttcgatatacatattatcaatgatgaattgcggtaaatgcagactttctaagaagcttcgcgtcgtgtctggtccatatgcttcgtggttcatgaaatttccccaacgaccgattgcctgtgctaataatacacttggtgcagcgatatctaaaaaagtccacaaagaaataaaatgatatttagtaaaaaaatacagcgtgatcgcgcctgcaatcagtccgccataaatagctaagcctcctgaacggatattgaatatttggattggatcagctatatactggggaagatcaaataaaacataatataagcgagcgccaataatggagataggcaatccccacaacataaaatctgtcacatcatctgcttttaatcctacccgaacagcctctctgctgctaagccacatagcgataatgatacctgatacgatgatcaatgcataccagtagataggaatccctacaagctcaaaagcaactcgattgatttgtgctaacatattgtcactccttgctagtcgttgcctgagttttcttcaatcaagcgacttaatctttcttcaaatgttttcgttgcgtcaaagcccattgtacgtgcacggaaattcatcgcggctacttcaatgatgattgcaacgtttcgtcctgttttgacagggatttttatttgtggaatgcccacttccgcgatttcaacggtcgtgtcttcagagcccagacggtcgtatttcttatcttttgcccatgcttccagataaacagccaactggacttgcatagagccacgtaccgcactcgcaccaaaaagattcattacatcaatgatcccgattcctcggatttcaatcagatgttccaggattttaggcggttctccgatcaccgttaattcatcttgctgataaacatctactcgatcgtctgcgatcaatcgatggccgcgtttgatcaactccaacgctgtttcactttttcctatcccactgtcaccttgaatcagtacacctaatccgtaaacatccactaaaacaccgtggacacttgttcgaggggcaaggcgaccatctaaataactggataattctcctaataaacgagaagttgagatgggagaacgcagtacagctatcccattttcatttgctgcctggatcatttcttctggagctggtaatcctcttgaaataataaatgcgggcatatcttcactacataatcttctcatgatgatcaaacgctcttctgggatcatccgttccgcaaaactgatttctttactgccaaatagctgtaaacgattatgggaataataattaaaataaccagtcaactctagtcctgggcgtgagatgtccccagttacgatgacacggtctaagcttttctcgtcgcctgtcacgatttccaaagataattttttcactaattggctaacttttacaacttctgacattcatgctacctcatttctattagagtgttctctatcattttatcattgtctagccaaaagtactaccaattaaaaaaaacgtttttatttaattaccaatgtaatagaaaacgcattcctgattctaaataaaaaaactgcgccgatagttcggcacagctttcttttattttctactgttatgttcgctgacaattacattgacaagcgacatcaagatagctactaacaacgctgcaccgaatgaagaaaaactaaaatgttctgctcccacaaaaaaggaggtcattttaagaatcgctgcattgataacaaacgtaaacaatcccaatgtgactaatgtaaagggcagggacagtatcgtcaaaatcggtttgacaaacatattcaacacagacaatacgaagctggcaagaacggccgtccaaatactgctcacatggaccatcgcaggaaaaagaacagccaatgatatgaatgttaacgtattaactaaaatacgttgaaagtacgacattaaaagtcactccattcgtcatcatcgattttttccgcttctttgcgtttttttgtttgttcacgagtttgttcacgataattgtttttttcataatatgcattgttatgtccatagtttgttcgtgcagaacgcgcagatgggataatcaaagctaataaaatgtataaaataattggacttccaaaagcaactaagctcaggaatacataaagcacacggataacagtcggatcaatcccgatgtattctcctattcctgctaaagtccctgtcaaaacaacatttttattagattttgtcaacttttttttcatcatgtctcacctctgttctactattttaaatgaagaaaatcgttgtgacaaccttcttcttaatcggtgtctttctgcaaaattctcggtcacaaattaccatattcataaaacgtgacgagctttttctgaaattattccttgtgactcggcgataattggcaggttcataatctcttggtaaacggtgttcaagagatagactatcggcaataaggcacaattttgtaaaataggggaagctattttacaaaatcgcttcttattgctcaaggctgaacatctctttcacaacctctttatttatctgtatcttttaaatagatacttcctgttgtcgttgaaagttgcacttgcgcgatttcaccatctgaaacacgacggaattgcaacatttggtttgtccgttcttttttctcacgaactacttcgtaattggacagacggctgttgatacttccaagacttgttttagcatgtccttccaaaccgatgccatctggtaaagcgactttgacatttccgttcactgaacttgcttctacttttttcaaattatcttctttaatcgtaagacgtacatcaccatttaccaaagacacagaaaggttttctgctgtcgcaccaaatgtcactgtaccatttactgtttcgataatagaatctaagatgttcccgtttcgaatatcgatattgccgtttacaccttctacttccagcatcgttgcagttaattggtccacgatgatgttaccattcgtagattttgtataaatatctttagcttccaatgtttcaatcatgatgttgccatttagaagtttaatagctgcgtggtcgtatactcgtttaggtaagtagaaaacaaggtctgcacgcacacgtttatttggaatttggaaggagatatgatcttcattaacctcaatctggctccgttcagagaatgcttcaaatggttcagcacccatttttccgtaaagtttgatcttagcttcaactttcacatcgttgctgtcccacgtttttaacgtcacgtttccgtttgctgccttgatatcaaggatacttgctgcaggagcttcatagtaaaattcatgctcaaatttcgttgtcgcaatcccagggacacgtaagctgacatctttccattccatgttgtcattcactgtttctgaaacagtttggaatgttttcttcaagaatttgcctaactgtgatccagcttctgacattttttcgcctacttgattcagtgtatctgttgcttgatctttccaatcatctggcaattcaaacttatcagtaaacgtttcttttttctcagaccattgattcttacggatatcttttaattctgcttctaatttcaattgttcttctaacagtgtatcgccactagcttctaattctttgatttctgcttctaacgtctgacgctgtgctaattcttcttctgtcaactcgcctaattcttcttttgtattcagctgcatcaatgcttcctgtttctcattgcgtgctgccttattgtcagcgaattgagcatttacttcatctagacgcgccgaagttttattcgcttcagttgctagttcatctaagatcttttctaagttttcttgatcttgtctttctctttcctttggatcaactggctcagaaatttcttcttcgccgttttcaagtttatcgatcaattgacttgcctgatctttttctttatgactagcagttaccttgtctgcttcttttttgatttgcttttcgtctttttcagttgccatgctttctaataaatctaagccttcttcagtcgaaaggattccttttttcactaaatctaaaatacgttctctttctttcatggaaattgcctccttaagcaaaattgtttgcaagcttttccttacatccatattatgcactgattcagtaaaaatgtcataggacttaagttgtaacttttactccatcttgagttgttctttcttttttgtaaagagatatgctgtagtcacgcaggttaaaggaagaacaagtagtgcggacaatgtggtaagaatagccatcgtatattctagaacaaatgatttttcattgatcacttgctgaaaaggaatgtctaaatcaataaaccagaggatcaacgctaaagaacttcccatgaatgcaaaaagaagtgtcattactgttgacgccaatatttttttagcaatagcgaaactagaatggcgcaattggtaaaaagataattgcggatttgcctgatatacttcgaatgtcccactagaaattgctacactcgcatctaaaacagcaccactaagactaatcagaagcaacgatctcgtaagtaatctaaaatcaatcgctaaagtcttatctaagccagataattcttctagttctaccgatgtaaaaccttggattgctaaaaaatcagtgataggaagcaatagtaggaaacaaaataaaaagatcagtatactcacaaaagctgcacgcatttttagattataaccgttgataaaaaataagataaccacagcaatcaataaaaatcctatgaccgacaatgccagtatcggccacttctgatgataaccgaataacaacaggaaaaagatccctaaattgatgaataagcctaaaagaatatacataccttgcgtaccgccaataagtagcacgctgattgctaaaatcccaacaagtataataagtacattcatcgtttcagcctccttacagtcagaaaaaagaggaccgagatagggatcgataatactattcctaagctgccagcaatgacgcgtaaaaattccaatgataaatgctgttctatcgtttctttgaacgaccattgatttcctaaatataaaagaagcgatggaactgacccactgatatagacgaacaaaaggatattggtcatcgagccaatcacatctcgacccacttgccttcctgaaagccataactgtttcgctgttatttctggttgtcgcttagtcaattcttctaatgtcgcaatgactgtgataacggtatcgagtgttcctccagctgttccaatcagtacgctagaaagaaaaacagaacgatacggtcgtgtcagataattcagttcctcatagcgcagtccttggtctttccaatgattcattgtcaaaagacaaataaaaaatgctaaaaaaacactcgtaactgcagctgaaattttgattatactgcttctattccatccatctaaagccaatatgctaataatcatccctataacgacgaacaggatagatatatttaatagagaaatcccttctgttttagtaaagatgagcaacaaaagtaaaagtaaaacgatattgatgatgagacttcctaaagcaaatagaccctgttttccaccaataagcaacatggcgccaatgaagatacttgtgaagaagaaaagccagccatcatttttttttgctactagctgccattcatctccatgcatttggactagatacatttgtctcgcttttatatttgctgtttctatttgatttttttgataaggaaccgataaataaatcgattctcctttttgatccgtgttcatcagttttcctgtaatcaattgatgatcctcttttattcgtactttttctatctcgatgacaggtacttcatataaagcggcttgatgctgaataacccatgaagtaagcacacaaataaaaaatatagtgatgatgctaatttttttttgcattctttatcctttctatgaaatgatgaaaagggtttgtgacatgttttgtcacaaaccctttcccgaataaacggtgttcaaaagcttgcatctgcggtaataagtccagccaaacgaaaaatatgaggagctattttttgtttgactgttcttattacttgatgcagaacagctttttcacaaccgctgatttcacaacctcttttcctaaacaaacggcataatcacagcttcagtttagaaaatctcattgtggttcgtatttaactcagtgattttccctgtagccaagtagacgatccattcacagatgtttgtcacatagtctccgatccgttctagataactggcaacattcaagtagtctgttccactgatgactgtctcaggattttcctgcatatttttgattgttgcattatagattcgattgaaatagtcattgactctttgatccatattggcgatcgtacgtgcgtctttttcgtctgttttgacataagcaactaggacgttgtccaccatttttttcacataatcggacatatcggagatctctttttcgatttccggtattctcgtctgcccttttacgcgaatcgtggatttagcaacagacaccgcatgatcggccatacgttctaaatccgagctagctttcatgaccgtaatgatcatacgcaaatcagttgtaactggctgttgcaatgcgatcatttcaaaacttttcttctccaagcgtgtttccatgttattgatatttatatcgttttcgataacttcttgggctaagattttatcgtgtttgatgtatgcacgaactgacttgtgcacggcgctgctcaccatcatccccatttcgtagaactgattatggagattcagcaattcttcttcaaattgtgtacgtagcattccgtttcctccttatccaaatcgacctgaaatataatcttctgtctcttgtttttctggattcatgaatatcttcttcgtatcattgtattcgatcaagtgaccatctaaaaagaatgccgtcttatctgaaatacgtgaagcttgagacatattatgggtcacgatgatcatcgtataccgctctcttaattctaacagcatactttcgattttcccagtagaaacaggatcaagcgcacttgttggttcatccaataagatgatttccggattaactgccaaaacacgtgcgatacatacacgctgctgctgcccaccggataaagataaagcacttttatgcaatttgtctttcacatcatcccaaacagacgctgccttcaggctttcttcaactacttgatcaaggacttttttatctttttccccttttaatttcaatccatagatgacattttcatagatagaaaaaggaaatgggtttggctgctggaataccatgccgatttcttttcttagttcaacaacatctgtttttggaccatagatgtctttgtctttatataaaacacttccggtgatcgttacattcggaatcaggtcattcatccggttcaaagaacgcagataagtggattttccgcaaccagaaggaccgatcatcgcagtgatttccccttgattgaagcttagatcgatcccttttagtgcttctttctttccataatacagatgaagatctttagatgaaataatctcttttgtcatgttgaggcctccgtcttaaccaaaatgaccggacacataatcttcggttgcctgaatttttggtctggtaaatatcttgttagttttgtcatattccattacttttcctaaatagaaaaaggcagtatagtcgctgatacgagctgcttgttgcatgttatgcgtcacgatgatgatcgtatagtcttctttcaagtttacaagtgtttcttcaaccgttcctgtcgaaatagggtccaaagcacttgccggctcgtctagcagcaagatatcaggtttcatcgcgatcgcacgagcaatacataaacgttgctgttgcccgccagataaagccaaggcacttttgtccaagctgtcttttacttggtcccacaaggcagcttgtttcaagcttgtttcaacgatttcatctaatttctttttgtttttttcgccgtgctgtttcaaagcaaatgtaatattgtcataaatcgacttgctgaacggattaggacgttgaaaaaccatgccaatccgtttgcgcatctcataaacatccacttgaggcgcattaatatctacgccttgatacatgatttttccagtgattttcgtattagcgatcccatcattcattcgattcaacgaacgaagatacgtagattttccgcagccggaaggaccaatcagtgcagtgatcttatttttttcaaattccagatccactcctttgattgcttcattgtcgccataccagacatgtagatcatccgtatatagtgctacttctttctcttttggcatggtgatgacatttgtttcattccagttatattttttcattttgcttcttctccttaggctgaagtcatttttcggtataatcgtttgccaatcgcacgagcgccgaagttgaacagtaaaacagcaataatcaacacggcagaagcgccagccgaaacagaaacaccatcaggcatcgtgccttctgtattgatcttccaaatatggacagctaatgtttcagcttgacggaaaatgctgatcgggcttgaaacacttaatggattccagttcgtaaaatctaacgcaggtgcactttgtccagccgtatagatcaatgcagctgcttcaccaaaaattcttccagaacttaggatcacaccagtcaaaatccctggtgtcgcttctggaaccaccacttttatcactgtttcccagcgtgacaaacctaaggccaatcctgcttctcgttgtgtgtaatggaccgcttgtaaagactcctcaactgttctagtcaaaagaggcaagttgaatacagtcaaagccaatgcaccagaaataatcgagaaaccatactggaattgaataacgaaaaccaagaaaccgaataaaccgacaacgacagaaggcaacgagctcaagatttcaatcgacgtgcgaatcacatctgttagccagttttttccagcatattctgaaagatagatacccgcacctaaagaaataggaaaactgatgatcatcgtgatcaaaagcaaataaatcgagttaaatagctggatcccgattccaccgccttcttggtaggctttggaaggttcggtcaagaaggaccatgaaatgtgcggtattccccgaactaagatataaagtagtaaagctgctaaaatcaatacgatgatccccgaaactatatataaaacacctgtagcaattttatctgagcgttttgcgttcattatttcagctctcctttcttcccaatcatacggatcacgatattaaagaataatgacatcaatagcaagatcagcgctaatgaccataacacattattttcaactgttcccatgattgtatttccgattcccattgttaagatggacgtcaatgtagaagcaggagtagtaagacctgttggcatcaatgctgcattaccgatgaccatttggatagctaaggcttcaccaaacgcacgagccataccaaaaacgactgctgttaaaatcccgggcacggctgctcgtagcacgactttgtagattgtttgccatcttgtggcaccaagcgctaatgaagcttcccgatagtgccgtggcactgtctttaatgcatcaacagtcatcgttgtgacagtcggcaagatcataacgaacaacacaaatgtaccagctaagataccaaacccagtcccgccaaaaatacttctgacaaaaggcacgataactgataaaccgataaaaccataaacgacagaaggaatacctacaagcagctcgatgaccggctgtaagatcttcgttccgtttttaggagagatctccgtcatgaatactgctgcaccaatggcaaatggcgtggcaacgatagcagataaaaaggtcacaataaacgaacctgtgatcataggcaatgcccctaccattggtttcccatttgctccgatttggcttggattccaatctgtaccaaacagaaaatcaaatacattgatcttatcagtaaaaaaggtggccaatcctttactagctacaaaataaaaaatagataatacaaccaacacgatcagcgcgatacataaaaaactgatgaattttccacgctgttccatttttgaacgttttgattttgttaataatacttttttcacatcttccacagatgactcccccttaatcaggtttaacatactcactcagtgtacaaattgaacatcaatttggttttaataacatgtaaaagtttagctaagtttgtaaattttgtgtaaagattactctttaacgatatttccttgccaatcacgttcgactttcatatgagaaacagggatataacctagttctccaacgatgttatcttgtacttcatcagataagatatagtctaaaaattcttttgtcagtttttttggatgatctcttgtgtacatatgctcatatgcccaaatcgtccatttgttcgttgtcacattttcatctgtcggttctacaccgttaacattcaacgtatctacatcatcggaaacataagaaaaagcaacatagctgattgcaccgggtgtgtcggcaacgatctggcgcaccattccgcttgaatcttgttcttgtgcctgaacagctgtttctccgtccaatacccatttttcaaacgtgctacgggttccgcttcctgaagcgcggttcaatataactactggctgatcttttccaccgacttcactccagtttttgatctcgcctgtaaatagttttttcaggttttccatactgatgtcttttacgccaatatccttgttcacaataggagtgatcccaacaactgctactcgatgatcgactaatgctgaggcatcgatccccgatttttcttccgcaaacaaatcagagtttccgatgtcgactgctcctgactgtacttgagacaaaccagttccgcttccgcccccttgtacattgatgaattttccaggattttctgtctggtaagtttcagcaactgtttctactaaaggctgtaaagcagaagagccaacagccgtaatggattctcctcgatcaatccactttgaacagcctgataaaagaatagctaatcctattattggtaagaataatttaagttttttcattagaaatctcctttaatcctaaagtatgtttattttatcattttcattacttgatgaaaacgaatcaaaatcattaaataacaaaataaattctcataattgtaaaaaaaactatctcattaaaagtttctatgctatactggctttgaaatgtgtctcttttaatagcatatattagcttatttcttgctttccccaaaaaacaagagataccccaaagttaatttcgctcatgcgagacgctttctccatttctgacgtactctcagaaatggccccgttagaaaaggacacgagatctccatctgttgatggttctcatgtcctttttatgttttaaaggagcggcgaaatcaatcttgctaatccttctttcatcttgatgattattcctcggttttcatacatttcttttgtgagatgcgtagaaattttcgagtcttcaaaaaaagcttttcttacacgtgaagccattcgttcatcataaaccagtgtattgacctcaaagtccaagcgaaatgaacgaacatcgatatttgctgagccaactgaaacaatgccaccatcgataatcatcgtctttgcatgaataaatccattctcatatgtttcgatccttgctccatactcgattagctctgcagcgaaagaatacgttgcccagtaaacgagaagatgatctggtttgttaggtatttggatatgaacttttacgcctgaaagaagagccaacttcagtgcttcatgaatcgatccatccggtatgtaataaggcgtttggatcaatatctcccgtttggctaacgaaatcattttcaaataagtcattttgatttgttcatgttcggtatctggtccgcttgtcacgatttgaacagctatatcaccagtagagtgaatggacggaaaaaatttgggagaatagcctacttcttttgtatgctgagaattccagtccatcaaaaaacggttttgcaaggtatacaccgcttctccgtaaatacgcaaatgattgtctcgccaataaccaaatttctttaccaatcctagatattcatttccaacattgaacccacctgtatatccgattttcccatcaataactacgattttacgatgattgcgataattgatccgaggattaatatacggaacaaatagaggaaagaaaaatgcgacttctccgcctgcttttttcaaattctgaaaaaagctggaagaaacttgtgtggaaccccatgcatcaagaaggactctgacttttacccctcgtcttgccgcctctgtcaatgcatctcgaacttcttcacctaatgcatcactgcgataaatataatactggaagtggatatggtcttctgcctgcttgatatcttcaatcagcgcatcgaatttttcacgaccatctgtaaataaagtgatttcatttttagtcgtatagagcgtactttcaaataccgtgagcatatagatcaattgtttcacatctacttgtccagtaggcggatgaggataaagccctcgcatcaatgcctgtttgtcttcttcaatttcaaggttcttaccgattttcccttggatcttcaaatcaaagattttctctttggaaatccctcttcctaaaaaaatatataaaataaatcctacaactggaatgaacatcaaaacgagcagccatgcccatgtttgagcagtttcctttctttctcgaaaaacgatgataaaggaaagcaaaatattcataatcaaaaggatcgtaaaaaaattgtcaacgataattttcacggcttcacctcttcttctaccaacttaagaatacccaagttgttttttaaagtaaagggaaaaaagccgcttccttctattctcctagccaataaaaaaagaaagctggaacgaaactgtccaactttctcattttatttatattgtggtattagaatttcaagaaacgtctcatagaaatgatcgagccaagtgaaccaatgatcacaccaatgccgaccattaaaagattgattttccaaacgatattttgtggatgaatcaatgaataatgggaacgtaataatgatggattgatcaattggaaaaaccatgcataaccaaatgtgatgatcaaaatcggaagaatcgcaccgatcagaccgatccagccaccttcaaggaaaaacggccagcgaatatatccattttttgcaccgactaaacgcatgatttgaatttcacgctgtctagacaaaatcgtgatccgaatcgtgttcgaaatgagaaacatcgctacgaacagcagcaatgccgctgcaactaatccccatgtccgaactgcaccagcgatttggaaaatccgatctgaggaagctccaccgtaatcagaacgagaaacattcttcaaatctgctgcttcttctgctacttgttttgtataagaaggatcagtagcacttactacatacacatcatataacgggttattgtcaccttcaaacaatttccaggaatcacccatttcgttttggatttttttcaattcctgttctttgcttgaaaattcaacttttttaacatgatctaagtcattcaattctttttctagctttttcatctcttcgtcttttgtaccgatatctacgaatacagagacatcaacgtttccttctatatcttgagctaatttagttgcgttcatgataactgccatgaatacaccgactaaagtcaatgtgatcgttaccgcactgactgaagcaactgtcatccagccgttacgtttcaaactcttgatactttctaataaatggcggaaaaaggttctaatcatcgtatccatattccccttccgcttgatctcgaataatgcggccgttttcgatagcaattactcggtgccgaatcgtatttacgatcgtactgttatgtgtagccatcacgacagtagttccttgggcattgatccgatctaataatttcatgatttcccatgagttttctggatccagatttcctgtcggttcatccgcgataagtactttaggcgtattcactattgcccgagcaatagagacacgttgctgttccccaccggataattcgctaggaaagactcgaactttgtgtttcaaaccaacaaggtccagcacttccattactcgttttttgatatcccgaggttttctgccgataacttgcatagcgtacgcaacattttcatatactgtttttcttggtaataatttatagtcttggaacaccacgccgatttctctgcgtagataaggaacttcgcggtttttgattgctattagatcatgacctgcgacgttcaaagttccttttgaagctttttcttctcgatacatcaatttgatgaatgtagatttaccggctccagacggaccaaccacatagacaaactctccttgttcgatgacaattgagagattgcggatagcggtcgtaccatttgagtacttcttcattacatccttcatttcaatcatggcgttctctccatatctttttcagtctttagctattatagcatggcaatgtttcaacatgcttgcaaaatcttacaattttatttcaatttaacaatgggttcttattgtagatgcatttttaaatagccgtcaataaataaatcaaggtcaccgtccataactgcttggacatttcctgtctctacgtttgtccgatggtcttttaccatagaatatggatggaaaacataagaacggatctgtgaaccccagccgatttctttttgttctcctcgaagtgcagctgcttcttgttctttcttttccacttctaattgataaagcttagcttttaacatccccatcgcttgctcacggtttttcaattgtgaacgttgtgcctgactagctactactgttcctgtaggcaagtgagtgatccgtacagcagattctgttttattgatgtgctgaccacctgcaccacttgctcggtacgtatcgattttcaaatcatctggattgatttctatatcgatcgtttcatcaagctctggcatcacatctaccgaacaaaaagaagtatgacgtcgtttcgctgagtcaaaaggcgagatacgtacaaggcgatgaacacctttttctgatttcagataaccaaatgcgttgtgtcctttgatcagtagggtcacactcttgattcctgcttcatcacctgcttgataatctagtgtctctacttgatacccatgctgctctgcccagcgtgtatacatacgtaaaagcatactgccccaatcttgggactccgttccgccagcccctggatgcaattcaacgatggcgttgtttcgatcataaggaccatctaacaacatagataattcatatgtcttcattttttcatctagcgcattgatacgtgtttctgcttcttcttgcatggctgcatcaggttcttcctgcaacatctccaccatcaattcgatttcttccagttcttcagcaagagaatggaattgatcataagtttctttatttgcattgttttcactgatcactttttgagcagcttcgctatcatcccaaaaaccaggttcagccatttttgcttctgcttccgcaatgtcttcttccagctggtctaagtcaaagagacctcctgaagcttgtgaccttttcctgcatttctgtcaggagatttcgaatttcggatatttccatgttttttccttctttcactatacttttttcattatatctagtctaacagaatcagcaaataacagaaagaaggtgagacgaattcttaaaaaaagaatttgtctcaccaatcctgctgtcagaaattagtttgcattttttccatgacagttcttatattttttcccgcttccacaaggacaaggatcatttcttccgaccttgttcacatggattggctgttttttcgcgctagtattactattttctttggcatctccgtcttctgagtgagaagctgttccttgagaaacctgttcacgctgtacgttttgacggatctcagctttcataaagattcgagtgacttcatactcgatggcgcctaccatatcttcaaacatcttatagccttctgtttgatattcgactaatggattgttctgtccataagcacgtaagccgattgactgacgtaattgatccattgcatcaatatggtctgtccatttagagtccacaacacgcaagatcacgactttttcaaattccaacagttgctctggaccatttagttgagccgctttggtattaaatacttcttgtgctcgttcgtttagatactctttgatctcctgagctgtttttccttcgatatctgcaagagtaatactatcttcatggacaagagtactgccggcaaaatcgatgatactttccaaattccaattttctttctctaattgtgtatgcgcatctactacacgactgattgtccgtttgaccatgttcattagtggcttggataagcttttttcttccatgattacttcttgtcgctgtttatagattacttcacgttgttcacgcatcacatcatcgtattgtaagacgtttttacgtgtgtcatagttatttccttctacacgtttttgtgcagattctacttgtttcgtcagcatcttgctttggataacagcatcttcctcaccgatcttcatccgatctaagaaagatttgattcgttctgaaccgaatcgtttcatcaaatcatcttccaatgacaagtagaactgtgacataccagggtctccttgacgtcctgcacgtcctcgaagctggttatcgatacgacgagattcatgtcgttctgtcccgataactgctagaccaccaagttctcttaccccaagtcctaacttgatatctgttccccgaccagccatgttggtagcaatcgtcacagcacctttttgaccagcattcatgatgatctctgcttctttaaagtgatttttcgcattcagcacttcatgaggaatacgttcttgattcagcatatctgataataactcagatgtttcaaccgcaacagttccgactaacacaggttgacctttgcggtagcgatctttgatatcttgcacgacagcgtggaacttgctttgtaatgttgggtaaagcaaatctggacgatcatcacggataaccggacgatttgtcggaatctggtatacttggatgttataaatttctctgaattcttcttcttctgttttagctgtaccagtcattcccgcaagtttcttgtacatacggaaatagttctggaaagtgatcgtcgccatggttttcgtttcgtcttcgatctctacgccttctttagcttcgattgcttggtgaagtccatctgaataacggcgtccatccatgatccgaccagtgaactggtcaacaatcagtacttttccgtcttggacaacataatcgatatctaaaagcatgatatagttggctctcaatgcttgatccaagtgatgggtcaatgcagtattttcaatgtcgtataagttatccaaaccgaatgtttcttctgctttttcgatccctgcttcggttaaactgattgtttttgattgtacatcgattttataatcttcttcttctttcaaacgtttcacgaagttgtctgctcttgtatataaagctgtggatttttctgcttgccctgaaatgatcagcggcgttctcgcttcatcaatcaagattgagtcaacttcatcgacaatggcataattcagcggacgttgtaccatttgatggcggtaaacgaccatattgtctctcaagtagtcaaatcctaattcattattcgtactataagtgatatcacaattataagcctcgcgtttttcatccgaagattttgagttgatattcaaccccactgttaatcctaagaaattataaagttcgcccatttccgtcgagtcacgggttgctaaatattcattgacggtaactacgtgtaccccttcgccagtcagagcatttagatatactggcatcgttgcggtcaaggttttaccttcaccagtacgcatttcagggatatttccatcgtgaagcacgattccacccatcaattgtacgtggtgtggatataaccccaatacacgttttgctgcttctcggacgactgcaaaagcttccggaagtaattgatctaatgtttctcctttttggtatctgcccttgaattcagcagtttttgcctgtaattgttcatcagttaatgctgccatttggtcagcgtatgcttcaactttttttgcaatgctatctaaacgttttagttctttcttatcgttttcgataagtgaacgaatcaaattggccatgcgttgtgtaatctccttttccttctgtgtattatccagactatgtagactttacttttcattttatcattagttatagataattgaaatatcttaagcgtattaaagtaagaacttcataatttattcatatttcatctaaaagaggaggaaactcaaaaaaacttgcggcagctgtcagtagctgctgcaagttttcgttgttatttaagtaaggctgatcagtctgtttcaatcagtccgtattttccatctttacggcggtaaacgatacttgtaccatttgttcctgcatcttcaaaaataaagaagttatgtcccagcatgttcatttgtaagactgcttcttcactatccattggtttcaatgaaaggcgtttcgtacgtacgatatctaattcagaatcattttcgttttcgtcctcttcattgaataaagcagtagcatctgcagtattcatgcccgtttcacgggatttacgattaatttttgttttgaatttgcggatttggcgttccaatttgtcaacaaccaaatcgatacttgcgtataaatctggagaagtttcttcggcacgtaatacaagataaggtaatgggatcgttacttccacttttgctgttttttctgtataaacttttaagttcacatgcgccgttgcatcgggtgcgtcactgaaatagcgttctagtttgcctacttttttctcaacgtagtcgcgaatcgcttcagttacttcgatattttcgccgcgtacattatatctaaacataaaaattacccctttcgtctaccacaatcaagaaggagaaggaccactctttccctcttcttaattctattatatcgaactctaggttatttgcaaattaaatcgctatcaaatttccacatctaattcatcttgctaaagaaatggttcggatgattttcggctgtgcgacctgcaaacaatctgctgcgtggaaaagagtctgtcctgttgtatagacatcatcaataatcaatatttttttattttgtatcttagaaaaggtgactgcaagttcaaaaggttgaggcatctccaatctttcctttcgcgtgttttttgcttgagccagcagatgcttctctcttttgagtagcatctgaaaaggaattcttgctgctttcaacatctcgcttacttgattgaatcctctttctgttcgccttttttcagataaaggtattggacaatagatgtatgtcgggtattctttttttatctgcgtccatttatatgcaaaggtgcctgctagtcggatatctcccataaacttgtattgattgagccaggccttcatattttcatcgtacacaaaaaaggcacggtgctgaaaatcataggtcggatatttcttcttccattcttgacagtcactgcagtaaacgggaatagactttactttctttttcgtactctctagattgaaatggattggtttttgacagccagaacagcctcttgtttccaataaatgaaattgtgcgcgacaaactgaacaagtctgaggtaatctgtatttcgaaacaccaataatctcgctgaatgttaaattttggacgatatctttactgcagcaactgcacctcacagcatcttcttcccttcttcattcatttctttgatttcctgacaagcttttcgaatagctgcagttttttcttcatagaaaaagtatacttgactgttcgtataaggccctttacgatcggctcttcctgcgatttgtaccaaagaagatttagtaaaaaccggatgatccgctcctaaaacgataacggatattctttcaaatgtgactccacgttcaaggatcatcgtggttaacagtatgtcatattttgcttctcgcattttctggactttttccgcccgctgattgtctcttgaagaaacatctgtgatctcatatctcggaagagcctcttgaagtgtggctttcaaacgatgcatcatcgtgatacttggacaaaataaaaggatatggttttctttaattaattgatgaatgatccgcaccaaagattttatcttcttcttgttcttgcatttttgtcgccaattattcatgaaaaccaagacgggttcaggaagtaaacgccgatgaaagcgtaaagcaagtttgtggatgtcaaacgtctgcttgatttcctttagtaactttttatcaggtgtggcacttaagtagatgaatcgtccgtctggtttaatcgctgtttgcacagcatgagctaatcctgcatccccgttataaggaaacgcatcgatctcatcgatcactattaaatcaaaggaccgataaaaacggtatagctgatgaatcgtacagataacaaaagaagtaaaggtataagccgttgctgtattcccatggagcaacgtgattttttcttctggaaaaacataacgatagcgtaaaaacaattcattacaaacatcgactcgcggtgtacaaatcgctactcttcctccagcttttaaagtttccactaaaataggataaagcatctctgttttccctgcacctgttacagcccaaataagatgatgtcttttttctgaatggcaaagtattctctttgcgatttccgtttgtttttcagtaagctgtcctgtccaaaaaaagacgacttctcgaggttttgcttcaggctgatcaaacaaatataaatcttgttgagtgtcgcatcgccctaaatatagacaatgtgtacaaaaataaccgtaatctgcaagctgtccatcaatgacggacgtcctcattccacagcgatgacaaagaatccagttgcccaaacgttccactgctgcgatcttctcataatttggtaaatttacctcctcacagtctattgctttaatatctctcgtcagaagccttctaccccaaaaatgattcatattattcgccctaaaaaaatatacgaaaaaacaagcgatctattttttggatcgcttgttcgatagttatactgttctatttattcacctatgagcgtgattgcttgatctaacactttttcgccattcatcataccataatcagccatattgatgacgtctaaaggaatgccttttggttccagacgtttttcaaaatcagctttcataaagcgaacttgaggtcctaataacagtacatctacatctttatttgcaagattgttatctgcgtcagaagcggacacagcgaaaatatccgagtcgattccttttgcttcagcagctttttgcatttttgttactagtaaacttgtgctcataccagccgaacatacaagcatgattgtttttttagccatacttttctctcctttttaaaacaaactacgcaaacgttttcttcgcgtctgttactctattatataaaaagaaagaaatttgtcaacgttttctaaacgcggtttatttaatcaaatagccaactagatttcactaatttattgaacacgacatattctttgtccaaattgatgacaactacttcatagcctgcatttatccagccataggcacctttttcagggtgtttataatcatttgcccaccaatctgtactttcccttgctgttttgggaagtccgttactgggaaacagcagttcgtcaaattgggtaaaggtcaacgttacttgagagccgccattgttcttcaaataatgcgtaattgcatcgtactttttcattcgttcctgcatccccagatccacctgcctttgtctttattatcgcatactacagcaattgcgcaaccgttacagtgttgaaacaacctagaactttatttatactgaataaagaaaatgaaaaaaaagaggtgacaagatgatcgagcgctatcgtacaataaaagaaaatggacaaagtgagattgagatcaaaaaatcacgctttatctgttctcttagacgaatagaatcagaggaccaagcaaaaagtttcattcaagaaataaaaaaagaacattggaaagcgaaccataactgcagcgccttcatcattggagaaaaaaatgaaatccagcgaagcagcgatgatggagaaccaagtggaacggcgggcgtaccgatgttggaagtcctcaaaaaaaatcaactgatcaatgtagctgcagtagtcactcgatattttggaggaacgaaactcggcacaggcggattaatacgagcatacactcatgctgtctctcaagcattgtctgacattggaatcgtagaaggtaccttgcaacaggagatctctgtgatgatcacgtatccgcaactaggaaaattacagaattatcttgaactccaacatttttttataaaagaaatccaatatactgatcaagttagcgtcatctgtgctgtagatgaaaaaagtgctgaccactttaaagaatccatcattgagctgctgaacggacaagtccaatttgaagagggtcctgtttcttatcacgagcaactggtaactgatcatatataaaaacaggtgattctgattctcttttatttctaataaggaatcagggatcacctgttttttatttttccaaataaaactcaaaacgatttcctacgtattgcgtacgcacatactcaaacggcgtaccgtcttcaaaataagaaatctggcgcaaacgaagaactgcatctcctcgttttacctctaaatagtcagcaattttctcagaagccaacacagcagtaatcgtttgattcgctggaccgatctttttcccgcctttttcttctagcgtgcgatacaacgattcagtaatctctgctttgctgtagccatcgatcagcttttgtggcacactggcaacttcaaaacaaatagggacatcatctgcgaaacgaatacgttccattcgcaagatcgtgtcatctttactcaagtttagtttttccatttcacttgagcttggcgaagtcaagaaataagagattgtccgactagacggtactcgattttgcgattccataatttctgtaaaacttgttgcaccagacattttttcttgtactttttctcgcgcaacatatgtacccgaaccgatctttctttctaagattccttcatctgccaagttttgaattgcttgtctcaacgtcatacggctgacattgaatttcactgctaattctctttctgaaggaagacggtctccgactttccatataccttgttcgatttcattttttaattggtcatgaatctgtatatatacaggtaattgattcgacataacgtacacccgtcctttcgtttcttctattataactggtatatacctgattcacaactgaaaaagataaaggtttctatccatcaacagaggatttagacacacatcgttctccctactcctattgtcagaaacaattttttagatatgttcaacctagaaaataacaaaagaccctaaaatcgatgaaaatgccgacttatggatcttttgttattattagcggtttttagccatccatttttttgtatgattcgttgggcgttttgattttacctggaccgcttttccgccttttttcggaatattcacttcaatattgtatttttctgatttgaccaaatcatataacttttcagctgcttcgtctactttttctttccatttcatgtggatccctccaattcttgtagttaacttaactctatcttaaatcagcagaatcttcaaggaacaaggtagcaaagcaaaaaaaagagctctcgaactaacgagagcttacgattgtggtatactggggtagctggattcgaaccaacgcatgagggagtcaaagtcccttgccttaccgcttggctataccccaatgaaatggaggagagtggattcgaaccactgaaccctaaggaacggatttacagtccgtcgcgtttagccacttcgctactcctccgaaaggtttgtatcaacctgacttagttataatacctaattttccagatttttgcaaccctttattgaaagtttttttgatatttttttattcgtgcagattccagtgtcgaatcactgtttctatcgcattttcaagacttttttcttttccaaaatcttcttcaccaaagaaaatttcatattcttttggcccataggctaagatctcaccaatcatttttttccctataaataactgagtgacttcataattcttacctttgatatcttttttcacttcttctatacgcacttcaatatctttatttttttttgacatcattttcacctctcaaatattttatcatactgcagcaaataaaacattccttaggtaaaaatctcctattcatttcattcacttcttttatgcaagctgcaccttctctaaagctcttaattctccccttgacgtacagcgagatagtttgctgctgcacctacaagattagcatcgtttctgtattcacataataaaatctgcggttcgaaatcatgcagatcgaattgttctgtcagcttcttcattcggattttgatctcatcaatgagcccttcttttgcagaaaccccgccgcctaatacgatcacttctggatcaaacgaaaattgaatactgaataatccctttgtaagatacgtataaaaactctcaacttcttcttttgctattgcatctccagtttctgctaattcaaagacatcttttccggtataagcatttttatcgagacctttgcgttcacaataacgccaagccatctgtaccgctgtaccaagtttactgaatgtcttatcgccatctaagaacatcaacccaaattctccaccgtaaagatgtgcccctttattgatttgtcctttcgtgaacaacgccccgccaatcccagttcctgccacaacaaaagcaacatcttgataatcacgggcagcaccttcataaaattcagccattccggcacagttggcgtcattttcaatcgttactggaagttgaaacagagtttccaaatctcggaaaatattaaatccatgaatataaggaatcgcactgattccctcaatcacctgtttctcattattcactactccaggagagctgattccaattccttcgacttcaaaagaaacgagcatttttttataaacttgaaataattgcgctttcatttcttcccaagattcaggcgttgcaaattgtcccttacctttaatctctttgccatcccaacaaccatatttgacagccgatccaccaaaatcaaaaactaatattcccataaaaatattctcctttttgtttgctaaagctattgtaatgtatctatttagcatttgaaagcattttcttgaattgaaattttattagttaaagctatttttaggtaagtgaattgctaaaatcacttgatcccttaattgatctccattttcaaaaatgggctcagagtaatgatggataaaatagtctttgactcgaccaatctccacatagcccattttttgatagagatgtaacgccgcactgctagtactgccggttcgtatgatgatctgagtttgactggaagcgagttgtgaaagcttctgaaaagctgtctcaagtaattttccgccaatcccctttccttgatacgttggggctactgctacattgacgatttcgtattctttttcccttgccacatagatcagtacacctattgttttttctttttctttccatatccagccactccctctggaaacatatacttgaactttttctttatcaggatctgcatctaataacaaggatcatggtaaatctttcttgtttagttcttcgatcattttttgtcccccatataagtagttgcggagttgttactttgacaataaatttcctctttttctttatcgctcagtgctactcgtatttttcacaacctttttataatctggttcttttttatctttcttatttcgcgttaatcggaatgtcaatggtacataatcgataccgcctttgacaaaaggatgacagcgtaagatccgtgcagtccccattaccgtcccttttagcgcaccatgggtttgaattgcttttatcatataattggaacaggttgggtaataacggcagctaggtggaaatgcaggcgaaataaagcgctgatatcctctaactaaataaatcaatatcttcttcatcaattagattccttcttttcttttactaaaaaaagggatcgcgactaacgtcaacgttcccttctgttttcttttatcatgttctgcttcatggctcacttcatgtcgactagaaccactgtgattcttatttatcaatgaaaaaagtctcgaatatgaatccacaaacttggctgaaatactttaaatggattgccgccaccgatgacaccatatccgatcatcgttccggccacaaaaagaaggataagcaataagatcaccactaaaatctttatcaaagttaataagatatatcgttggttactcattcagccacttccttaagcaatcgtttgtgctgttttttcagcagaagtttgatccatgtctacacgttcaacgtctgcacctaattgctgtagtttgatatggaaattataatatccacggtctagataattcaagttacgcacacgtgtgattccatttgctttcaagccagctaaaactaatgctgctgctgcccgcaagtctgttgcatatacttctgcaccttgcaattcatggtttccatccatgattgctacatttccgtcgattttgacatgagcgttcatacggcgcatctcttctaaatgttggaaacgattttcaaacactgtttcagtcactacacttgtaccttctgcaactaattggatagctgtcatttgagcttgcatatctgtagggaaaccaggatgaggcatcgtttttacatctgtaggtaagatatgttttggtccgatgacacggactccgccttcttcttcaatgatttctgcacccatttcgatcaatttagaaatcaatgggcggttatgttcagagatagcatctgcaatcagcacattgccttgtgtcattgcagcagcaaccataaaggtacctgcttcgatacgatcttgtacgattgagtggttgactgcatgtaaatgatctacgccttcaatacgcattgtttcagtaccagctccatagacttgagcgcccattttattcaaaatgtttgctaaatcaacgatttctggttcgcgagctacgttttcaatgatggttgttccttttgcttttacggcagccatcatgatattttgagtagcacctacactagggaaatctaaataaatcgtgttaccgatcaattcatccgcaattgcttcgatatagccgtttttttgaataatttttgctcctaaagcttgaaatccttttaaatgcaaatcgattggtcgtttaccaatcgcacatccaccaggcatagctacttttgcatgtccatttctggcaagtagcggacccatcacaacgattgaagcacgcatttgactaacatactcataaggcgcttcgatttctaattgtcttgaagcgtcgattgttacttgattcttttgttcatcaaaatctacatctacgtttaagtgacgaatcacttgattcatagtgaagacatcagaaagaatcggaacgttgtctaatgtcgtaataccttcttctgctaacaaactagcagctaaaataggcaaaacagcatttttagctccttcaattcttactgttccatttaattgattgccacctcttacgatgatctcttccatgttgttccctccaaaaaattccaatgagcatacacttactcaaaatcttttctattataacatccttgcttttaaaatagtacctttttttaaaatttacaggctaacgaaaagatttcggcataaagcgataacttctaagaaaaaattacttgcagtgtaccctaaaaaaattgaaaaaagtacgattgccattctaatttgcgtattatgcattggtctgaaaaaagtttcaatgcgtaacgaacgtaaagaccagaaggctaagtagataaacgccaaatgactcacgattcgaagcaccgcatcaattccgtatacttgcataatgacgtcctttctaacgattgttttataataactaataaaatgataataccataaaatgtataaaaggaaaaacaagtatacttaaaaatataggaatccccttacattttttaggaaataaatgctaaaaatatgcaaaaaaagggactgagacaaaagtcttgtcgcagtcccttattccaaataaacggtgttcaatcatctgaccctcggtattagctcaaaaaacggcaaaatatgaggaactattttccatttgtttctctaatactcaggacaaaacgctgattttacaacctctgatatacggtgttccagaagtagcttcttcgaaaaataagctgagatttcacaaaaatttgagaagcaattttcgtaaattccttcttatgtcttgaagctgaccacttctgtcataacctctttttactgttcttaaaaacggataaacatccgcatctcattttatgagtgcttagatactttgatacgattgattgctcggtgcaacgcaacagttgctcgtttcaattcgttcgtatcttgttttgcttttgcttcttcgatttggcgttctgcgcgttgttttgcacgttctgcacgagatacatcgatatcacgttcacgttccgcactatcagcaacgattgaaacaacattatcacgaacttccatgattccgccattaacagcgatccaatcgacgtgggtatctgaatctgttcgttttacgcgaacttcatcaatcgtcaatggaacgatgattggtgcatgtttaggcaaaatcccaagctcaccagctgtcgtacgtgcaacgacgatagctgcatggtgatcatagaccaaaccggcaggagttaccacatttactgttaaatattgatccatggggcacccctttctagtagcctagtgttttcgctttttctacgacgtcttcgattcggccaacacttcggaaagcttcttcaggaagatcatcgtatttgccttccaagatttcgcggaatcctttcactgtttcttctacagggacatatgaacctggaagaccagtaaattgttcagccacgttaaagttttgtgacaagaagaattggactctgcgggcacgagaaactaacactttttcttgatcggataattcatccatacctaagatagcaatgatatcttgtaattcacgatatcgttgcaatacgtgttggacttctgttgctactttataatgttcttctcccacgatttcaggtgctaaagcacttgaagaagaagccaatggatctaccgctggataaatcccttgttctgttaatttacgttccaagttggttgtcgcatccaaatgggcgaatgctgttgccggcgccgggtcagtgtagtcatcggctggcacatagattgcttggatcgatgtgatcgaaccttttttcgtagatgtgatacgttcttgcaattgacccatttctgttgccaatgttggttgataaccaaccgcagaaggcatccgtcctaacaaggctgatacttcagatccagcttgagtgaaacggaaaatgttgtcgataaacaacagtacatcttgaccttctacatcacggaaatattccgcaatcgtcaaaccagtcaaagcaacacgcatacgtgcacctggtggttcgttcatttgtccgaacaccatggctgttttttcgataactcctgaatctttcatttcataatacaagtcattaccttcacgagtacgttcacctacaccggtaaatacagaaataccaccatgttcttgggcgatattatggatcagttcttggatcagtacggttttaccaacaccggcaccaccgaatagtccgactttcccaccttttaaatatggggcaagcaaatcgataactttgatccctgtttccaaaatttctgtacttgtacttaattcgtcaaaggctggtgcttttttatgaatttcgcttctttccgcatcttctgggaaaggtgtttctaaatcgatcgtatctcctagtacgttgaatacgcgacctaatgtttctttacctacaggaacagagattgctttgcctgtatcaatgacttccattcctctttgtaaaccatctgttgattccatcgcaatggtccggatcactccgtcccctaattctaacgctgcttcaagaacaacttttgatttattttcgtcatttttataaacaactaatgcgttgttgatatctggtaaggattggtctaaagaaaattccacgtcgacaacgggaccgattacttgaacaatcttgcctgaactcatcttttttcctccaatctcaatactattctagtgccgaagctccggcaacaatttcggtaatttcttgggtaatagccccttgtcttgcacggttgtaagaaaccgtcagctcatcaatgatattagcagcattatcagttgctgttttcattgctgtcataccagcagcatgttctgctgttttggcgtcaacgatcgcaccgtagatcaaactttcagcatactgaggcaataactgagacaagatttcttcttttgaaggttcaaaaatatattcttgttcgaaagtagttgcttcttctggatctaagtctgagattggcagcattttttctacacgaaactgactagttagcgaattgatatgatggttataacatacgtataattcatcgaatacttcgttttggtacatagttgttgccatatttacgattttgcggacttcatcaaagcttggctgatcagatagattgcgcagctcatatgctagattgataccgcgtgctttaaagaagtctgcaccagttccgccaattgcgatcatcacgtaatcatcgggtgattggtggtcttcttctaaaatagacatcgtttgtttcaatatcgagctgttatatccaccgactaaaccgccatctgcagtgatgacgatataaccagttttcttaacaggacggctgagcagcatgctgttgtaattgatatcccctctaggattttctgaggcaatatcatttaactgagtagcagtcaaatgcgtaacgatttctcttacttttgttgcataaacctgaaacttctgtgaagaagcttcagattttgtcaacttagaagcagacaccatctgcattgcccgcgtgatttggctcgtttttttcgttgaagcgatacgtgtcttgatttcatttaatgaagcacccattcatctcacctcactatgcattttgaatggatttcagtttatcttctgtagaggaattatttccttttgtagctaagaacatgtctttatattcctgaatcgcactgttcaacgcttcttcttctggaagatcttttgttgtacggattgtttcaaagatatctgaatgattggtatccagatattcgaataattcatgttcgaagtctaaaatactgtctacagggatactatctaagaatccatgtgtcaaagcatacaaaatcactacttgtttttcaacagctagcggtgcatgcaatttttgtttcaagatttctactgtacggcgtccacgatttagttttgcttgtgttgctgcatccaagtcagaaccgaattgtgtaaatgcttctaattcacggtaacttgctaagtctagacgtaaagtcccagcaacttttttcattgctttgatttgcgcagaaccccctacacgagatacagatagtccggcatcaaccgctggacgagtacctgcgtagaacaagtcgctttctaagaagatttgtccatcagtgatcgaaataacgtttgttgggatataagcagagatatctccagcttgtgtttcaacaaatggtaaggcagtcattgaaccgccacctaaatcatcacttaattttgctgcacgttccaataagcgtgagtgtaagtagaaaacatcccctggataagcttcacgacctggtggacggcgaagtagcaaggaaagttcacgataagcaacagcttgttttgaaagatcatcaaaaatgatcaagacatgtttcccgttgtacatgaactcttcacccattgcagtaccagcatatggtgcgatataaagcaacggcgctggttgagacgcaccggcattcacaacgattgtgtaatccattgcgccatattttttcaatgtttcaacttgtgtacgaactgtagaatctttttgtccgattgctacatagatacagatcatatcttgacctttttggttgatgatcgtatcgatcgcaatggaagttttccctgttttacggtcaccgataactaattcacgttggccgcgtccgattggtacaagagcgtcgattgcttttagacctgtttgcattggttcgttaacagatttacgttgcataacgcctggtgccattgcttctactggacgagctttgtcagtaacgatttcacctagtccgtcgattggctgacctagcggattaactacccgtccgatcaaggcctctccaactggaacttccatgatctttcctgttcgttttactttatctccttcacgaatggactcgaaatcgccaaggataatgatacctacatcatttgattctaagttttgcgccattccgtatgagccatttgaaaattcaagcaactcaccactcatcgcgttttctaaaccatgtgcacgagcgatcccgtcacctacataagttacggtaccgatttcttcgactgaaagcacgttttgataattttcaatttgttctttaatcaaggcactaatttcttctgctttgatggccattcgattcacctacctctttgtactatctatttaattgattacgcatattttctaattgcgtgcgaatgcttccgtcgattactcgatggttagcttcaacaatcgcgccaccaataatagaagaatcaacgatttgttttaattcgactgattgatagttcattgtttttgcaacattcttttctaattgtattcgttgttcgtctgaaagtggaactgctgttgtgacacttcccaacagcaaaccttgatgttcatcatatcgacgttcatattcttcgatcatgaacaaaagatcatccattcggttatacgcataaacaacttctaaaaagtttttaacgattccatcatagccactaacaagcttgtccatgatttctcgtttttcatgaggttctagacgaacatcacttaacatattacctaatccaggtacttgttcatagatttgacgtaagcttacgagatcttgatagatttcttctgcttgatttgaatcgatcgccagttcaaataaagctttcccgtaacgtcttcctactgtatatttatctagtttcatttgaagaacctagaccttcgatatattgattgattaatgattcgtgcatttctggagataattctttgttcaagattttttccgcgatttgaagagatagttctgcaacatcgtcttttacagagttcagcgctgaatcacgttctacagtgatatcagcttgggctttactttttagacgagctgcttcttcttgagcatccttcaaaatattttggcggcttaattctccactttctttcgcatttttgatgatatcagctgcatcagaacgagaggctaacaattgttgttcgcgttcttgttccattttcgctgagttgatgcgagattgttctgcagaatccaaatcattggcgatcttgtcttcacgttttttcaaaatatcgctgattggtccccaagcaaaatgcttcaagagagccagtagtatcaaaaatgagccgctgacaacgatgacatttcctaacatcgcattgccaacttctgcaattgccaattgattcagcataggcgagccttcctttctttgaagtacttctagttttcatgtaaaaaagcagtaacaaaccaaattgtttctgccttaatactgattcaattaaacaccaaaaactagaatcaaggcgacaactacccctaagataggaacagcttcgactagagctaccccgataaacattgttgtacggaattgaccagacatttcaggttggcgagccattgattcgattgttttagagataacttgaccgttaccataaccggctccgattgctgctcccatgattgcgattgctgctgcgatataattcataattgttttcctcctaaattagataaatagtagtttgtttttaaaacgaatattattcttccacttcaatcttatggctcatataaaccatagataaagtaacgaagacaaatgcttggatgcttccgataaacaaggagaatgcgatccagaccatctctaatggaattgctaacggcaatgagaaccagcctaagcttattaccatttttgcaatcaaggttagcaaaacttcccccgcataaatattcccataaagacgtaaagcaagtgttaataagtttgtaaattcttcaatcagtttcatcggaaacataaaactatatggtttcaagaacgaatttacgaaatatcctttgaagcctaactttttcaccccaaataagtgagtaagtaagatcattataaatgccaaagttaaagtaacaaacgggtctgctgtcgggcttttccaaagtgttgtttcgttaggtaaaacgatttttgttactaaaccgatgttgtttgcaacaaaaacaaataaaaacaatgtaaatgccaacaaatggaaattgctcaattcttttctaggcagattatctgttacgattcctcgactaaaatcaatgacccattctatcgcattttgtttgcctgttggtttcaacttaagatttcttgtaaaaaagtaagctaagaagaaaacaatcaaacaggtcagtaacaccattatacaaactgtaccatcaaaccaaattggtccaatgtggaacgttagcgagcgttcatccaatccatttcacctcttttccccgaaattcacataaaatcaattcatgtgcgtatctggttttttccaatcggtttctaaccacacggtatcataccaccatgaaacagaaaattcaaaacattttcatgaaaattagacacttttttatttcagtcaaaaacgaagcgaatttttctttatacacggtgctcctgatctaagaaaaaacctatgataatcatgttttatcagattaaatgctaacaaattttatcattaagtaaaagcaaaagcaccgaatatgcgaaaaaggataatgaaattatctagagaaattttttaatgttcgatcaatttgtcgatcgatatcttttcgtttcaaatcttcccgtttatcatacgattttttcccttttgccagaccaatcaataccttggcatagccgttacgaatatagacttttaaaggaacaacagtgatcccagtatttttcaattcattttcaagacggatgatttgttttttgtgtaataataactttctcgttcgcaacggatcatgattaaaaatatttccttgttcataaggactgatatgaacattatgcaagaaagcttctccgttgcggacgcgaataaatccatcttttagattgatccggctgtttcgtatcgacttgatctcggttccttgcaagaccatccctgcttccatcgtgtcgatgatcgaataatcatggcgagctttcttgttttgtgcaattaattttccctcgccttttggcatagctgtttcctccaactcattttattttttctttttcttctttttaacacctttgtaaaatcgcttcttcccttttttcttaccgaacgtttgcttactatcgctatatcgtttgttcttcttgccatttctttctgggcgttttcctgcttgttttccttcgcgttttcctgattttccatttcgtgtttttggccgttccaacgctgtaacctcttctgcggaaacaagttcaaaatctactgctcgttcatctggatcagctttgactacttttactcgcactttctgtccgattttaaaagtcagaccagttctttcacctacaagagctaaatgattttcaacaaaatggaagtagtcctgtttcaattcattgatatggatcaatccctctactgtattcggcagttcgataaacaggccgaatttcacaacagagctgatgatcccatcgaattcttctcccactttgtccatcatgaattctgctttcttcatggaatctacttcacgttctgtttctactgcacgacgttccatcttagaactatgatctgcaatttcaggaagttccgcagcccacgaactttgattgctttcacttttatcttcactgtaagaacggatcagacgatggacgattagatcgggatagcgtcgaataggagatgtaaagtgtgtgtagtaatctgccgctaagccataatgcccaaaattgtcttctgaatagcgtgcttgttgcatgcttcttagcaacatagtattgataactgcagcttctggtttgtcttctactccttcgatcacatgctgtaaatcttttggtgtgatcgttcctttcgttcctcggaccagaatgcccaaagctgaagcaaaatcaaagaagcgctgcattttttcttcttttggctgttcatggattcggtaaataaacggccgatttaatttattataatgttcagctaccgtttcattggccgcaagcataaaagattcgatcaagcgttcaccaattcctctgcttcttagctggatgtcatttgggtgtccttcagcatcaacaaggattttcgcttcgcgatcctcaaaagaaatcgcgccacgtttgattcgcatcgtttcaaggattcgatgcaattcacccatttcttggaacataggtacgagctgagcatagcgttgcatcgtttcttcgtcttgatcttctaagatttgattgacagctgtgtaggtcatccgttctgttgtttggatcacacttgggaaaatatcatgagagactacttgtccatttggatcaatctccatttcgcaactcatggtcagccttggaacatggggattcagtgaacagataccattcgataaacgttgcgggatcatcggaatcactcgatcagtcaaatatacacttgtccctctttcatatgcttctctgtccaattgactgccttgtgtcacatagtaagaaacatctgcaatgtgtactccaagaaaataattaccgttatctaattttttaaccgtaactgcatcatctagatcttttgcatcttctccatcaatcgtaacaatgagctgatttcttaaatctctacgtccaatcatatccttttcgctgatttgatctggaacttcatctgcttcagacaatacatcatcaggaaatttcgtagggataccattagccacgacaattgagaggatatccatgccagggtcattcttatgaccaatcacttgcttgattatcccttctaaactagtcgcataccctttttcagggtaatgggtcagttcgatcagcacaatacttccgtcaactggacgaactccctctgctgctgcatatactttaaattggttgagctttctatctttcgggataacaacgccgtaaagatccgtttcttgtatttcttcttctgaataagcaacgaattcccctgctaactgagtagtggcccggtctcgaatctcgactactttaccctctgctccgcgatccatatctgtatttgctcgcttcatgatatcgattgctacggtgtctccatccattgcaaaaccagtcgcttcttttgggatatagatgtcatcttcttcgggatcaatcgttacaaatccaaatcctcgttcatttgctcgaaatgttccttcgatcaagattggttttaaaggaagtttcacttttccttttttattgaaaactatactctgttctctttccatttgagcaatcgtttgtactagtaatttaaaatcatcgcttttttggaaccctaaaccttcagcgatttcttccatagaaaaactgcgtttgcgactgctttccatgaaaaagagaattttctcttttatcgtttcttttgtcatatttattcctcattccaaggtaatttttctaaaaattccaagacgtctttttctaattcgcgtcttgctgtaccaactgtaatcacatgaccactttcaggataccattgaagtgtcactcgctgacggctcaacttgcgtgcagtttcaaatacgccattagggtcgatcatttcatctttcccagcttgagctaaaaatatcggctgttggatatctgacaacctactttctacgattgctgcctgatcttgtatatccattaattgttgttcagctaacgagcggtaagcaactgctttttcattgatttctttctctgatttacctgctgtcttcagcacttgacgtacgtatttttcaaagttttcaggcacgtttgtttttacaggagacaaaggcgaacagaaaaaaccgccgccaatcactgattcttcttctagtgctcgtacagcaaagatgccgcccattgataatcctaatacggcaatatcagaaaactgctcagactgtaaaaaatggatggcttttttagtgtctgcccaccagctttctgctttttcttgcaagatatcatatggctccattgttccgtgtcctttaaaaagcggcgcataaactgtataatctgctttttccaaaaatcgtgcgagcattcgaacatcgtttggacttcctgagtaagcgtgaagcagcaaaaccgctcgctttccatgttttgcataaaggggttttggtaattgtctcactcgtctcacctctttcgcctcattttaccatagtttctttcataacttcttcttaagcgttctctttgcaataaaaaaagccgcccgccgttttgcgagaggcttattcaactacttcgaagataaatatgctaggacaaataataagatcatccagatagctcccataactgcagttgatcgctgcatgacagcttcaaagccgcgagctttttgtttgccgaatagttgatccgcaccgccggtaaatgcactcgctgcactattttgcttgcttggctgcatcataatcgcaatgaccataacaatcgataaaacgatcacgattcccaaaattaaattatacatatcgcagcctccttcccaaaagatatcgtctctttaactttatcatagataaaagtccgtgacaactctatataaatggaataacagctgaaagttcaaaactttcagctgttattcttatgactgacgtaagacgtcttgatattctggtttcttttcaaactctttttttgcataagggcataaaggaatgatctttttcccgtctcgtcttgctaattctactccagtatacactagcttttcagctaacttttgaccacgatatgctggatctacaaatgtatggtcaatgatcatgatgtctgggcccgcatctgaccatgtcatttctccgatctcttgttgttcatcattgaataaagcaagacgatttttttcttctttgatttccatatgccgcactcctcaaataactgatatttttttattcctaccttattttagcagtctcctgatctataaacaattatttatcctcgaattacttacaaaaaagaagagaaaattaatccatcgttattctttgttcaataaatgaaaaaatcactgtccaataggttttcggatctttcatcgatgcttccaagtgttctgcttctggaacaagcagcagtgctttatcccctgccgtagcattttgaatcgtatacgctgcttctgtagggacaaaatgatctctttcaccatgaatgaccaataaaggcagatggttgctgccaagctgtctcgtagctgatgcttgctttaaggagtaaccggcgtatttctgggcataatgattcgcatatctcatgaccatttttttaggaaagacagtgattttacttaacatatatcggaattctgcataaacagaaacatatccgctgtctaaaataaatcctttgaccgctgatggaagtttttcaccacttgccatcatgatcgtagaagctcccattgatccgccgtgtaaaataatggacgcattcggctgttcatctaagatgagttggatccaggcaattaaatctagccgatctagccatcccattccgatgatttctccttcactttctccgtgcgcacgtaaatcaggtacaagaacgttgaatcctttctctgcatatcttttacctatatgagacatgtctcttttccctgtgcttcggtaatcatgtacgcaaatgacccatttattctgcttatttggatggatgaacatctgaccagctagtttcaacccgtcataacttttgattgttttgggtgttccctgctcccaaaagctttcacactcttcttctaatttttgtcgttttttttctactgacgtgactgcagcagggttcatcaaacgatgaccagtgtcttcataccagtcatatcctctctgtactcccgctcttactaatttctttgcataaaaataagaaagaaaatggtaactgatccctataattatcagaataagaatgaaataaaaaataaccattgtacacccgccgctttctgccaaactataatctatctattatccaatgtaccgatccataggattctttattttcggcacacgtaaattccatttctttttcattgtatcatttacttaaagttctcctcaatagatttacttgtaagagagcatttacattcgcaataaaagccagtatactaatttcgtgcattataatcaagacgctcgtcttggactggttcggaaacttcccagaataaaaaactaagtatctctaaagaaaggagattggaaataatgcgaaaagtaattattgattgcgatccagggatcgacgacactttagctttatcattagctgtcaaatcccctgatatcgaagtagttgctattaccgtagtttgtgggaatgtccctgcagatataggtacgcagaatgtgctgaaatgcctggaacgctgtgatcgtttagacattcctgtttatcaaggaatggaaaaacctttgaagcaacctttcatcagtgcacaagacactcatggtatggatggtttaggggaaacaaatttcccgatgatcttgagaaaacaggcagaacctctccatgccgttgattttttggctgattatttcaaagaaaagacaaatacatcagtcattgctttgggtcctttgaccaatatcgcttctgctttgaaagtcaacccaaatattgggaaacatatggaacgttttgtctcgatgggtggaacttacaaaagccatggtaactgttcgccagttgctgaatacaattactggtgtgatcctgaagcagcttcttatgtattcgagaatctcaaacaaacgatagaaatggttgggttagatgtgacaagagaaatcgtcttgacaccgactatcctcgaatactgctgtcaaatgaatcctgaagagggagagtatctaaaagcgatcactcgtttttattttgacttccactggaaacaagaaagaattttaggatgtgtcatcaatgatccgttagctgttgcttattttatcgagggggccatctgtgaaggtttcaaaagcttcactgctgtggaaactcaaggaataagtcgtggacaaacattggttgatcgttatgaattttggcagaaacctgctaacagtaaaattatgacaaaagtagatactcgtctttttttccgaaagtttttaaccgttcttttaaatgcacaagaagaaacgattatgaaagatttggaaaggttaaagatgggctaacaaaatgaataaaaacaaaatggcaactcgcgtacttacagtgatggctttgtgtattgggatcaattatattgggggaacgattgctttatggcttcgtttgccaatctatctcgattctatcggaacgatttttgctggtgcattgcttgggcctgtacctggaatgctgacaggattgtccagcggtattttaagtggagtgactacagatattttttctctgtattattcgccaatccaaattctcacaggcttgcttgctggattgattttgccaagatatctcggcaaagataaaaacagcttgaaactgttattactcgctttgattttgtcggtacctggaacgatcgtttcttcgatcattaccgttcagttatttggcgggatcacctcctcaggatccagtatgatcgttcagctattacatgggttaggtttaagtcagacaacaagtgtgatcttggtacaggcaggtacagactaccttgatcgtttgttatctatcgtcgttgtttcattagtcatcactatgttgccacaacgcttgatatattcaaaaagaaaaataggctgaataaacagagctggattagcaaaataatgctaatctggctctgttttttcatttattaaaaaaatcttacgctaagtaggataaaataattccttgatatttttcgatcatatccaaataattatcgatttcaacatactcatctacttgatgaggcaaagtaacgacaccaggcccaaagacgacaaagtcgaaggaatggttatctttcgtaaattcggctgcatccgttgttgctgccgctccaactaaaggtaatggctggctgaattgttgctgaatgcaatgaatcaaaggagaatctggatctgctttgacaggtattttgttgtaatcgatcatcaattccaaatgatagtctgtctcttgattcaattcattgacgattgattgcagcaatgcaatgattttatcatttgggtattctggaatcgatcgaatgttcccttggagctgcgcatggcttgggatgctgttgacttgattcccgccactgatcaatgtaacattatggattgtttttcctaggacaggattctcgattgtttcagcgaggtgattcatttcagcatttgctttcgtaatgaattcatttaggtgattgattgcattataaccttggtctggcatagagctatgcgcttcttttccgtgcgaggtgactgtatagttgattgatcccatgtgcgtatacatcaaactgtaattggttggctctccgatgatcaaggcatctaagtcatctacatagcctgctttcgtgagctgttccccacctagttcacccacttcttctccgacagtggctaataatttgactgttccgttaaatggttttcctgactctttcagttcgatcatggcaatcaccattgctgccaagccactcttcatatctgtagcaccacgtccgtacaaacggttcccatggatttctgctgcaaagggtgcataggtccaagacgattcatcaccagccgccacgacatccatatgcccagataggcctaacacttttcctgattggcccttttggtaacgagcaatcaaattatctctaccatctctgtaagaaacaatctctcctgttatgtcatgctttgccaaaagcttattcaaataggctgctacttcaccttcgtttccattcactgatttaattcggatgatctcttgtaaaatcgcgattttttcttcttttttcatctaatcctctcccttgccatttctttttattgtatttgagtgtgctcgaattttcaaataggagcaaccaaagtaaaaatgaagaaagagagccactttatgaaaaatatgctgctacttccctcctattttatttatacgagaggacttgctcatagattcctattctactgttctatccttaaaagctcttatatgatgctagttattgttagctttcctttttcaaggatgatcttttcttgtaccattctttgtaaacatcatatacagaagctagttgcaaaaaaactctctacctgctgatatttcagcaagtagagagttcgattacttaactaagtgatcatactcgactatctttcaatagtcgatcatgtatcttcattagaaaagaattatttgttttttaagttgtagaaagatttcaaacctttgtattctgcaacttcaccaagttggtcttcgatacgtagtaattgattgtatttagcaatacggtcagtacgtgatagagaacctgttttgatttgaccagcatttgttgcaacagcgatatcagagattgttgaatcttctgtttcaccagaacggtgagatacaactgctgtgtagccagcttctttagccatttcgatagcttcgaaagtttctgttaatgtaccgatttggttcactttgataaggattgagttagcaattcctttttcgataccttcagataatttttgagtgtttgttacgaacaagtcgtcaccaactaattgaactttgtcgcctaatacgtcagttaatttcttgaatccgtcccagtcgttttcgtctaatccgtcttcgattgagatgattggatatttagaaactaattcttcgtagaatttgatcatttcgtcagttgttttttcgccttcgcctgagtcagctagtacgtaaacgcctttttctttgtcgtagaactctgaagaagcagcatccatagcaagaacaacgtctttaccaggtacatagccagctttttcgattgcttcgatgattacttcgaaaccttcttcatttgaaccaaggtttggagcaaatccaccttcgtcaccaacagaagttgctaatccgcgagctttcaagattgaagctaatgcgtggaatacttcagcacccatacgtagagcttctttgaatgttggagcgccaacaggcatgatcatgaattcttggaagtcgattgagttatcagcatgtgatccgccgttgatgatgttcatcattggtgttggcaatactttcgtgttgaatccgcctaggtagtggtataaaggtacttctaggtagtcagcagctgcacgtgcaacagcgatagaaacacctaaaatagcgttcgcacctaatttacctttgttaggagttccgtctaaagcgatcatagctttgtcgatagccatttggtcacgaacatcgtagccaatgattgcttcagcaatgatgttgtttacgttgtcgacagctttagttacacctttaccgccataacgagctttgtctccgtcacgtaattcaactgcttcgtattcaccagttgaagcacctgaaggaaccattccgcggccaaaagctccgctttctgtgtatacttctacttcgattgttgggttaccacgtgagtctaagatctcgcgagcgtaaacatcagtaataattgacatgttttgtctctcctttgagtttgttttttcctaagggatttccctcatatacgattttagttaattttgctcattagtgcaaacatttcttgcatttttcgcaaattttcaacaattattttacagcgtctaacaatgacaagaatgaatctgcttgcaagcttgcgccaccgactaaagcaccgtcaacattttcttttgccatgtattcagcaatattttctggttttacagaaccgccgtattggatacgaactgcttctgatacttcttttccataaagtttttcaactgtttgacgtacaactccacaaatttcgtcagcgatttgtgcgtcagctgatttaccagtaccgattgcccagattggttcataagcaataaccatgtttgacacttgttcagctgaaagatcagctaaaccagctgtaatttgtccttcgatccattcagcagttttgcctgcttcataggtttctaaagattcgccgcagcataggattggtgtcataccatttgcaaagatagcttttgcttttttattgatgtcttcgtctgtttcatggaaatattcacgacgttctgaatgtccgatgatcacataatgaacacctagatcagcaagagctgctggtgaagtttcaccagtgaacgcacctgagttttcccagtagcagttttgtgctgagatttttagttctgtaccttcagctgatgtcattaattcttgtaagaataatgcaggagatccgatgactgaatcaactttgtcatttgaagggattttgttttttactgcttcagcaaattcttttgcttctgatgcagttttgttcattttccagttacctgcgataataggtttacgcattgaggaacacactccttaatttattgaaaaatggctagggagtcatgaaaactcccttcaccttttgatcgattactcgtcagaattgagcaaacttggtcgtttatttatcgttgattgctgctagtcctggtaattctttaccttcaagcaattccaagcttgcgccgccacctgttgagatgtgtgtgaatttgtcagcaaatcctaattgttctgctgctgcagctgagtctccgccaccgatgattgttgttgcgccttctaagttagcgattgcttcacaaacaccgattgtacctttagcaaagttactcatttcaaatacacccataggtccgttccaaacaactgtttttgcaccttgtaatgtatcagcaaataattttactgatgctgggccgatgtctaaagccatcaaaccatcaggaatgtctccttcgattacttgtgtttcaacatcatttgaaaattctggtgcacagacattgtcgattggcaagacaagtttgtcgcctgctttttcgattaattcttttgctagttctactttatcagcttctactagagagttaccgatcttgattccttttgcttcgtagaatgtgtaagtcattccgccaccgatcaagattttatctgctttaggaatcaagttttcgattacgccgattttatcagaaacttttgcgccaccaaggattgcaatcattgggcgttttggttcttctactgcttcaccgatgaacttgatttctttttccatcaagaatccagcaactgttgggataccagttgaagcgatacctacgttagaagcatgcgcacggtgagctgtaccgaaagcatcgttaacaaatacatcgcctaatgaagcccagtatttacctagttctgtatcatttttgctttcttttttaccgtcaatatcttcaaatcgtgtattttcgaatacgacaacgtcgccgtcattcatgttgcggattgcttcttctaattgttctccgcgagtttcaggtacgaatgttacttctttacctaataattcgcctagacgttttgcaactggagctaaagattttccttctttatcttcttctgtttttacacgtccaaggtgagagaaaaggattgcttttccgccttgttctagaacgtagttgattgttggcaatgctgctttgatacgagtgtcgtcagtgatcacgccgtctttcaaaggaacgttgaagtcaacacggacaagaacttttttgtcttttaaatcgatatctttcactgttttcttagccattttatttcctcctgaataaacttattatcaaaaaaagcggaagaagcgcgattgcttccccgcttttaaatgtacatgtctataatttacacttgtacgtttgtctatcttataagttagcgaagtattctaaagtacgtactaattgtgcagtgtatgacatttcgttgtcgtaccaagcaacagttttaactaattgtttgtcgccaactgtcattactttagtttgtgtagcatcaaataatgaaccgtaagtcataccaacgatatctgaagaaacgatttcgtctgtgttgtatccgtaagattcgtttgaagcttctttcattgctgcattgatttcgtcaacagttacttctttttcaagaactgttactaattctgttaatgaacctgttggtacaggaacacgttgagcagctccgtctaatttaccgttcaattcaggaattactaaaccgatagctttagcagcacctgttgagttaggaacgatgtttgcagcagcagcgcgtgcacggcggaagtcacctttaggatgaggtccgtctagagtcatttggtcacctgtgtaagcgtggatagttgtcattaatccttcaacaacaccaaatttgtcgttcaatgttttagccataggagctaaacagttagtagtacatgaagcacctgagataactgtttctttaccagttaatgtttcgtggtttgtgttataaacgattgttggaacatcgtttccgccaggagcagagataacaacgcgtttagcaccagctgttaaatgtttttcagctgctgatttagaagtgaagaaaccagtacattctagaacgatatctacgcctagttcgccccatggtaattcttctgggttgcggttagctaatactttaacttcttttccgtttacgttgaatgaaccttcatgaacttcaactgttccgttgaaacgtccttgagttgtgtcgtattttaacaagtgtgccaacattttagcatctgtcaagtcgttgattgctactacttcgattccatctacatcttggatacgacggaatgctagacgtccaatacgtccaaaaccattaatacctactttaactgtcatttaagatttcctccttatgaaaatcaaaaaaatatttattttaaagggttaccccttttaaaatctcatttgcagcagcttcatcagtgatgagccacgtttgttttggtgcatttttcatataagctcgaattgctttggcttttgattttccgcccgcgattgccatgatgatcgggactttttccaaatcttgcaattctatgccgattctagggaccttataaacgacttcacctttttcattgaaaaagtagccaaaagattccgcaacagcatttgcttgtttcagcatgactaattctttttcagtcatcttacgacgtgctgccatgtgtaatgcacgcccaatactatgaataacacaattcgcttcactaatcaagtttaagacttcttggatagatggctcattgagtaaagaattgtaagttgccagacttaattgttccggaacataaagtgcacggtggttaccgtttgctttagcagccattcttgcactgacagaatttgcctgtacagttatcgcttcaccaatcccgcctcttgcagggacaaacaggttatgccgtttcttattttccagattagacaattgttcggctaccacagccatagtagttcctcccatcacagcgatgatattctcgccttctggaagtagtcggtctagggcttcgcttagcgcttcgccgaatgcatcagccactttggtctgctcttcgctgtttcctgaaacaacgatacagcgttggttaccaaaatattctgccaactgttgttcggtttgatgcgtacctaaaagctgatccatgaagttttcaaggctttgataaacttcttcgcccttagttgtcagcgtcataccgctttttgaggtgtcgatcaaattcagatttttcaaaaggtctgtttctgttcgtaatactcgttctgtgatccccatactttccgataaacttcgacgtccaatcggctgcatccaatagatatttcgtaaaattttatagcgttcttgcaacacttcgataatatctggtgcaacagattcaatcatttttatttcatccagcatagcgatctccttagttggacactttacgtccaatgtagacttaaaacgacccatatacgataaaaaaagaaattaactattcgaatttcacatcaataaagggaaatctcaacctcacgactgtaagtctaacagttttgctctcgtttttcaactaaaaagactagaaaaagtgaaatactttttctagtcttttgactgattagttatcataacgttttctttttgatgaactcgggattcctaataaatcacgatattttgctactgttcttcttgagattactatctcgtcttttttcagcaattcaaccaatttctggtcagacaacggcttgtttttgtcttcttgattgactaattcctgcagctttttcttcgctgtatctgctgaaaggtcttctgtctgttctgtactattcgtaggaattcgtgtagtgaaaaatttttttaattcaaatacaccgaaatctgtttccaaatatttcccgttgactgcacgactgaccgtggattcatgcacatctatctcagttgcaacttcctttaacgtaagaggcttgattggacgttccttgtcgataaagaaagctttttgccgggaaacaatgacttgagcaacccgcaaaattgtatccccacgttggaggatcgttttcttcaaccattcgaattcctgtttccgttcttttaaataattttcagtttctttatctgcttgttgtgacatttgtttgaagtaactctcttgaaagcgtatatttggctgattttttcggtttgagataacttgtacatttttatcgtcgtccactaatacccggacatcaggaataatgtacaattcgctgctacggtcgaaaatccggccagggcttggactcaacgtttgtaaatagtcgaatatctgctgaacagcatgtagatcaacagaaaaacgttgtgcgatttctttccattttcgctccaccagttcctcaaaacattcttccaacacgatataagctaattccggcgcataatcatctcgttctgtttgaagcatgagacattcttgcaaactacgtgcacctactccagctggttctaattgctgaatcagagtcaacgcatcgagcatttggataggcgtagctccaatctcttttccggcttcttctaaactaatcgtcaaaaatccgttcaaatcgatgtattctacaagataaagaacaattttcctcaaaaaagtatctcggtaattcaaatggacttgttcgatcaatgaatcaaataaagacccttttgtatcaggaatctgatttaggtaatttgtctcttctccttcataagaagatgaagaagcttttatgtaatctggctgccattccggctcaacaacttccaccaatggattttccattgcttgattctcaacgaatgccaacagctcctcactgttatattgtaaaacttggatggactgttgcaactgttgcgtcatggctagtttctgtgtctgctgctgtttttgtgaaaaattttgctcaaatttcatttttttgtccaatccccttgtaattttttatctgtttagttacaattatcccagtgcttgcgtccttagtgtagtggatatcacgtaagattccggttcttgagacgggggttcgattccctcaggacgcgttctactgctattttagcataatttacgaatagttgcttctttatttttaagtgaaaactgtccgccaaagaaaattggtggacagttttttgttgtacctgtatagatattgttaagcctttgcaagtaaggtagttatgtgttcaactacttattaaaatgtgttatttattaaagatacttgtctcacttactgaactggccgatgatcgtttctgccataatagttctcgacagccgttggatgccctaataaatccccaactgtcgtgatgcgatacccttgctctttcagataatcgatcacttgaggaacggcacgaatcgtttcaggatagatatcatggaataaaataattgccccatcgtatactgttgcttggatcttctgcaaaatcaaatcaggatttcttgtcttccaatcttctgaatcaacagaccattcgatgatcggtcgctggatgatcgttgctcctacattcgtgacagaaccatagggcggacgaacaaaagcgggggttttaccagtgacttttttgatctcagtgtctgctttcgtcacttcctccgtcatcgactgggcagaaagagtggccagattctgatgatcgtatgtgtgattgccaatctcgtgccctgcttcagctgtctgcttcacgatttcaggatgctgcgccgtattttctcctaagacgaaaaaagtggcatgcacgtttttttcttttaagattcgcagaagctgcggtgttgtggtcgctcctggtccatcatcaaagctgattgcgacgcttttgacagccgtatctcggctcgtttttgtactgtcttgtgttgattgtgatgactgactttgtacctttttcgctgattcttgaatggcttctttgacgttagctgtttcagttgattggcttttaaaggttgattgttctgatcgttctgattgttctgattgtttgaaagattgtgacgaatgctccgaagagtgtgtttgtccttttacttcggtgatcaaggaggccaccgaagtaatttcgaaaaacaaaagcacggataaagcaataatactgataactaagtaatttcttttcactatatctcttctttctctttttctcttcttattatttacttgtacttacttgaaaattgaaactgctagtcgcaactacttctcgtctaatgatccaaataatcttccgatgccaaaatcgtttttgtcacggacttaggaatgacaaattctggtgtacccatataaccaggagcaatttcgtattgagaaaaagtcaaaactaattgatgctctttgttcaaataaaaacttcgtgtaggcgtaacaagtgttggtttttctatcgtcccttcttgaatatcttgctcagtccaatagtacttagatggatcttccttgacttgttcggccatctgccgtttgacttcttttgtcaaaacagatagataggtgtcatctttgaataaaagtggaagtgagagctggacactgtttttcttgtcgattgtgtcgtatcttttttcaacatggctatctgctgctgtttgggtgatctgcctttcaatcacgagaaaccggttatcgtctacgattttctgataatctcccaaaacttggtaatgatccgtttcaaaatttccatattctttttcagctttttcaaaatctgcttgtccttcgcgaaagtatttttgatttaatccatgaattgttttattttctttctcattttgtgtattgatcttcggtacctgaatatcgattttttcagatcgatcagtaaagcgttcgcctaaaatcaattcaatgactgatcctaagatgggtaaatcttctgcaaagcttcgaacttgactattaaaaagaaggctacttgttgtaatcatcacgatagccaaagatactccgaacccttggagacgtctctttctccgccttgcttttataaatgattgctcttcgataataaaacgctggcggatctcctctttaagccctttgggaattgcttgttctttataagttttctttagtttttttaaattttctttttgggaatacatggcactcttctctccttcattctaggatttgacgtaaagcattcaatgagcggtacattttcgttttaactgtgttttcattcatatccaagatagttgcaatttctttcaaacgaaatccttcaaaaaagtagaggatcagaatctctttttccggactgtctattttatctaaaatcatatggagctctgcaacggaagtttctaaaggtaactgttgggggatatcttgaatttcaaataagtccacaggcgtccttttttgtctgcgccaactatctaatgccgtgcggatcaatatccgataaaaccatgcactaaaatgctcgatctctttttctttttcaaaatagttcagggctttatgaaaactatcttgcatcacatctaaggcctcttctttatcatgtacgtaattcatcgtaatacggaacattttttgataatcagtttcgatgagtccattcagcaggtgacggtatttttcgatctgccgttttttcttatatccagtaaaaatcattctccactcctttctgcctcacttaatatgacgtacaaggtgcgctaaaagtttcaatttttttattttttatgtatttacttgggatttttatatacaaaaaagaaggtgtgacaaaaatcgtgtcacacctccttattctgataggctgatcgtctctgtcacaacctctcgtaagaaaataatgtttattctttttcagagtcagaaaattcttcctcttcataatcttcatcatcatcgtcttcgtctatgatacttaaatcttcttcgatatttcctggcaagtcttcttcatcatctgtcgggtcatctgctccgatttcttgcaagtcagaattataagcagcgatttcttcatcttcatcatcatcgtcatcaaacagatcatcgtcatcttcttctgtcagatctgtatcttctgggtcatcgtcattgtaatcgatcgcgtcttcatcatcattgataaaggcgttgactttcttgcgtttacggcgacgtggagtatcttcatcctcttcgtccattccatggtttacttcttcatcgatcgaatcgatagcataccatgaacgcaagccccaacgattatcccctaatgagataaagctgccgtcaatattcaagtcagtataaaattgtgcgagtgaatcacgaatttcactgtctgatttcccaagatagttttggatctggttagctaaatcagaaaaatccatgacatcgccacgttgttctaagatcgcgtgtgctacttcgatcattgataattcgcttttgtttgcaccttcaaatacactaatttccaatcaggacacgtcctttcacagtctactccttatcatacaaaatcagacacaaaaaatcaaacttttcttttatatttacgctgtaaaatccaaggtcaaataatattcgccgattttttccggtcccatgaacagatcataatcgattcgaaccttccctgctgtgggacggtctttcaaactaacatgcagttctttcgtaaaagtagcaatctggatcataccgtatggtgttcgataggatgtttctaaccgttctttatagccaaatttcaaacgcatccgcatttctcctgcacggatcagctgtacatgaccatctggaactaatttgatcgttacaggaatctcatcgcccgtctcctcctgaatctctttataacgtatgtacagcgtatcgccaattgtcaccatttgccctttcaaatcaaaataaaaatcttgcacttccccttgctgttttacttttgtacgcaatttgattgaaatcggtgttccttgtgataattccattattcattctcctttacttctcatagctacattgttcctagtttcttttgttttgtcaaccaacttgtccatttttacagaaaaccttttttccaaaacaactccttgattttagagtataatattgtagaaaatatgaatttatacaaaggagccggttgaatgaaccctgcgattcgactagatcagcacatttatcaaaaaaacgacttttccccttttgcattaacagatatattaacggaatattctaaagaacaccagcaaatctttttacatttctggcaatatgactgcacagtcatcttaggtatgaaggatgttcgaactccttttctaagtgacgggatccaaacactgaaagatgcaggttacgctccagtgatcagaaattcaggtggattagggatcgtatcagatgaaggaattttgaacatttctttgattttcccccaaagtgacacaaaaaaaataaccatagatgacgcttacgagcaaatgctcctattgactaaatacgcttttccaaaggcaccgatacaagcattcgaaatcacccattcttattgtcctggaacttatgatttaagcatccatggcaaaaaatttgccggtatcgctcagcgtcggatcaaaaatgggatttctgttatgatgtacttaagtgtcaacggtaatcaggaaaaacgcgggcaagtcatgaagcgattttatcaatctgctttaaaagaagactttggtacaaatggctatcctgcagtggatcctgctacaatggcaacacttgaagaactgcttgaccaacccctttttgtaaaagaagtcaaagaagcatttgcaaaagcttttgaaaagctgtattctgcaagtgatttacaggattctaccgactggctaaaaaaagaaatccagctggagcaatggaacaaccaaatccagagaatggaacaacgtaataacataaaggagctacattatgacaaccccttataaatatcaaatgctgcctatggaaaaagtttttcgtgatccagtccataactatatccatgtccagcatcaagtaatcttagatttgatcaattcgaaagaagtccaacgtctacgacgcattaaacaattaggcacttcttctttcacttttcacggagcagaacatagccgttttactcattcattaggcgtttatgagatttcaagacgaatctgcgatatcttttctcgaaatttttcaaaagaaaaaataggcaacggaggctgggatgatcaggaacggctggtgactttatgtgcggcactgttgcatgatgtcggtcatggtccttactctcatacatttgaacatatcttccatacgaatcatgaagccatcactgtagagatcatcacttctccagaaacagaagtgtatcagattcttaaccgagtagaagaaggttttcctgaaaaggtagctagtgtgatccaaaaaacttaccccaacccacaagttgtccaaatgatttctagtcagatcgatgcagatcgaatggactatttgcttcgggatgcttatttcactggaacagaatatggaacatttgatcttacccgaatattacgtgtgattcgtccttatgaaggcgggatcgctttttccatgagtggcatgcatgcagtggaagattatatcgttagccgatatcaaatgtatgtgcaagtgtacttccatcctgtttcccgtggtatggaagtaattttggagcatctgcttcatcgcgcacacgagttgtatcaagaagatgccagcagttttgaactccattctcaattacttctgccatttcttgacggaagctttactttagaagaatacctcaaacttgatgatggggtcttgggcacttactttactcaatggtctgaatctgctgatcctattttaaatgatttagctaaacgttttttgaatcgtaaaccactgaaatctgctactttttctggcaaccgggattcaaaattagtccaagaactcactttgttagtagaaaaggtcggatataatcctgtttattacactgctgtgaattctagctacgatctaccttatgatttttatcgcccagaacaaggcagacatcgcacacaaatcgagattttgcgaaatgacggaactttgatagaattatcacaggttagtcagcttgttgctgcattagcgggacaagaacaaggagatgagcgatttttctttccaaaagaaatggttgatccgtccttgcgtgatcattatgatttatttgacgaaacttatcaagaatttgccagccatatccgtaatggcgcattgattgaaataaattaaaatatattggaggaaattatgtctatcaaactagtcgctatcgacatcgatggtactttattaaatgagaaaagagaagtaacaaaagaagtaaaagaagcgattgccgctgctgttgcaaaaggtgtttcgatcgttttatgcactggccgtcccttaccaggtgtccaggaacagttaaacgagttgaacctttttcaagataatgattacgttattacttataacggggcactcgtacaacaaacgaaatcaggtaaaatcatcgcccgtcacggactgacacatgaagatttcctagagatcgaagtaatggcacgccgtgtcggcagtcatctccattcgatcgatgacaaagcgatctacacgcctaatcgagatatcagcgcttatacgatccacgaagcaagtttagtcaagatgccgctaaaatatcgaacacctgaagaaatgacaccagacatgaacatcgtcaaaatgatgatgatcgacgaaccagaaattttagatgcagcaattgcgcgtttaccgcaaactttccgtgataaatacacaacggtcaaaagtgcgccctattacttcgaagtactaaataaagaagcaagtaaaggtgcggcagttgcgaatctcgcacagcaccttggtattgatcaagatgaaatcatggctatcggagataacgagaacgacttatccatgattgaatatgctggtctaggagtagcaatgggaaatgccgtttctcttgtcaaagaagcagcaaatgtcatcacttcatcaaacgacgagcacggtgtagctgaagcaatcaaaaaatatgtactgtaataaataaaaaaactgagagaaagctgatctactcgctttctttcagtttttatttttttcgatccatctctcgactgcccatcggtggctaccacgtttcaatttcacaagcgcttcttgagggctcacccaccaaattttattggtcttttcagttggttctcctatacgcttccaagaatcagcaacaaagaaatatcctggattataataataagttgcacgataattcgagtaaaaatactcatcagcttctcccagataagaagaaatttctgccacaattcccatttcttctatcagctcacggacaatcgcttcttctttcgtctcttctccttcaatttccccgccaggaagaaaaaaagcaccatttggagcctcgattactgcaatccgcttgtctctttctataacgatatatgctgcataacgggtttgataatcagcaaattgctttttttcaccaaaaattggtttatccatgaatagtttccaccttaacagttttattttctatccattttacatgagaaatttctcatgaacaagcacaaatcaactatttccttacttctttttgttatgattgagtaaaaggaaaaggagagatgaatctatgaaaatggctcacacatgtgttcgagtgaaagatcttgaagcatcaatcgaattttatcaaaaggcatttggttttgaagaaagccgccgccgtgattttccagaaaacaaatttacacttgtttatttgacacttcctggggatgactatgaattagagttgacttacaactatgatcatggtgcgtatgatctaggagacggctatggtcatatcgctatcgcagctgatgatctagaaaaattacacgagcaacataaagctgctggtcttgagattactgacttaaaaggattacctggcactgcgccttcttactactttgtcattgaccctgatggttataaaattgaagtcatccgaggatagttagtatggggcattttactcttgattgaataaaaaacaaacaccaataattaaaatgagacgcaaacttttcattaaattgaaaaagtttgcgtctttttttaacaaccattgtagctataaggctgccactctccaccaatttatatttaattcatttgaaagaaatcaaataaacgaggtacctttagaaaacaaaactgcttttcctcctattatcacacgatcttcttttaattcacattctagatccccgccccttgatgacatttgataagctgacaattttgttttattcattctttctgcccaataaggaataagattagaatgtgctgatccacatactggatcttcattgattgttaattttggaaagaaggttctagaaacaaagtctttttgcacactttctgctgtcacgatgactcctattcctaattcaaaatttttgatagctgtaaaatctggctgcaatttagccaccgttttttcatcttctaatacgaaaaataaatcacgtgctaagtaggcttctttaatcttagccccaatcgcttcttcatattcagacaatatcggcacttttttcggcataatactaggaaaatccatgtaataataatctttaattcttgtcacaaatagattaccgctttgagtagaaaacttaatcgtttcatcaggtattttgtaatagttaaataaaacaaatgctgttgctaatgtcgcgtgaccacaaagatcgatttctcgatctggcgtaaaccatctaagctcaaattcttggtttttcttcactgtaaatgctgtttcagataaattgttttcaatggcaattttttgcatcgtaccttctggcagccattcttctagcacataaaccgctgctggatttcctttgaacacctcatctgcaaatgcatcaactacgtaataatctaagttcattttaaagcccctttctctaatttgttataaatatattctgcacaacaaagatcttcaatagctagaccaactgcgtcgaaaatcgtcggcctcgattttcctttataaaatgtttttttctcagaaactaattcgcctaatgtaccaacaatacaagattcctctaaatctccttctgccatggctataagcaggtccccgctttctgttaaggcagctgagtaatcatctacatagatttgagaagtttccatcaacgatgtacttatctctcttgtatcaggagtaaatgtgcccacagcattgatatgtgcgtcttcccttacccactctttttgaagaaatgcctctttactagaggtcaacgtacaaatgatttccgctggacgtactgcatcttctactgatattgcatttataaacgttattttaggatactgttttttagctttagcgataaaagtatttcgtctttcttctaaaatatcgtaaacaaacactgtagtgatgggacgaatggtagaaatcgcagtcaaatgcgacaatgcttgttgaccagctccaattaaagcaagtgtttctgcatgcggatttgctaagtaatctgttgccagcgcagatacagcagctgttcgaatccaggtgactgcatttgcgtttatcaatgctttgggtagtccgttttgagcatcaaacaagaaaatctctcctaaatgagaaggtaaatgatactgatgattatccggaaaagcggtaatgacttttgttccaaaatatctgttctcccccaaataagcaggcatcatcgcaaacatatttttgtcttttccgtcaggtaaaatttccaccaatcgaggattttggctgattttaccactttcataatcaaaaaaacattttttcattacttgaatcgcttcttcaaaactaaaagaagctactacttcctcaaaattaataattttcatagacaattccctcctcacaaaagattaacttctaaaatcaatacaatcaatggtaaaattgtatggtatacaattttaaggagtggagaaaatgcctattaattcttatgacaattacccgttaacttggcgaccagacaaacaaaaattgaagcgtccttattatcgatcgttgattcaacaattagaacaagatattttaaagaataaattacagaaaaacactcagttaccctcccaaagagagctagctgattatttagatttaaattttactaccgttggcaaggcttataaatatggaattgagaaaggtttgctgtatacgaatattggaagtggcacatttatttctcccaatgtctttgagtccatcaccatctctaccaatgaagtaaccgaacatatcattgattttggtctggttagttcttttgaagaatgtaataaattcgttgtcccgtttattcaatcaactagtaataacccaaatcttgttggtttgcttaattaccaagatcccaaaggcacaaattttcaattgactactgcagcaaattggttaaaaactcaaggagtcattccgtccttagaatctctatctattgtttccggtgttcaaaatggattggctatcacactttctgcacttttctctccaggtgatagaatagcaacagaccgatatacatacgctaatttcattgaattggctcagttatatcatttagagatcgttccaattgattttgacgagcaaggaatgcgacctgatatattgattcaggaatgtagaaaaaagaagattcatggtgtctttcttatgccttcttgtaataatcctatagggtttcaaatctctcacaaaagacgagagcaattagccgaagtgattgaaaaagaaggtctatgggttattgaagatgatatccattcatttttaacaacttactatcaacatacgatcattcctcctttccaaaaattattacctaaccaaacaatctacttagctggaatgacaaaatttatttgttctggattgcgagttgcttatcttgtagttccagtacatgtccaaagcaagatagaacaagcaatttttaatataaatgtgaaaacttctggattagatgtggaagtcatcactcaaatcctccattcaaatgaagcaaataggatcttagaaactaaattaagtcttacgaaaagagccaatcagctttttgattctcttttcaaagtagaaaaaccaacgaatcgtgtcccttactatcgaattcttccagttgatcctgagattgaccctaagataattgagaatgactttcttgctaacggtatccgactttatcattccagacgctttactacacgtgcgcaaccagatgcattcgttcgaatttccctatcctctaataaccttgaaattttagcttctggactaagtatcgtaaaagaaaaaataaaaaaatatgaattataacctattgataaataaaggaatcaaatcttattgattcctttcaataaaaaagaggcactacccgaggttcaacaacgggtagtgccccaaaaaataaacgaacattttgcacttaaagtatccaagaagcaagaaaaattattttattttcttattttactaaatcactaggtttctgtcagaagatgaaattatccaatcatgacactttcttctggatatttgtattttgattgtgttctttgtgcttttgtcatcagagagaagaccacagtcaatacaccaactcgtccaatgtacataagcgctataatgatcaatttccctattgcagtcaagtctggcgtcaatcccatcgtaagacctactgtaccaaacgcagagaagacctcaaaagcaatatattcgatgccagaagttttaggtatcgtttcagtcaccgataaaatcatgatggcgactacacacaacgtcaacgtaacaaaaaataaagtaagtgcccgcaacactgcgccttgtcggatggtacggccaaatgcttccgctctcgtacgtcctttaagcatcgaacgcatctggatcagcaacacacctaacgtagttgttttcaatccgccggccgtcgacccagatgttccgccgatgtacatcaaaaacatcgttaaaatcagacctgcatggctcatatggaggtaatcaactgaataatatccagccgttctaggtgtcacactcataaaaaaggtgtttgccaatcgttgaaacatattcccttccactagcgttgccccattgcgctctgtgaaaaagaacacaacgaatccgcctaataaaagggtacctgtaacggttaatgcgatttttgaatgaatcgtcatcttctttttctgatgatattccagtaaatcacgccatacgatgaagcctaacccaccagaaatgatcaaagcagataccaccatgatcaaataaacattttgctggtgattggctaaactgtctcctaacaaatcaaaccctgcattacaaaaactagagattgcatggaacaaactgtaccagatacctttcaaccagccaaattcaggcacaaatacaaaagataaagcaaccgtaccaatcaattggatcacaaaggccaattttaggatgtaaagcatgagcttcatcacacctgatacttcttctagattcagcgcttcttttaatataatacgtgtgctgagactgactttcttctttatcaatgcaaagcatagaatcggaaccatcataaaaccaagaccgccgatctcaatcaaaagcatgatcaaaaattgaccagcactgttccaatgctctgctgtattcaatgttgtcaatcccgttacacagacagcagaagttgcagtgaaaagcgcatcgataaaatttgtcccatgcccactattactaaaaaatggtagggtaagtaggccgccgccaactaaaatcaggagaaaaaatcctaatgcgagaagctgaacagccggcaagcgtttctttatttgtttgctttgtttaatcatcgttttcctcttttaaaaaaagataccacttagtcagtggtacccatattttttactttgatcaaccttgttacttctgcgcgctcgttttcttccagcttcatacgaatataatagatcgtttcttctaattgagggatcgtcatatattctaatgcattgactcgccgacgtgtcttttcgatttcactcgccatcagttgacaagttttttcgatttctgtcagttccaaaagttttggaagcagggtagtaaaccgatcgattgaccgatccagttcggcactggaattcaaatacccgtattccaaaggtgtgtctgtcagctgttcatcatattcaaaattcatcacaggtacttttacactcatgatatttttgtctacgatagacaaatcaacgttttccgccggcaaaacaaataattcttcgatgaaaggctccgtgatcgaagcatttgccaatacaaaatcagacattgcttctgtcatagactcttccatttcttgacgcagctggttgttctttcgaatcaacaggatgaattgacgcatcagttcatcttgcttatcttttaataatttatgccctcttgtggcagttgtcaactgttttttcaatcgagtcaattccatgcgggtcggattcacattcaatcgtgccatcagaactcacttcccttctggcagatatttgtccagcatgtcgtctttgattcgttttaattcggttcttggcaacatcgatagcagttcccaccctagatcaagtgtttcagtaatcgaacggttcgtgtagaatccttgattgacatattctttttcaaaccgctcagcaaacttcgcatagatcttgtctacatcagataaagcagattcacctaaaactacggctaattcttttgcctgttttccttgtgcataggctgcaaaaagctgattcatcgtagctgcatggtcttctcttgtctttccgggtccagttcccttatcttttaaccgcgaaagagacgggagtacatcaattggtggctgaatcccactcttgtaaagctctctagtcaagatgatctgtccttctgtaatataaccagtcaagtcagggattggatgagttttatcgtcttctggcattgttagaatcggaatttgagtaaccgatccttttagtccgcggattcttcctgctcgttcgaataaagtagctaagttcgtgtaaagatacccaggatatcctcttcttcctggaacttctcgccgtgctgcagaaatctctcgcaatgcctctgcatagttggtcatgtctgtcatgataaccaaaacatgcattcccttttcataagcaagatattctgcagcagtcaaagccatacgaggagtagcgatacgttcgattgcagggtcgtttgctaaattcatgaacatgacagaacggtcgattgcaccagtttgtcgaaaatcttccatgaaaaattctgcttcttcaaaagtgattccaatagcagcaaagactacggcgaaatcatctgatgaatcaagtaccgttgcttgtcgcgcaatctgagcagctaattctttgtgaggaagaccagaaccagaaaatactggtaatttttgtccacgaactaatgtgttcaaatgatcgattgcagagatacctgtttggataaactcatctggataatcccgagctactggattgattacttctccgttaatatccaaatgcttttcaggcaggatctctggtccgttatctttcggtcgtcccaaaccatcgaatactcgaccgatcatgtcttccgatacacctagttctaaaggatggcctaaaaatcgtacagaagagtcacgtaaattgatcccacttgttccttcgaatatttggaccattgctttatcttcttggacttccaatacttgtccacgacgaatctcgccattttgcatacggacttcgattaattcttcatatttgacaccagcaactttttcaaccgccatcaatggaccgacgacttcaccgatcgtacgatattctttaatcattgctcatgcctccttctgaaacgatcgtttgcatcgtttgcttgatttcaccaataatttgatctagtttttctaattctgtttccgggatatatttgcttcgtccgatcctttcacgaatcgatacggtaccgtccatgatctcacttaaataagcacctaacgacaacgcacggcgtccttcttcaccaaaggtcaagatcatcttcaacattttgaactgtttctctcttgaggtgaatgtatcgacatcatcaaaagcattttgctgcaaataatcttcacgaatggattttgccacttctaatgtcagacggtcattatctgaaagggaatcaatccctaccaaacgcacgatttcattcagctgctgttcttcttgcaaaatacgcatgccctcggtgaccatggatgcccagtcagcttgaaggatatgatccatatacttccctacttctgttgaataaagagaatagctttgtatccaatcgatcgaaggaaaatgtcttttttgggctaaactggaatcaagaccccagaatacttttacgacccgcaatgtattttgtgtgactggttccgaaatatcccctccagacggcgatacagcactgattgcggttatacttccttcgcgaccttctgatcctaatgcaatgactcttccagatcgttcatagtattccgcaagccgtgaaccaagataagctggataaccttcatcaccaggcatttcttccaaacgtccgctcatctcacgaagtgcttctgcccatcgtgaagtggagtctgccatgatagcaacgtcataacccatgtcacggaaatattccgcaattgtgattcccgtatagatagaagcttctcgagctgctactggcatgtttgatgtattagcaatcaataccgtacgttccatcaacgattctcctgtattagggtcaatcaattcagggaattcatttaaaacatccgtcatctcatttccacgctcgccacatcccacatagacaaccatgtccacatcggcccattttgcaatttgatgctgaacgactgttttccctgcaccaaaaggaccaggtacagctgctgctcctccttttgtcactgggaagaatgtatcaatcactcgctgtccagtgatcatgggtgcatccgggtttaatttttctttgattggccgactacgtcttactggccatttttgaagcatcgtcaaatttttgtcaccattttcggtttcaatgacacatactgtttcatcaatagtgaatgaacctttttcgattgttttgatcgtaccttttatcccatttggcaccatgattttatgttttataacttttgtttcttctacgatcccgataacatctccagcactcaccgtttctccggcttctactgttggttcgaaccaccattttttctcatggtccaatgcgggcaattgaactccgcgccctaagaaattactttgtgtgatttccataaaggtatctaatggccgttggattccgtcaaacatttgtgaaatgatccctggtcctaattcaacagataaagcttcaccagtagagcgaaccggttcgcctggaccaattccagaagtctcttcatatacttgaatagacgccacatcgccacgcatctcgataatttctccgataactcctagatctcccactagacacatgtcttggatactggcatcagacatgttctcagccattacaagaggtccggagacttttatgatttttccaatttgcaaaatttctatctccttttcatactataagatattttgacctactgctttttctacgtttttttgaatttcttccagccctatccctaatgatccttgatgattgggaatcaatacgatagcaggtatcatttgttccttgtaacgttcgatcgtttctgggctcaatgctgcacattgctctgtgacataaatcacgccatactcattctttgccatttcttcaattgcctgacgaacggtttgcttggttgtaccataacgaacatcaaagccaaacaatttgaatggcaaaacagaatctttgtcgccaactacaccaatcttatgcgtcatagacttgtctcacccgctttctgattgtttctgattcgaaatggcttcttttgccgataaccagtaaacgaaggtttttgctttctacctcttttgcgttcaaaaaggctagtagtggcagtggtccgaaagcctgggtttgtgcttcttgatacaatgaacttagataatcatctttcaactgttcaagctttacgagatcaagatttccctcacggatgacagggcgcagaaaatcagcataatctgtctctaatagaaaattcgtataatcttccatatctttatctacaaagttcaaaaatacttctttttcgatacttcccgagctggaaagtaccgtcgtcatgaacccatatgttcttttctgcaatattcctcgagccatcgttgtgatattggtcaagtcaataaaagcaatgacttctgttagcaattcttgatatcctagcttatcggcaagccgtcgctgctctgtcaaaaactgtcgatcataaatcacgtcaattccctgaagaatggtagactcttcaaaataatcacgtacttctcgtatactgtccataatgctttcaggaagttcatttgaaacttgtgtatgaatggcatccttcaaggtttctaatgaataaaatccatcgtcgatatacaaatggtccagattttgatttgtcatctcggcttttgtcaaaaccttcagattatggaaagtatagcgcatcgtatagatccaaacgatttcaggctccggtgctgattcctttaaccagcgaaatagacggctctgctcctttaaaagattctgttcgaagtcatattcatatccgtcataaatatatggactgtaaatcgtggatttcaatatttcaccaagtgcttcgacagaatttgtttgaatcatccgttcaaatgtctcattggacaaaagttcaagctctcttccgcgaatcaagggatttagttcgtggtattccatacactgatccctccttattcgaataattgattggcaatctcaaaactcatcgttccttggatatcttgtacaaggctgctgaaaagaaaattatactgaactccttgatcgtttatcagaaaacccgcttgatcagcaacagtttcatcacttaaaaccatcataaagggaagttcattgttccattcatccaacaacgtctgagaaagataggctgctgatttttctccagcaatgaatgctacttttcctgtcaaaggtaatgaatacaatgcatttttgataaactggatttgttcagattcatcccaattttccatttcagttaccgcatctgcaaacaatcgtcttaaaaattcctgcttcgcattcaaattttcttgtcgtacttctacttgctggcgattccttagctgacggtattttttttcgagtaattcgatttgtttttctttttgtttttgatgttctgtttcaacttgcgtacgtttttgttcaaagttttgatcgatcttcattcgctcttcttgttctaacgccgctctttcctgctctgctgcttcgttcatctgagagatgattttttcaatggcgttcatctgcttttcctcctttatgcttaggcattcaacactaataggaaggaaataacgaaacctaaaatcgcgtatgtttcaaccatcgcagcaaaaatgattccttttgtagcatgttcaggttttttcgctaaaatttgaatacctgccgctgcgacttttccttgggcaatacctgaaaacaagcctgtaaaagcaatcggcagagaagcacctagaaagttcagtccttgtacaactgacatgtcatttcctaagttgataaaaatcaaaaaggcaataacgaatccatacaaaccttgcgtacctggaagcaattgcagaatcagagcctgcccgaatttttcgggttgacttgttgtcaatgctgctgctgcctcacctgtcattccaacacctttagctgaaccgatccctgaaaaaatcgtcgctgttgccatcgctaataccgcaaataccattccaccattttgactaattaagtaatccatcattgtataaaaatcctccaattatttattgttttttttcttgtgattgatgttgacgtatttttccgccgttttcagcggatcaaaggcacgtccgcctcctgtataaaacttcccaaaaaattcgacatactgcaatcgtgcgccatggacataggcacttagcagtgtcaaaaacatattcagtgcgtgtaaagcgatgatcaaaaggatccctgcactgaatcgagcagctggcggcatgaaagcaactagcatattgaatgccgctccaatacttccgcctgaaatacccaatgccatcaaacgtgtataactgactaaatcaccgatatagccggtcagtccgtaaagattatacgcacctttggcagcacctttgactttagacggcgtttggataatcggaacgatcaagatacataaggcagcaatgatcgatagcccagcgccaaggtaaacaaatgctgtattttttatcaacatggcaccaaccaacgcaataacgatcccaattaggatcccttgccaggcaaatccatcactgacagcactcaagtaatcttttctcctgatattttcctttgctgccacaaataatccaaccaaaatctgtatcagaccgaaaatcacggataaaatcaaaatcgtattaacgtcatccgtcgtagataggattgggaaaggcaagcggatgccaaacagttcttttggtaatgcctgtccgaaaaatgaactgtagatcaatccccagatgatcgatggtatcgagagaatctcaaagaattttacgaaacgtttcatcccgcgtggtagaacaagtagtttttgagctagtattgtcccaatgagcatcagcaatccgtaaccaacatctgcgaccatcatcccgaagaagacaagataaaatggtgtcatccaaggtgttggatctacttcttcatattttggcagactgtacatttcagtcagcaattcaaaaggttcgacaagcggatggtttttcaatttagtagggacttcctgctgaatctcttctgagtttggtgtttcgaaactgacgtatatatcttcttctgatacggtttcgtttaacacatgcagcaaattctgtttttcttctgcatctacccaaccttgcaaaacgatcagataagtcgcatggataaaccgttcttttattttttctcgttctgcaacggcaagtgtgacttcttctacccattcaaattcttggatatagccactgcactgacctaacgctgtcgttatcttcttttgctgctcgtgaacaatggataattgctgcttggtctcttgcagtttttctttaggattttgttcataaggatacgtttctttgttgaacccgtatttcccaacaatttcttctataacagcaactgatttttttaaagcaacatacgaaagataaacttgttttggcgtataatctatttcttccatataaacgtcatcaagcttactcagttcttccttgaaactttcaaaatttgctgcactcacagtccccatctcaaaaatggtcgtcttacttgcatacatacttggagcaatatccagctgttgccaatgaagaagccattcttcctcttcttctaaacgatcacgtttttcagttagctgttcccacttttcttttaaatcaagaacttctttcaatttatttatgaaattttcttcggaataattggcttccaaatcttgtaaggaaagttcttgacgtttcaaatggagtttcttttgacggctatcgccgtggtgttgtatgaattggatagcttcttggatgtctttcaaccgattacctaaagcgcttaattttgcttctttatcaataatcgtggtatctggaaaatacttctctacccactggttgtttgttctattttgatacagatcccgtatttcaacgttttggattccttgtactgcttgtaaaatcctctcctgatttcttttatctgaaatgagggtcactttttccatcttagtgacggccataagtttctttcaccctttcaatgatcgcaccgatcgcttgactctgatgcttttgatattgatctttcaaagttgcttgcaccttgtctgcttctgctttcaatttcattttttctttttctaattcttgtatttcgaattgttctttttcttccaccaactgttttagttgttgtcgatagtttgtttggatcgtttccaattcctgctctttttctgttgcatagatcttcagctgctgccgcagtgtttgagcacgcttttcattttcttcttctgcttttcggatttgttccaaagcttctaacacttgcttcacttcctttcgatttaaaaaagaggtacatgctttcttttttcattgaaagtatgtacctctaaagataacttagtataggcaggccccttcaataaaatgtccttctcaccccttgaagaactagatccttgaagcttacgcccaacctttttatttctgcttactttttattataacaaattaagcaatattttcaactatcgtcatgaatttcacacgaaatttctctttacagatagtaacacagcaagaacagataagtataggggcaagtcttacatagtttaatttttttataatccttgttacaataggtctactttagggggaatacaaatgaaaccaatcatcggcattgccggaaatcaactgattcgagcaacagatactttccaaggaaatcaagtgagctatacaccgcaaggattcgtggatgcagttttagatgctcaaggattgcctcttattctgccagtcatgtctccagattcagctcctcaactgattggacaaatcgacaaactcattcttgcaggcggtcaggatgttagtccgcaactttacatggaagaccctcatccaaaactgacggaaacaaatattcaacgagaccaatttgaacaggcactgatcttggaagcattgaaacaaagaaaaccaatttttgcagtctgccggggactccaactattgaatgtcgttttggaaggtacactttatcaagatctttcattatatccaaagtggtcagtaaaacatgaacaacagcccactgccccgcaatttacgactcacgaagtcaagattgtttcagacagtttgttaagcaaccttctccccgatccatattttgtgaattcttaccatcatcaggcagtcaaagatctttcacctttattaaaagccatcgctttttctaacgatggactcgttgaagcggttcaaagcaaagatgatatgcataaaatcctcggtgtccaatggcatccggaacttacccaccgtgtacatccatctgaacagcgcttattcgatttctttgtgaatgaattttaatagactttctgagggggttgtgaaaaagctgtttagtttcgagtattaagaaaaattttgtgaaaatggcttttcacatttttgcataaatttggcttaataccgagaaactggcttttgaacaccgtttaaggaagaggttgtgaaatcagtgccttgacctgagtattagagaaacaaaacggaaaaatagcttctcatattttaccgttttttgagctaatatcgagggtcagctgattgaacaccgtttataccaagaggtcgtgagcctgccgttcaactctgagtcacaaggagcaatttcaaaaaacagcttttcatgtttgttgaatagtgtgacttgtgaccgaggagttggcagaagaacaccgtttatccggaaaaagagactgcgacacgacttttgtctcagtctccagtctatggaacaatgttcactggaattcttctcaatcgtcctttcgatagtccaacagccttttgagctgggtaatctgctgctgcagttccataccttttgttgtatcacgattgagtttgcgtggtagttgctgttcgattacttttttcacatttgtttggtcggatttttttgcaaattgttgttcaataggcaaaaacggataatgtgtcacgatttggaaaccataagaattgcataatagtgaataaccggcaattcctgtcgttttttgataagctttggataaacctccgtcaatgacaaatacttttccatttgctttgatcggtgactcccctttttttacttttactggcgtgtgcccattaatgattgctgacccttcttcttttgtgtcgaattctgctaaaattttttcactgaaccactcttcatctcgcaagtgataataaggattgcttttctcgacgtgcgtatgaggctctgtgagaaaataacgttcaaaagtcgccattttactcttgccgaataaaggcgaaaatggcccactccacgcataccaaatcaaatcggttgctaaatcttcttttgcagtcagatcttttgcgctttcagttatctgtttttcaaaaaagcccagcagttctcttccgcgataagattggtctaattcaaatgctaagagctgtcccttctcgtctacaggtatacagccatgaaacagcacatgctgattgttcgtgagatacattccccctttttcgatcaaaaacgtcatatgtttttgcattctcaaagagtgctggaatgaatacatcaaactatcaatcactttttgttcctcttccaagaatttttttggatcatctggctggatcgtttgaaaacaagttcctttcaactcatagagctgaccttctaaatcaatcgttgatgcttcatagtcgattttttccagcaatttacgatcgtccattttaaattcaggtcgacgatccaataactgatgttctgatttgaattgaaggatagaaagtgcctgatggattttttctaattcttcttgctctctttcggatagatttttactgtttttaggcgcaaatactggattcttctgataagtttgatgagcaaaagaaaacaatggacgtaaattcaacccatattctttctctaattcaaataaataattatagcgtgctgcaatccgtaaaagtgtcagtaaacatgcctcagagccgcaatacgcaccaatccacaaaatatcatgatttccccattggatatctacagaagaaaaatccatgattcgatccatcactttggctgcttgagttcctcggtcaaaaatatctccaacgatatgcaaatgatcgatgacagatttttggatcgtctgtgcaagtttcgttaaaaatttttcttcttccttcatcaaaacaagttgttcaatgattttttttacatagtctttttttccattgatacggtcatcgatatacaagagttcctcaatgatatagctatattctttcggcaatccttttcgaacttttgaccgggtatatttgactgtcgtaaaccgtaaaagatcgatcaaatgatggatcagctgcgatttatcttgttctttgtaccaatcagtcgttaatgcatattctggataagccgtaaaaatagtgaattggctgatatccgtttccgtcatttgttcagaaaaaaggtctttgatcttttctttaagatttcctgaaccgatacgcagaatatgatcaaaagcaggaaattcgccatgtatatcactcaaaaataactctgttccttttggaagctgcaaaattgcttcgagattgatgatttccgtgatgacatcctccgttgaggggaatttttctgaaagtaaatctaaataacggtccattaaaacgcctccaaaaattggtatactcaatattataaagttgttatacactattttcaatgaatatatatccaatatagtaaaataaataaaataggtctatacaaaaagaagctgggaacaatagatgtccagcttccttctgtattttaggattgttttatgatttttttcgttcattcctcataattgaaatcgattgttttaatgaactccataatccgccttcgctataaacgagtacattcgatttgtacatgtttgcagacaagatcatcaataagaatgttacggctacaagtaccaacaaggaaatcaatgctccacccataccgactgtctcatttgctaagcgaaccggcataatatatgaagataagaatggaatatacgaagtgatccgaataacgatattgtttggatctgaagctcctagtatcaatccaagcatgtatccgcctagagatagataagtcactggcaaaattgcttttgctgtatcttctgctttgttgaccaaagagccacataaagctgctaaaacagaaaaaatcaaaatgccaaagatcatgaatagaagagaataccacaagaatggtccaatcaagttatccaatgagataccgtctaatatatttttgaccatttccatatctttgaattgactgtatcctataccaaaaataataccgtataatgccatttgcgttaatgcaacaagtaaaacacctgttagttttccgtaaaaatgcttttgtgcagtcgtactggacaggatcacttccatgatccgcgtgcctttttcagaagcgatctcttgtgcaatgatctgcgcatacgtcaaaataataatgaacaagacaatcgttgctacataacttacgacatattggactgtcgagttatcttctccgactgtcatttttccttttgaatcaaaattgactttttgtcgagtcaaacttgcttgttggctcaagctagctacttcttctggtgaaatgcctaattgacttgctcgaagcatcgattgcaagccagtcagttgttgttgtatcagtagttgtgtactttgtcctaatgaattttcgctataaagcatcccatttatcttatcattctcagttgagactactaaatacgcatcgattttttcttccgaaagctctttttgtgctttttcttcagaatcaactgctttgaactcaaaatcatctgttttgacttggctcatttgctgactgatttgctcattatcagccaatacgccgattttattgacatcactattttgttgagcaaagtttcctgctacataaatgatacccagcatgataaaagggactaatatcatgatcaagaaagaaatcgacttaacattttttaaatagacatctttggtaataatccaaaacttacgcatcgatttcacctgctttcaatttgaaaatctcttccaaagttggcggttgctggttaaacataggaatgtagccgaactgagtcgcacgagtaaagatttctttcccagcttcaggatcttctaaggtaatctctaacgtattgtcttcatgaaggatcacttttttcacgccttcgatttcttctacttcctgttggcttaaaccagattccaagaataacttcgtacggccaaatgattcacgaatctcatgtacttttccattcaaaaccatttttccgtttcgcaacatgatcaaatgatcgcagattttttctacattatccatattgtggctagaaaaaatgacacatgaaccatgttttttcaattccaatattccatcttttagcaattcagcatttaccggatctaacccgctgaatggctcatccaaaatgatcaatttaggttcatggattaacgtggcgatcagctggactttttgctgatttcctttagacaaagattttactttatccgtctttttcccttttacctgaaatttttccatccaaaaatcgatttttggttcaatctcttttcttgatttccctctaagttctgcaaaataaagcagttggtcttgaatcgttactttcggataaagtccccgttcctccggaagataaccgatgacatcataatctttctccccaagatgatggccattccataacacttctccttggtcttgtgtcaaaaaatccaagatcaaacgaaaagtcgttgtcttcccagccccgttttggccaattagccccatgatttttccatcggggatttggaaagagacatgatcgacagctgtgtagttcccaaaagttttaacaagatccttgacttctaacatttcttcactccttcttcaagaaatcacatatatccttagacaccagacgtaagcgatttattatttaccaacaaaacgtaaacgctctttttgttgtacataaaatgataggacactttactttctttgtaaagtgccctttcctcattcctgatgtaatttatcaaatacgttttgtgcgacatttttcggcagtccgatttcttgtaattcttctgtcgtggctgctgtgatatttttcaacgatttgaactctttaagcagcattttttttcgttttggtcctaacccttcaatttcatctaatcgggaagcaaaactgtttttactgcgtagctgccgatggaaagtgattgcgaatcgatggacttcatcttggattcgctggagtaagaaaaactctggtgaatttcgctcaagcggtactacagccaaatctgtaccgaatagcaactcatttgttttatgtttatcgttttttgccatgccagcaataggaatatcgattcctaattgattttctaagacatcttttgccacatctacttgtccttttcctccatcgatcaagatcaaatcaggtaaaggcaacccttcgcgaatcactcgtgaatatctgcgatagatgacttctctcattgatgcataatcatccggtccgttgactgtttttattttatatttccgatattcttttcttgccggttttccatcaatgaatacgaccatcgcagccacaggattcgtccccatgatattagagttatcaaaagactcgatacgtattggggtcgggatattcatcgcgtttcctaaacgttcaactgctccgatcgtccgttcctgttttctggcaatcagatcaaaccgttcattcaaagcaactgaggcattcttattcgccaattcaactaattttttcttttctcctcgttttggttgcagcactttcgtagctaacaaagcttctacactgggcttgtcgatcgtatcaggaatcaagacttctttaggaatgaaatgctcattttcctgataaaactgaccgaggtaagtcaagaaatcttcttcagcttcgttatagaaaggaaacattgaaacatctcgttcaattagctttccttgtcttacgaaaaacacttggacacacatccatcctttgtcaatcgcataaccaaatacatctcgatccagtaaatcagtatttgtcattttttggcgagtcatgattgtctcaatggcacggatctggtctcggtattctgcagctttttcaaactccatgttttcagcagctttttccattttctgatggatctctgactctattttttcgtgtcctccgtttaaaaagtttttcacttcatcaacgattttcgcatagactttcggatctacgtcgaaataataaggacacagacattgtcccaaatgatagtaaagacaaggctccttcgtctgactaggtttgcattttctcagaggaaataatcgatcgaggatcttctttgtctcattcgccgcaccgacatcgggatatggtccaaaatacagtgctttgtcttttagtaccttacgagtaatcaccaaacggggatatttttcattcgttatcttaaggaaaggataggttttatcatcctttaacataatgttgtatttaggatcatttttctttatcagattgatctctaagagcaatgcttcgatattcgattctgtaacgatgtattcaaagtcttcgatttcactaacaagccgttccgttttcgtattatggctgccagtaaaatatgagcggacacgattttttaatattttggctttgccgacataaatgatcgttccatttttatctttcatcaagtaacagccgggctgatcaggaagtaaagctaatttgtttttgattcgttcgttcatctggtactccccttcatattcaattaaagttattatagcatgtctgtcaaaaaaacaatccagcctgacaacgtaattatactcaaaaaatattaatttgaataaccttaactcaaccgcaaaaaaaccgaggacggaactggattcagtcccaccctcagcttatttttgctttaagtttttataaatattgatcgatcatttgacgtagttgttcttttgaatgaacaccaacagctttttctactacttgaccatcttttttcaacattaatgttggaatgctcatgataccgaattgttgaggagtttctggattttcatccacatccattttagcaattctgaattcttcttcatcatattcttgttccaactgatccaaaatcggtgcttgcatacgacatggaccacaccaagttgcccaaaaatcaatcaatacaagtcctttatctgtttcttcattaaatgtcttatctgtaattacttgtgacatatcaaagacctccatttttaaaatctatgactagtatagcatttctatacttggatagcgaaccatctgcttacctttagtaagctttacttaaatttaacaattgtcgcaccatttccgccttggtttgccggtgcaaactcaaagcttttgacgctccgatggtttttaagataatcagtaattcccttgcgaagtgcgcctgttccttttccgtggacaatagtcacttgaggataaccagctagaatggcagaatccaaatattgatctacctcacttagcgcttcttcgtatcgttttcctcgaaggtccaattgattcggcacgtgactactagattcagatcgtacagcatggataactcgttgtgtcggctctttttgaggagcaacaggcgtcagctcgtcttcggatacattcatttttaatataccgatttctacttgccactgattcccgtttttacgtaaaagcgtccctctttggccgtaagtcgtaaccaacacttcgtctcccggtttcaacgttttttgttctttcgccttcttcaatactttatttttcttcaaagtttcttcttgatgtagatttgctaattgggtctttgcatcgatcaactgatgctctttcacatttccttgcccaatctgctgttgcattttacgaatatcagcaatgattttttctgctttttcttccgcctctgacacgacttcgtttgcttttttctttgctttttccatttctttttcacgttcttcaaagaaatagctgtaagcttctttcaaatcatcgtgaagttcttgtgcctcagaaacaaaatgacgcatttccagatattcggtctctgccattttccggcgattctctaaatctgtgatcatttcgtttaaatcttggctctcatcattcatcaactgcttcgcttcatcaataacttctgtatcaagacctaatcggctagagatttcaaacgcattgcttcgtccaggaacgccaatcagcaaacgatacgttggacttagtgtatccacatcgaactccatgctggcattaatcgtatttgcccgattgtatccataaactttcaattcaggataatgcgttgttgccatcacataagcagactttttaccaagatcatctaagattgcgattgctagagcagcaccttcttgcggatctgttcctgcaccgagctcgtcaaataataccagacttttttcattgacttttgataaaatatctacagtgttcgtcatatgagaagaaaaggtcgatagactttgctcaatcgactgttcgtctcctatatccgcaaatacttcctcaaaaataccgatttgactttcttcgcctgcaggaatcggtaatcctgcttgccccatcagttgtaacagacctaaagtcttcaacgtgatcgttttcccacctgtgttaggtcctgtaatgacgatggcttgatagtcttttccgattgtgatgtcattagaaactactttttcctgatcgatcagtggatgtcttgcttgtttcaagacgacatgattgtcttcactgattcccggcacgatggcttttacttctttaccaaatcgtgcttttgcattcatcagatccattttaccaatcacataagcattgtggatgatttcttgacgatggggaacaagttcagcagaaagttcacttaaaatacgttgaatctcatttcgttcagcgatttggtattgacgcaaacgattattcaaatccaccacttgttttggttcaataaataaagtctgtcctgaagcactttgatcgtggactacaccgccaaatacaccgcggtattcttgtttgactgggataacgtagcggtcatttcgcatggtgatgatcgcatcacttaaatactttgcatttttcccacgaacgatcccatctaactgttcacgaacagcttgttcacttcgccgaatgttctgtcttatgctctttaactcaggagaagcgtcatcagtcacgcgtccgtcttcatcgattgcttcctttaaacggcggctcaaaacagggatcgtgactaactgatctgcccacatatacaaacgtgcaaattcgatttcactgtcagaaagatcattaatgaaacgattcaattcgcttgtcgtagacaatactctggaaacttgtgcaagctccactccattcaagtctgctccgatctcaatccgtttcatatggggacggatattttcaagtttaggtatagggatcccgcctcgcagacgttgcactttcaatccatcctcagtttcttgaagccagtttgtgatcgtttgtttctcactcactggtaccaattctgccagttcttcttttccttgtgcagtcactacaaattgtctgaccatctgtttgactttttcaaattccaatgtttcaaggattcggttattcattttatcaccttatctttcactatgaaaaaagagctgtgccggacatacgctacgcagccttcttaaataaactactctgtacaaaaaacgaaatattttccagcactattttccttaattcaaaatattcgttacccaaagctcatacatcttgttggtaagaaatggcgttctctcaacgataaaacgagcgaaactatgctcgccgaattgattttggaccacatctaatggaacaaaggcaagtaactgcaaaatcaaaaatatagtaacgtaagccatgattagtgacaggatgcctcctgcaatccagtctacctgtctcaagatcggcacatacgtcaatccatggacaaaaacccccacaaatcgggtaagcagccagccaattagcaaaataatcagaaaagcagttcctgcataaaaagcttcatctagatgaaaggcaaatacctgatcaaaaaatgctaactttgatgttggggtgacagctgggtatggaatgtataattccaaatgacttgctaatggtttgtaaaaatgctgggcagcaataaatgacaatacatatccaatcgcgaatatgatttgcaaagcaaacccgcgacgtgctccagaaaaaaacgcaattagcaataaaaataaaatcagcaaactcagcatgctacgttcctttctcttctaacttttttaaatttttcttattttgataaaaggatcttaattagaagatttttgtttaatttgtccttttcgtttctcgtttaaaatctgttgtgcttccacatgatttttaatggtatgatctgcttgaccattttctttcaatacttcccgagcttcgttctcgattgcttcaatgcgtttcacacgattttcaagctctgtaaatttgatcatttttttctttaattctgctgtttcttcttctagctccaagattctttcttgtttcttcaattgatccgaaagcgcattgacagccatcaagattgctgcttgttcattatccatttgtggtgataattgtttcaattctgctaactgttcattgatcagcttcgttacgatatccatatgatgcttggtttcccgtccgataatagtatatgtttggttggcaatcactgctttgtagcgtgttttttcgtgcgccatacgaatcatttcctcctatttgatgaaagttttatttagtgtaccatgaagttggttctttcaccgttctccacaaatatttttcacatacttaactattatatgataaactttaaaaaaatgctatgtctcgcaatctcttagaaaacgaaaagtcgtgagttgcggtatagttttatgtataaaaacgaggagaattttatgagcaacgtcattatcaaagcaacaaacgaccaacttagtcaaatgaaagcatactatcgctcttatttgttaaataaacagattccttatactagctttgctgcaaaaaaagacgggacgaccattaccgcttatacatccggaaaagtgatgtttcaaggtgcgaatgcagcaatagaagctgataaatggggggggggacaggataaacaagccaagccagcaaaaacagcctcttctttgccaaaaaatatcagtcaattatccgttttaggtagtgatgaggtcggaaatggcagctatttcggtccgctaacagtatgtgctgcttatgtgaaacgtgatcagcttgcagaattacgtaaacttggtgttagagattcaaaagagttaaaagatagccaaatcatccagcttgctgacatcttaaaaaaaaccatcccctataaactgcttgtcttatctccagaaaaatacaatgagatccagccaaaatacaatgccgttcggatgaaagtcgctttgcacaatcaagcgatccatctattgttaaaaaaaatcgcaccagaaaaaccagaagcgattttgatcgatcagtttacgccagaagcaaattttaaaaaatatgcgcgtttagaaaaaaatcaattacaagaaaaactgtacttcgttactaaaggagaacaatatcatttagctgttgctgctgcttctatcatcagtcgtgccagctttttggaagagttagacaaagcatcagctgaatctggaatcacccttccgtcaggagctggaacgaaatctgaccaagtagcggcaaaactattggagaaaggcggcatgcctatgcttgaaaaatatgccaaacttcattttgccaatacagaaaaagctttgaagctactaaaaaaataatggaactgtgacaaaagtcatgtcacagtcccttgttccgaataaacggtgttcaatcatctgatcctcggtattagctcaaaaaacggcaaaatatgaggaactatttttccgtttgtttctctaatactcagaacaaaacgttgatttcacaacctttttcttaaacggtgttctcatgccaactcctcggtcacaagtcacaatagtcatcaaacatgagaagctgttttttgaaattgctccttgtgacgcggagttaaacggcaggctcacaacctcttccttaaacggtgttcaaaagcttgcatctgcgataataagcccggccaaacgaaaaatatgaagagctatttttgtttggctgggcttatttattactgaaaataagtggtcaatgcttgtgtcaaacttgcagcaatctgctgctgataactgtctgttactaattcctttaaatcactatcattattcatataacccatctcgattaaaatagaaggttgaagattttctcgaagaacttgatagttcccagtggagattcctcttgaatccagaggcagatcagtgaaggagtcagcaattgtctgtgctaatgtttcctcttgtccatagtaataatatgtcgtgattccagttgcttcattcgcatattccgtagagtctgcgtgtaaactgataaagacatctgcctttttttcttcactgtagtcgcatatatctccaagctgtactaattcatctttagtatgggtcaaataaaccgttgctccagcatcctctagcgccttttttacttttatggctgtacttaatgttatatctttttcttctgtttgttcatcattgcttaatgccccagtatcatttccgccatgcccaggatctaatacaatcactgcatcagatagctcttccggttttgtttgtatattctttgtgactttggttccatcttcgagggctaaatatccagtatagccatcatttgtcttgatctgataagcattttttgtttcagaaagaaactccgccagctctccgccgtttatagttgcaagtggggtagttagcgagtcatctgtatatagtgtacggtcattttttccgattttgattaatgtctcttgttctgtgtcatcaaatgattcctttgtctttgtaaccgtactattcgtactgctgaccgtttgtccaactatctttttttgaccaaaaacatctatttgaaaacagataataatgattgcaaatacaaaagctccaattatttttttcattcttgactctcacctcgtagatccagactaagggtcaaaacttaaaatcagcttaagtacgcaaaaaaggggctgtaaaagatataaccgtagaaaataatattactgctaaaatgatttttttcatttttggcatatcctgaaatctcctttgactattcgtggtgattcatctacccaataaatagtttccttcattctacaaacaattaatttcttcgttattaaattaaaacacttcctggaacaccgacataataaataaaaatataccctgataatcatgagagaataacaaatttgtatttatgaaaaactacctatgtaaaaaaaacaagatataacgatcttcgtcatatcttgcttcttcacctaactatttttctccctatataacagctttacgcttctcctaatacaccattcaaatataaatcgatcaattgcgccacatttagcggttcttccacaggtcttttcgaccgagtgatgtaaggtgctaacactaagaaaaaatgccttgctgcgatttcttttgaaatcccatttcttagcacagattggtttgctgaaaagatttcttcaaaaggttcacgataatttttcttccatagaaagaaaagatgatctcttgtttcctttgaaagattgctttcaagatcgtgaagcatcagaaacaaatcgaccagatgtgtctcaatcaaaaactgcgccatttttgtcaaggtcacttgaaatcccgtttcgcttgtttgaacgatttctctcaaagcttttccaacatcttttaagtggttttctaaaactgccgtatatagtttttctttatcaccgaaataatgatagagattgggctgggtgatcccaactttttgtgcgatctctcttgttgaagtgccgagatatcccttggacataaacaagtcagtcgcttctttcaaaattttttgctgtgtatctttgttgtatcgatggatcatttttccacctgctttttggttattctttttctttcaatacaccatcttccatcataaatattctatcgcatttgtcaatcagccgtgtatcgtgagtaaccatgatcgttgctttatttttgtcttttgattcttttgccaagatatcgactacttctcgtgccttttctgaatccaaactagcagttggttcatctgctagaataatggacggatcattgtacaatgcacgagcgattgcgaccctttgccgttctccaccagatagttcttctggatacttgttgatcaacttatccacgccaagctgctcaaataattcgtttgcttctttttgacgatgttcatgtttgatcttatctactaataataactgcttttttactgtcagaaaaggaaccagattggaagcttgcaaaataaagccaatttctttaaaacgtagtttaacgcgttcactttctttttgattactgaattcttgatcattgataaatacagagccactgctaggcgtctgcaatccgcctgccaaagtcaaaaaagtacttttacctgaaccagaaggaccgatgattgcaacaaattcccctttatcgatactcatggttgtttctttcaatgctttaactacttggtcgccatcttggaaacttttttctacttctttaaattctattgctttcatgctcttcctccttcttatccaattgccttcaacggatcgatttttacgattgtccgaacagaaaatagtgcgcctaacacagctactactaacatcaacaagctaatgacgccaaaaaacagccaattgctttggaatggaaccgcatcaggtagaacaagggatgttcccactgttcctaatagaccaagaagaataccaacaaatgataaaatgaatgtttgtgccactacagaacgcgcaataaatcctcctgtgatcccttgtgctttcattacaccaaagatattaatcttttgcatcgtcagtacataaatgaaaatcccgatcacaatagccgcaataacgatcaaaaatccgatcataaatccaaaagtcaatacttgcgcattatatccaggtaattcattgatgaatttagaaattttgatctgttctaaatcttcaggtaaattactgattttacctctgacaactattgcgttaatccgtgcattttcacttgtatcttctttttcgaagcggatctcttggtaagcattgatggttgtatagagaactggtgagacattgaatttggcatgatccgtaaagccagttagtttaaacgtcttgtcactaccagataacttaactgtatctcctacggctagaccatattcttctttcaaactaatatcgcctactgcctcatcatcgttatcaaaagcttttccttcaacaagattgggcatgatgaattgatttttatcgataccgaagaagctaacattgatttttccttcttctgtactgtctttactagtcacgactccaggtgtctgggcaagatacgccactttcccaccttcgacttcttctgctatcttcttagtaatcatggacatccctagatttgaatttgcatctttcgaaagcacaatcgaatctgcctcccacttgtcgactgctgttcgattatcttgagctaagccataagctaacccagtcaaaaaaaataccaggtaggcgatcaaaaacatcacccctgcaactaacgcataacgtaactttgaatgcataatttcatttaatgctaaaaacatttaactcctcctcctgaaataatcattttatacaacaattttatcacttgataaatttttggcgaatattatgctcaaaaaattcttccgctatttcattatatgaattttttattctcaattgattaatatttattatatccccacacaataaaagaccgtgatatttctcacagtcttttatctactctattgctatttgctctcttagctagtactttaaaagctaactcattgaggtagtgaaaacgagaggtgtattcagacagaaatccaaaatcctcaactgctagctgtggaatcgtagttttgtgtttcacgatatccgcaagcaggttcaaatctgataataagaattcttggcttatcagctgtccgccaattatttctaatgtatccggatggtagatcagctttgcatttactgttttgttttcttcatcgtattgtggaaatagatcaaattctcctgaacacgaaccggtattttgttccaagaatggcgcttcatcttctgtcagccctacagtttctaaaaagtagtctataatgactgctgctgttatcttttgtctgaggtcgtaagcggttggctgaccactcaaagttagcgctactgctcttgccatatgtacagctcgagtaactaaaggtaaaaagagatgccgtttatttttgtcaaaactgactgggacgatatctccaatcgcatagatgtccggatcacttgtctgcagatattcattgactatcacagtctcatcctcatacaaagccactttttcttttaacaatgtcgtattaggacgagtttgggcagaaaaaatgaccatatctgcctttattgcttgagatagaagttgtacggatactactttctcttctgattttttccaatcgatcaagaattcatttggataaaaattgatttgcttagtttgcagctgattttgaaaactgttgatcatatccttatcgaaatatcttgataaaacattcggcatataatcaactagatgaataatgtatcctttatttctcaaagcatctgctaattccaatccaatataaccagcaccgaagatcactacttcttttgcttcttttaaagcggcaagtacttgcttagattgcactagatttttataggtgtagacattttcagcttcaatttgtttatacaaggtgacaggagaggaacctgttgctacgattaatttatcataggttatggtctcgttttttccttctttggatgcgaggatgagctgatgtttgtctggatcaagttcagttactctccatttggtgatcagttttgccccactttcttgaagagtccgcatgttatgggcaacttcagctaaactacgtatctttccttttaaataaaggttgattccatttgaaacatagcctagtccatctttatgatcttcatcgatcagtaaaacttctgctttcggttgaagttttcttagatttagggcagctgtgatgcctgcatgggaagcaccaatgatcacgattttcatgttttattcatccttaaattcaatttttctaaataacattcttttaaaaattggttcaaataggggaaatcataattatattcgttgctagtgaatacaaaaactttagcggacttctgtgacgggtactctttcaattggctagtcaaaatgatatcatactgcttttctttctcgtattcgactaaatcatacttgatcgtattcagcaattgttcctggatgatttctttcacgatatccgccattagcctttcataaggaagatcataagcaatttgcagacgtaattctaactgcttgatcagcgtccgcaaaatagatgcatagcgagaaaataattcaaagcgggcattttcctcgtctacttcagtaaaatcaacaatagcaaatgtttgtctgaccaatctttcacataaaaccaggaattgtttatcttctacttcagttaaccgctgttttaatccttcttggccaaaaatattcatccatcctctaaaataggcaaaatgagcgtgattttgcatcactgtcaacgcaatcttttgcgaaatctcttctggaaaaacataaaaagagaaatattcttctatcgattgtttaaacgttcgattcaattgagctactacgtcgtctttgtatttttcgcttatcaaaaactcctggacatgcgagttatgtgtatctaatgtaaagttactgatcatgaaaagataaaaaaccaacgtttcattttgattccaaggaaaggcatattgaaagaagtaacgggtcaaaaatgtatggaggtccaataaaaattgtgtcgtttgaaacaatccaacaggaagattgctataatctggtttggattttttcgtacagcgcattcgcttcttcataatggaaagccatatttaaaatttcaatcgtccttcttctgtaatagcaaaactaaactctttttgcagcagatctaaaaaagtgtttcctgataaatcactgtattcttttttgttttcaagataaggacgtccaaaccaaaataattggaaataaaaataacgaatttgactttctggaccggtcagccgcccgctttttattttcagatgaaactcatttaaagaatcatttaattccttcactctgcgagacaaagtagccgaactgatattaagttccatgacaagtttctgccgatcaaatgagccattttccaacagataaagaagtatctgatattttgtagaatagcgcaagtagcaatgataataaacatcgactgctgctatatttccatgtctgattaataaaatattcccttcttggataacaatttccaattgtttgatattttccaagttagcttgtaaataaaacagatcttctttcaaggtagcccgatcaactgataagcgggtaagtacgttattaacggaaatctctcctttttcctctaataaaagttggaaaagtttgatttgccgttgttcatttttttcaagcaaactgaaaagttccaagtccactcctccaagcatttctgattttaacagcagaagtttccttctcatccttgaaaaagaggatctgtgacagttatcacagatccatacaaattctaatcacttagctggttggcccagctgtcagttcccatgtgaccatgccttgatacgttgcgccaggttgagcattcgtactgctatttacctctaagagtaaaccatcggtatcgggaaagtcaacgagaacctctcctttagctgttccatcactctcataaatcaacgtgttttgaccttgctgaatcaattgctttgatccagaatgattgaagtataattttgttccgcttaattcttgaccttgattattcttaaataaagaagtcaatgtccctgtcagttgccaaggagacgtgcttggaagccgagtatcccgcacatcaaaagaaaaatcgccttttgcttcataataacttgtcttcaacggtttggggagatcgttaccaaatgtaaaatcatctggtacattaactaatgttaattcttgtttggggacaagaattgttttagcagatgtttggacaactgggttaggaagcttagcaccatctgctaatgtaatattgctggaaagtacagctgcctttgtcagtatgctgacggattgtacagaagtatctacagtatttaattgatagttgtaagtaagatgaatggtatctcctattttgctcaatagatctgctgggacagaaactccttgttgaatgccggtatctgcgatagttgtaccatttaattttaaggaaccattgatataagtagtattttcaggaagtgagatcgtgatttttttgtcggttatcgcatccccagattttgttaacgtgaatgtcacattttcttgaatcgtatctcctgatagagcagacaggggatctcctgtctcaggttgtctactaaggttttttagctgactatctgcactcacagatggaaaattagccactgttatttgaggaagagtggtgattccagcttgttcagactgccatttgtacgcaaaagacggatacatgttagtaagtacatcgtccaccaagcgataatcaaaataatattgccctgaagccaatgcagttagtgtagaagtagctgtatttacacccccgttatttgattgaatcgtttggaaaagttgatctgtccatcctgtcgctaatttttgggttcctttcgaataaagcctggaatggatcgaacccttttttagttcagttgctgaccaattggccgtgacttggtacgatgcagaagaaaggagctttccccactgactatcggctgttaagtttgttggtaaaaccgttccgtctagcttgtactgctccaatacctttaaagcaacaggagaaagcaatccgccttgcgcatctttcccactgtacacgatattggctgtctggttcaatccacttgtgcttgctggagtatgagtcagtgttgctccttgtgtaacgttttttcctgtaaaatagttgactacgcgatcaaagcgactaaatggcaactgatcaaaacgtccttcagacagccccatcgtcaatgtccgactattggtagagcctggaaggttctggttatttccatccacgtattctgtggtatcagcaaatgtattatattttcctgttgaatcacttggtgagatgtaactattccacgtatttatctctgcacttgcagaaaatgcatatactcctggattcaagtttccgccagttaatttaggataaaatctacctgcagctggagctaaaatcgaattgaacatacgatcttggataatattattcgaatcataaaaatcaacagaaaaaacggcctttttcgaaacagaaggctgtaatctgccttttgtcaaaattttgtttgggctcgtatcatatttatctccgttttctgtcatcttcgctacattagctgtaatatcaaattgaagcgggatatcgtccacgttgaattcgcctcgcgtaataatagcaataatatctgctaatagagtattagtatcccacgaccccatcccaaaacgcaaggtatggcttcctgctgataataaacttccgctagtaaccttgatgggggcaccggcaatatacaagtaggcgttgttccagtcaattgcttttaatacatcactgcttgatacatgttccggcaaattgatgatcgccacaaacgcaaatccttgtgcagtaatattcaccaaatcaagtacatttgttagcttcacatggctttcccaatgaaaacggatcgtgccacctttccaaggatcatttgaaccatcgttcaaataagtagcagtcaatttaggcaattggttagccccagttagttggacaagcttcccgccattgactgcactacgtccaccatttggaggtacgatattttcatacgtgtatggatcataagaaatggtaggaggcgttgctccaacagcttctgtcgaaggtgaaaaggtaaatatacttaaaacaaaaaacgaagtaaaaaagaaggagcaaaaaaatgaaaatttattttgtagcaacatgttcatcctccttttcctttcttctccataacaacaaccacgcaagaagccataattctataccaatgatcaaataaagaaaacggatcttttgttcattcgtctccgggaatatgccatgttgattagattctttataaatcggtgactgtgtctgctgttttgatgcgccattgactgaaccacttggatgcggaactggacttagatcataaaatgtaatcgtacctgaacttttggtatctgcttggactggctcttgccagctgaagaacagcaaacttgcaataatccctcccaataagatcgatgttttcaacgaaatcacctcatcatgttgtttctccttttttcttgtggacccacaaaaacagcaaaattaacaataacactagaactgcagcaaccaatcctgcataaagccatgggaaagattgttcttgtactgcaaaaacggaattttcatttactttttgtgctttttctttttcgatcgtaaagttttgtgtaaatcgccattcattactgtcgcctgattttgctatgatttctgcgcggtaatcgccggcttttgctttatcaccagctaaatcaagattcaagtgaaaattcgaatttggtgcaactaaaaatgcattagacgtattttcaatataaagctgattttcataaaagatcttgctcgtaaatatcaaattgctgataatcctaggctgaggattttggaaacgaagctgaacagttggctttgcgttgacctcgtccaaatctcctgataaaagtttcagatccggttctatcgtctcttgactttcttgtaaaacgactgcgagattataagcaatacgatttttgatttgtgctccttctgtagcattttctgtttcagcttcttctttaggtgaaacatgaatacccgctaatacacgtcccttaaagctttttgctgggattttcacttctataggtacagttgtttctgcatgtgctgatacattgatttcctttttcgcaatgagcaaaacgtcacggacatcaaacggcaatgtctcatctaacgttggttttttttgactataatcgatcgttccaccatcactcgttaccgccggattgacagagacctcaaatgttcgttcttcatctgaagaattgctgataattacttctagtatctgattttgttccggtgccactaataaatcaaaataaccgattgctttatctatttgattctctggaaataccggtttgatcccaaagtctcctgctgaatcttctgctttactgattgacggaaaaatgaaaaatagacttaaaatagaaaaaaacgaaacaaacagtcgtttactttgattcattgtccaccacatcctttcaacaacaactgcggtaaaagatccttcacctatagtattttcaccgcagtttgttgaatttatttcatactctatgctactgggccagccacgaggttccaagtcaaatcagccgtgaatgttccagctgctgctttcggcactttcagtgtgatatttgctggatcataaacagaaagccatgttcccagaccttgatcttttgctgctgtaaatattggtgtcgctgcacttgctttactcaacccagttacagtttgactagttggtccagtggattcgttatctgacgtacttttaacagtggatgttccaaaatctaattcagcgccttgcaaaacttgtgaaccgtttacaaaatctgaaaccgaaactgtcacgttccacccttgtgcttggccatctgcacctacaccacgacgatctgatacttgaagataaggtgtatcgttttttgaagcgtctacttgatacgtttttgttccgctttcaatctcgtgtgtaccaaatggcaattcgggaactacatccagtgttaaaggacctgtctggccagttgctggattttccggatctgctggctctactggttttgaaggatcagtagggttaagaggctccacggtatttgttggttcagtaaaggtaatatctccttttgaagtcgcttgaccctcagcaaaagctggtgttgccaagccgcctagaagaagtattgaaagtaataatatcccaatcatgttctttttcataataaatcactcctttttcttagtgacctaagtatagtagagacagtatgcaaaaaatcctcatgaattcatccgtttacttgaaattatgaccctttttgtataaaaaagaaaaaaacaataaaatcgtttacatgaatattcttccttttttattaagtatgaaaaaatatttcaattttattttttcgtttcaaattattctattagtgacatccttgaactataaaaataggagtacggcatcatctgccgcactcctatttgttttcgtcatttgtttcttaaataaaacgattctcacgcaattttatttttttgatatcttctactgtttgtgttccagctaattgcatgaccatttccaattctgttttaaagaaatcaaacacttgatggactcctgtacttcctcctaaagacaatccataaataacgggtctgccaatagcaacaagatcggcacctgatgcgattgctttgaaaacatgttgtccacgtcgtacaccgctgtcaaacacgattggtacacgtttatctactgcttctgccacatattgcaacgaatcaaacgcagcaggcccaccatctaattgacggccaccatgattagatacccaaattccaccagcaccagattctaatgatcgatagacatcttcttctgattgaacacctttcacgtagactggcaaatcagaatgagcagcaataaattctacatcttttggactaagtttttgtttggaagatttatatacagcatccatcgtttggcctactcctgattgataagcctgaacgatcggcattggcagcgggaaggtaaacccatttctgcggtctgtttcacggtttccgccaactgttgcatccgctgtcaatacgattgcttttgctccattacgcttggccacttcaagaatatccaaattgattccattatctttgctcatataaaattgaaaccattgcggtgctttccccccgcctgcttctcttatctcttctaaagtacaagaagcgtaagaacttgctgtatagagcgtcccaaaatctgctacaccttttgcagaagctttctccgccttcacatgagctaatccatgagcagcaactggtgccatgatgattggtgcagtcagcgtttcttcatcaaaatgtgtagttgtatcgggtaattctacatctcttaatacatgaggaataatcaaacgatgattgaatgcccgttcattttcttgataagtaaataagtcgccagcaccactgctgatgtaaccataaccaccagctgggattacttgtgaagccgcgatttctaaatcttccatattgataaaatctactattccttcatttgtacctgcttgatatattttttccatctcaatgccttctctctataaaaattgaatgacaaacaatatgatagcgtttacactttttatattactcttcgacattgatacaggcaaataatctgtttacatttcagccattccagatgtcactactatggaagaaatgattataataaaaatagataaaaagccgatgggactttgacaaaagtcgtgtcaaagtccctttttttgaataaacagtgttcaaaagccagtttctcggtattaagtcaaatttatgcaaaaatgtggaaagccattttcacaaaatttttcttactactcgaaactaagcgactttttcacaacctctcgataaaacggtgttcctttttcatcaacatttttacgaaatactgtggaagactattgaaataagtgtggattgtttctttgtgtttcaatcgtttcttgccattcttcatttaattttagatcaccgttttcttccttgaactcataaggtcctaattcaaaaagcccagtcagtatttgattcacgatttcatatagttcagtgtgatcagacacatgattcttgaagatcatctcattatcaccacgtttgaacctcacattcgggctctcatgatgaacctctatgcatttttctcctttttttaactgacggacttctgaaaacatctcataaatatcttctccagtaaaaccttcagcaagcgccagactgtccacaagaccgcctactgtcagttcagagattattgcttgattggaatctaattttaatgtatagcttgtcgcttctactacgccacatgcattgcaaccgccttctgatagttcgctttttctgatcaattgaacttcttgcattttctgttcctcctcttaattttctacttatgtatttttatcacctgacataggtgactcctatcaacgctatcatgtgcttttttcctcagaaatcctatttatccattccatctatcccttattcttctacttttctttctctagcatataagagatacgcatagtattcaagcaaggattgtcgatataaaaagaacaaatactgctattttgatttcttttggctatattacatataaataaaatttatcatacctgctctttttgactatatcatcatctgacttctatacttcgtttgtattaaaacttaggaggaatcattcatgcttacagggttaaacttattaaataatccttttctaaataaaggaacagcttttacaaaagaagaacgggcaaaatatggaatcactggtatgcttccaagtactgtccaaacactggaacaacaatctgttcaagcttatggtcaatacttaagcaaacaaacagatttggaaaaacgtatcttcttaatgaatctattcaatacgaatcggacattgttttataaattgatgggcgaacatttagttgaattcatgcctgtcgtttatgatcctgtcgttgcggattcaatcgaacaatacaacgaaattttcttgaaaccgcaagatgctgcatttctttcaatcgacgaaccagaaaacatcaaagcaagtttgaagaacgcggcagatggacgagacattcgtttgattgttgtgactgatgcagaaggaatcttaggtatgggcgactggggtgtgaacggtgttgacatcgctatcggcaaattgatggtctatactgctgctgctggtattaatccagcacaagttttgcctgtatcgatcgacgctggtactaataatgaagaattattgaataatcccttatacttaggcaatcgtcatgctcgtgtagaaggcgaaacttactatgaattcatcgatcaattcgttcaatcagctaccgaattattcccagaattgttattgcattgggaagattttggacgaggaaatgctgcagcgatcttagaaaaatacgaagatcaaatcactactttcaacgacgatatccaaggtacaggaattgttgtcctagcaggtgtattaggcggattgaatatatccggtgaacaattgaaagatcaaataattttgacatttggtgctggtactgctggtgtgggtatcgcaaacatccttttagatgagatgatccgtcaaggtgtacctgaagaagaagcacgccaacatttctatcaagtagataaacaaggtttattgtttgaagatacagaaggattgactcctggtcaaatcccattcgctcgcaaacgctcagaattcactaatgctgatgaattgacaaacttagaagcagttgtaaaagcgatccatccgacaatcatgattggtacttctacccaacctggagcattcactgaagaaatcgtgaaagaaatggctgctcatacaccacgtccgatcatcatgcctttgtctaatccaacaaaattagcagaagcaaaagcaaaagatttaatagaatggacggacggaaaagcattagttggaacaggtatccctgccgctgatgttgaatataatggtgtaacttaccaaatcggtcaagcaaataatgctttgatgtacccaggtttaggacttggtttgattgcttcaacagctacacgagtaaatgctgaaatcatttctcaagctagtcgagcattaggcggaatcgttgatgtaacaaaaccaggagcagctatcttgcctccagtagcaaaaatcactgaattttctcaaacgattgctgaaactgtcgcaaaatcagttgtcgcacaaaacttgaatcgtgaagaaatcacggatatcaaagaagcagttgaatctgctaaatgggttcctgaatataaatctttagaagattaagatcgttatagtaaaagaacatacagaaactttgtatgacgtctaaaaagaaaaaagcgactgcggcaaaacagcggccagccaactcctgctcttttgccgcttttctttggcttttttcatacgatacagaataagaaaggatctgtaaaaatggcacaaaaaaaaacaactgcaactgcagttgaggaaaagaaaaaagaaggtttttggtccacaaaaatcaccggcgtaagtttgccactttatttgatcatggtccttgtcctgatcattgcaatggctttagggaaattaccgacgaatatgattggaccaatcgcagttttggttattttcggtaatttatttcattttatcgggacaaaaatccctatcgtcaaaagttatttgggtggaggttccgtttttgcgatcttcgcttctgctgcgattgctacatttgggatcttacctgaatatgtagtgaaatccacagaaaactttgtcagcaatatgggctttttggacttttatattgctgccttgattactggtagcatccttggtatgaaccgtaatctattgatgaaagcttctgttcgttttattcccgttgcacttatttcaatggtcgtctccttttttgccgtaggactcgtgggcatgcttatcggaaatggttttgcaaattccgttttatacatctcattacctgcgatggctggtggtgttggagccggagccgttcctttatcaacgatttatgcaaatgttttaggtacggatgcttcttctatcatttcccgcctgattcctgctacagcaatgacaaatgtcttagctatcatcggtgcagcattagttgctcgtgctggacaatcaatgccaaaattcaacggcaatggtaaattaatggaaaaaggcgatcttggcgatggaaaacctcgaactgtgaaaccttccattccacagttaggtgttggtttgatggtatcattgactttcttcatcttaggacaaattggtaactattttgttcctaaagtccatgcatacgcatttatgattattatcgttgtcatctgtaaaatcgccaacctattaccagaatattatgaagatgcagctatcatgttcaataacttgattgtcaaaaacttgacagcagctgttcttgccggtatcggtattgcgttgctgaatctgaatgtattagcttctgctttgacatggcaatttgttgtcttatgtctgacaagtgttatcgcgatttcagttgtttcaggatttgtcggtcgtttgtttggtttatatccaattgaatcaactattactgctggcttatgcaacaactcgatgggcggaacaggaaatgtagccgtcttatctgcagctaatcggatggaacttattgcttttgctcaaatgggcaatcgacttggtggtgccatcgttttgatcatctctggtttcttgatgcaattactttcttagtcaaaaaaacaaaaatacctgatcatcaagtatccgcttgatgatcgggtatttttttgataaagatttacaggattttcaaaaatcttttttgcattttatcggaatgataaccgatgtgttcataaaattggtgtgcttctactctgtattctgcagaattaagccttattgccgttattcctcgttttttcgcttcttcttctacgccagtcatcaaagcctttccgatgcctcttttttcagcatatttagacacagcaagtgccataatattgaacattggatcgctaaaaatcgattcataggactccgcttgtacatagccagctgcttttttagaagtaggatcttcataaaccaagaaaaaatttttctctggctccttcagcagtttcttcatttgtctcaccgtaacggttaatggtatatcataccctaattgatccgcattgatttcacgtagtgcttctgcatcttctaaacgcatttcccgtaacatccaaatcaccagccaatttctgattttttaaaatgaatttttttatcatagtatactttttttttcatttagaacaatatgtttcagtgattttgacttgcgttagtctagattctcctaatgtttgtaagatgacaaaggcattgtaacaattgaccaaaagaaccacgaggacaattacttgaaaaataaaggtcactttttttggagacaaaatcctgctaaattttgctccccacaaacctccaataacagcagcggggataatataaaacaacatagataaatcaaagcgcataaagccacttgttaaagcaatcgttaccaatttagccagttgagaaaagaaaatcgtagatagagaatacagcgttgcttcttttattggcaaagcaaacatcagcatcagtaatgaaacattgatgggtccaccaccgatacctaaaaagctagctaaaaagcccaagatccccccacatataagataccaaatccatgacgttagatgaaattttggctgatgatgcttggtgtagaagaacgcaaaaaccaaggtcaataccgtcaagaaaatttggatcagctgcacatgcttttcattttcaaacaaccgtaaaaaaacttcgaatacaatgttaccggctattcctccaactacagctccaccagatacccaaccgacaatctgccaattcagcgatttcccacttgatacttgtcgcactgtcgaaacaatagacatcgtgaataccgcaaccgttgagtaaaaagaaatacctgcaatagaatgggcaccgataagatcaagaatcggtttgatcaacacgcctccgcccatgccggaaatagcgccaactgtatttgccagaacgatcaccacaaaataaatcagaccaatcatatcatcttgtatatcctttctcttatttatatcttttagcgatttttactctttgcttatattatacagtaaaagaaacgaacgaggcttcgaaagcttttctactttttaaggaaatgtagtactaaacgaaaagaggttgtgaaaaagctgtcctgcatcaagtaataagaacagccaaacaaaaatagctcctcctatttttcgtttggttgaacttattaccgcagatgcaagcttttgaacaccgtttaagaaagaggtcgtgagcctgccgttcagctttgagtcacaaggaacaatttcaaaaaacagcttctcatgtttgttgaatattgtgacttgtgaccgaggagttggcaggagaacaccgtttaaggaagagactgtgaagtcaacgttttgacctgattattagagaaacaaatggcaaaatagttcttcatatttcgccgtttttcgagcgaatgccgaggggcagctgattgaacatcgtttatttggaaaaagggattgtgacaagacgtttgtcacaatccctttttttatatcttattaattcattcattcttttgttctattcttcttcttcagccatgaatatctgttgatttaccaagcttttcattgctattaaagtctgataatttttatcagtaataacatatcgctttaatagtattttagatattttaaatagaacctgggtcaaattcttggtcaaaaaacttcatctaacgtggggcgttttttatcaaaaaattttcaaagcagttttccaattctctttaaaaccattctcttcacaattaaataagccatcgctatcttcaattaattcagataaattgtctataaataaattccattcatcttgaatagcccgatctggaagaaaagaaaaaagctttttctctgtaaacaacattacaaataaattatctttctttgacttttttatattatattcaattaaatcctctctaggcaaagaaggaaaaaccacaaaccttttactataaaatcttgcgtggtgagcagtcatatttctgatgtatctagcaacaccaacccaactaacaacaaattttctgtattgtttcccaaaaactttatcgatccacatatttttataatcaggcttcaactgagatataaatgtatctatttgtccaaaagttaactcctcaatcagaacccacacagggatacaaccatttttttccttgtgatgatacttaatatacggctctttacttcgagtaactgtttcagcaaaactcgctaaagtctcttttcctagttcctctttaccataaatatttaaatcaagataaaattcagcctgtcggtattcatcagaaatatagttattactgattacattagcaagagaggtttttatccactcctctaaaattcctgaaaaatggcttaattgcatccttatgtatttatccacattgtacaaatataaaacatttgaaaaagttcttttattatcctcaactactaacctagggaaaattgagaatctataataatttgtatatttaaaaaagttaagtgcctgctgcttttctgcagaagaaaataaaaccttatgaccataatcttctttttgaagaatatcaataaattcttgcccttccttgggttctttcattacctcaccgacatcaacactttttttaaaataagtgtaatccaactcactattttttttagccagttttaatatatttttgatataaattaattgattatataaaaacaatgcgctttcacctcaatacaaaaaaagactcgccgtggtccgctggtttccctcgcgtggcaagttctggtaataaaaatatatcattaaacacagtaattgtcaatgatgatcctaaaaaatattattttccattaaacaccttctacctttcactttcttcctgttaaaattgtcctcctaattgcgattgaataaaaacccgacaagtgacttgcgcttcaatacgagctaatttgtttggcttaatttgtatcgtgtgacttccacgctgtatttgtccactacttgtttttttcaaatagtcgactaaattcaatctactttggctggtttcatgatgcgggattgttttcccatcaacgacaatatccacgcttgaaggtgaatcacttgcttgaaaaattccccactctaacggatgtgtgtgttctggaagcaccacattatgtttatgacttggaattttcactgtatgcgtatggttcggtatatttacgctatgtgtatgattgggaatattgacgctatgggcatggcttggaatagaaacattatgcgtatgcgctggcacattgattgtaaaattatgcgaatgatttggaatacttacagtatgcgtatgattatccgcagcttctgccgtatatatttcctttggcgaaccttgtaattgtagaaggctactaccatacgcttcatacattgttgtctgaactggtcctggtttattagttggactaaacatcatgtgccggtgtgtaccatttgcactagaggtttgtgttgagcctcctcccacacttgttgacgatccttgataagaaccaccaccagagccagatgttgtgactccgcctccgccagctgtagtcgattgaacggatccaccaccggccgagcttgtttgacgactgccaccaccagccgaacttgtttgtgtggattggccccctgcttcactcgtgattgttttcgaccctccgcctttaacggcttttgtatatccacggtattttttcgttttgaaagttaactctaccgtgttgacatgaaatacatcatcatcgagatagaactcaatttctgcaggatacgccgattcgcaattgtcctggtatgagtaattcaaaatattcgttgcaccttgcgagtacgtctcattaatctgctgtttacgactaagatctgacatcgttgtactgatatcatctttcagatttcctagttctaattgaatggactgcggtgcgccgaacacatctgatttgctttcttttttaattcttaggttaaatgatccatactcatttgtattgatcattacgactgtgccttgacgtaatttgtcgatgtctaaaggtgtatctgtcaatttgattaaatcagcagcagaaaccttccatgatactttgggaattgaccacttttttagcatgctaatcgcattgtctttcagtgcttgagcaatagtaaaacgttgatccacccaaacgtactcgatcaatccgtatttctttatcgaatcagtatcttcaacatatggaatattattattgactgatttaatattcagttgattcacgccttcaccagcgccgagcggatagactcgattgactaaattgttcggatcggtctcaatttcaaatccttccatgttatagccttcttgaatccggcaaatcggttctgtcggtggtcttacaagcgataactcaaatggatagacttgtgtgttccatgtccacatataatcttcatcaaaagctttcggtatagaaaacaacgcatcagccaacccattttcgttctcccaggcatagctgaaatatcgagtgaattcacatttttttaaaactcaatgctttgttttctgctgattcaatacatagttgatcacgtcggtagttgttcggttgactaactcatggtaaccaaaaaggacactatccagtaatgtccctaacacatgcatcgctgtgtatttgatggaatagttgcttggatctttttggatcgtcgatggcataatacgatacaagccaatatactcgttctcgttgtcggttaactcaacgtactgcagcgcttggatcattgaattttttgtgtcataaagcggcatagtaaattcaatggatccaatctcattttctatttttacataactcacgtcgtaagcattctccaaaattgcagtgtactcacgactgagattcattgtcattaacatattattcctcctttttttcatttaattgctcttttaaaagttcgcgcgagaaaaaatgtacagtgactgcgtgaagtacgaagcaaccaccggtgggggaggtatgcccccactcagcttttttcttgcgtcactattttttgatcaataagttagaaatagcgtttgtataattatgtttttatttattcttgattattcattcctcgaaggttcgtaagcatatttttataagctttttccttctgtttggtagcttcagacttcacgcctttgcgctcatatttggattcaatatccgcgacagacttcgctttttcggcttcaatttctgtaactctttttctttcgttttctttgcgttctgataatatggctttagcaaataaattatttaattcatcttgtttctttttgctacgctcagtttgtgcatttaaactagtgcgaaactgttctgatttctttttattttctttatcaactttctcttgcatacctttgatatcaatgtatttcttgtctgtcatgtttgtatacctccttatttaaacccaataattacggtttgactgtggttcttctccggccatttttgataatgatgttccgtaaattttactttggtagaaattatgaacagtatcaactttgttgtattctttgtcagatgaccaggttgtagttccatccccatttggaattttcccttttggttctttgtatatttcacgttgtaattgatgcatcagcttattggcttggtcctgtgtttgaacagattcttttgaaatatttcgcaattcgctgattaataccgctgcacgttcgttttgctcctcatgtattgtgtttgcagcttgagtaatcttagttaatagcttattgtattctgacttactgattaaaggttcacacttaagtttatctagttgtttttgatacagttccttcgcatgatttgcagcccaaatggtatcttttgccttgttgtatcgttccacatctacttctgtttctgctacaatcaactcttcgtttgctttttgaatggtttgttctgtttttcgaatattctctttggttgctgctacttcttttttattctccgctgttttttctgttaaatatgtttggatctcgtttaatgttttcatttaaatttctccttagttttaaatatttttttgttttactgagaccttatcaaaaccgagtaacaacaaatcaaaaaacaatccttgtttgtcttctgtctgatcaaaaattcttgcttcctctttagttcctagaatatattgctgttcgtttgtgttttgattgatgaaatccaccaagtataatcttgtattgacacgaaactgaaaagaatcacctatttgatttaaaatattctgcatagccttttttaagctcatttgcgctagtcgtctcatattgcgaaaacgatctatcgttacaccataatttttagctaggacttcatcttttacaggaatcaatgaatggtaatgtcctgttttttccctaaatgtacatggctgttttgagtaataataggcatccgataaaatttggcgttcctgttcatctaactgttttaaagcattgaaaaatacttttgcttgttctagttcaacttctgataattcatgccttgctgcttcgtagtactgccacttcttcagataataaacgggtcgaatagtatcatattgcaaagaaatcacacatcctttctaaattttcctcggcatcttctaagatttcattattttcgttgtccggttcaattccttctctaaagcatatagctgtttctatctcattgatttcatctaagaccttctcaatgaggcattgagggcacataactgtattagggtttatatatcgcttaatcagaaaagaacgctctaaagatgtaagactagcccaaaataccttgaaatgcttttgcctaaacaaataccgatcaatccgacgatctaaagcatctatattggttagcagcttctcaacttctcgatctggtcggaatccttttacaatcatttcataggtatcttttcttactctgtgatactccatgtgagtagccatattttgactgtaaaactcttgtctgagttgtttcctttttagttctaagcggtgtacctggagcgacagggagagatatttttttatggcaatttcatcaaatgaatccaccgcttaacctcctcttattttgatagctgatttaccgtatttgtcacgttttgtaacgtcctttttggctctactttctttatttgatactattttctgtacgttacagtttggctcagatttgagcctatctagttctgttgctttataggtcggcataattttgtgccacccctttttaggtctgtccaaaattggacacatctttcacatcagctgaattttcagccgatctttttttaatcggggggattttccgcctatctcttttttaagacggaagaaacggaagttttccctctttttcaggcggcggaaatgtcggatttttatgaaataaaaagaggacacaaggggtaagccgaaaattcggccaacctctcatatcctctggttcttcctagtaagataaaaatattaaaatattatactgcattcaaatacataactctaaaatagtaagatatacgttttttaactatactcattataccattttagcactttaattggctatttttcactgattttatgggatgtaatcacatcatatttgactacttttccatctttgacgatcagcttcacttctccgtatgttggtaactcgactacctctggtcgtttattgttgtcaatatatactttatccacttctttctccttctcttacaatattttttctacagatcgtaccaaatagaaatgactgtatttgtctcaaagctgtctgcttcgccatctgatgcactactttgtagaatatggcgtactttgatgccataattttcacgaagaaaatcatttactttctcttctaatgtctccgtgtatggcgatttttgagtagtataattatttgatccttcaatgatttttactttcatattgtgcccccataacttcgtttttaattatctacctgtctgtctacctcctgtctacttgtctacctttttccgcatgtatcctgtgttcgcttgtttcccgaacctaatcccattctttttggactttatccaatccgggtggttatccatgactacccggacttttgcatctagtctcgtgtcgtcgcaaaaaactagtgtacccctaataggaattaaaaatacttgtaccatctgtaccacaactcatgaacattgatatatagccattttcaagaggattgattccgcttttattacgatttcacttgtaccaccgcttgtaccatcattaagtggtacggatagtggtacgggcataaactaaaaatattagtgtttcgtccatgcacaaacattggtatatcagcatttgcaagtagcggtacaactggtacaacgtttttcaactatttattaaggtagacttattcaatgtatgaatttttcattttcaagtgaatatagcgccaaattctcgttccgttttgtcttgtatttttcttataaatacccatcttctcaagttgcttactaaacttaggttgtgacaattcacgtaaactttcttgataacagaatttttgatattcttcgtaaattgttttggaagaatcaccttcactggattccatatcaatactgcatttttcctcaatgaaccgtagtatatgattagattctttcaaccatttatctttggcttggatcatcttatctgatacagtcaattctttacgttctaatgcgtctttgaagacattcatacaataaactgcaaacactggtatttccgcttcaattgccttcaagtcatgcctagctttgaacgcttcatctatgacacaatcaaatggaacaacgtatagtctacgttcaaatcctcgtgtgaagtcattaaacgctggtaactcattcgctgaaaatataagttttgcaaagttcacaaacataaaatggtcttttcctttaaactcagcagataagcgatctccaccagttaaggctttgagtagtcctgttgacttgagaaattcagaatcaacatccgcaaataaattggcttctttctgaaataggttagcactggcaaagcgattttgtttatttcctaaatcttgcaacgtcatattgcttacattttcagaacccagtaactgattaaggatatttaagaaagtagatttaccgttttctcccgtaccttgtaagatagtgattgtttgaaatggtgcataacttctataaaagcagtagcctataatctccaccaaatgttttgcactatcagaatgacctgttaaatcctctagccatccaattgtttttgtaggtactttctttgtggttggatcaattgcgtagttatgactttgcagaatgtaatctttcgtatcgtgcggcttcatttcaccggttttaatattgtaagtgccattcttaaaattagttaggtatggcttgctacggttaaaagggttctctttcatggtagaatcaaaaatcttgataaagataaacttctttgtttcgtacagttttgattgcgaccactggcccacgctttctaatttcttagtgatatgaccgtctaaaaaatcgcttaaactatccatacgccaagaacctgtttttgaatcgaatctagcgccttgtgataattcactagtacgaatcattggtatttccttcataatctcataacctaattttgaagcactaaccttcatatttcttttatcatcaaaatatatccaagctggcaattccttgttttcctgttgctttttcttttgcaactccattaactctattagctcactcaattagcgcccaactcctttttcgctatcgaatagaaagtttcctccacttctttttctgataacggttctgtaaaatgctgattggcaattttcaccagttctaacactgcccctacatctacagcacgagccagcaaaccaccagttatttgtgcaatacgattattgcgatttccttcctcacaacctgtcacaatactttcaaataattcagtcgtggtattccgataacgtgaaccgccttttttgaattgacttgtgtttttgtacaatttacgtgaagttacgccacctgtgtcttgcttgtaatcttttagccaacgttttgcggtatctaagccatcagatacgggaaataagttttctccgttatggataataatttgttcttccttaatgtattgtgtcaatactggtagtaattgtatttgcgaccaagtcaggttagattgatctgcattgttaataattccttctagtatcttgtttgtaaagaaataaactagtaatttgtactcttgttcattcactggcttatccaatggaatgactaaacgatagcgtacgccttttaatccgtgactaatactcggataaagaacataagcaaacttgcctagtttttgtttgatagtatctatcaaattaacttcagatacaatcacatcatctaaatctaaaattaaacaatctcgactgattaaattctcattcttacgtattaaggctttcatttcaccagctataaacccatctatgccaatcatttttagctttttctgttcttcggaatcattagaaactttgattttaagcggtgcataatcagaaaaaaactgaataacagttttatcaatcggtggttccataatactaggacgcactttacctatataaatcattgcttgtacctcctacatgtctctcatactcccaaaaatcaaaggccaaaaacaaacatacagcaataggtactacacaaatcagccataaaataaaaggtaacagcttagtgagcgatccaaaaagaaaggctagtaaaaacagatttctacgcttactcatttacaggaacctcactttcaaaatgaacaatatcatccgagtgttgctttgctaaacatgctacagctgcaatcattccatttaaaatatttaagtcatttctttttaaagagtttactgtgagttcacttgcaaaaaggcccaagccttctaaggcgcttgcaatatttgtagaatctattactaaatcaactggatcgattatttttttattcattttgttttattcctccattcgtttgtgttagaatgaaggcagaaataggctgtattagccgttgtgatgcctttaacgttcgctttggtcggtggaatcgttaaggctttttttctgcctttattcatacatttactccttcatcctttggtaggcacgttaccttcttgatctggctcaatccccaatagttcatacaggtcatacaatgttatggtactcaagtactccgctgcacttttcgcacgctctaaagctgtttcagtagtatctttaccatttagagcacatggatattctttgtcatctagagttgctatatccatcagaatgtcatccatttcacccaataaactttttactgtaacctgtggctttgttaattcgccctgttcatgtatttcttgtaataatttatctgttttatcttgcatactgaatcctcctagaatataattcattaacaacaactgcttgacttctacgacttccaattatgtgccctcagtttgatgagatgttcctcgccccacgcttggattttttatttcttgtgtttctctaaaaactcgtcagcatctcgctgatcaattttttcatagccatccatcaatatgacctttaatccttgtttctcaatgaaattgtatttcagtgtattgtagcttgtattcatatacttagctgcttgcttataattcataaagcgaggaagcagtagctttttcttgtattcttcgataaactgaaaagcttgttgcttaccctcttttgcagccgtttcacgtataacctcacgcaacgtaacagataaatctaattcatctatacttaatttagccatttaaatcacctccccaaaatctccctaatgagccatttcaggcattttaagcgtggtttgatacaagacaatccccacgtttaaaatatccctaatctcatcataggaacgccctaattgaataagactcgatactaattcttcaatttgattaacagccgcttgttctttagttgtaaggaaatctaacggggttgctttagctttagcgtttgcttctctcgcttcacgtaattgtttagcattgaagcccaatgctttcttataaactaaatcagtaaaatgtttataaaaatgaccactaaatccagcttctttaattgcatctgtcatagaacaccgtatttgtttacctttggttcgttctaaccttcttgccattagctctttttccatctcataaaattgtttaaccaattcttttttaaactttctaactggttcggtgttatcaagataggtaataagcagtgttgcttgttgctgattaagatggaacacttttgctttttgaccacttggcataggtcggatttcaaatccgagcgttccaaactcttctaaatcaccttgatattttcttattagacgtgtaacactttctctactattacctgaatattcagcgataacttcatctgtagtaaatggatcattgttcaggttatctgattgtagaaatactaagtctttcatttctagccctccttacgctctgctaacagatcatcgatcgccttttctacacgctgtttacgatcttcacgcatttctgtacgtaaccatacagacaaattactttgggcgattcctactttttctgccacctcccagtataggaatcggtttgcttcgattctttctctgatttttccatttgcttttttcatttactcaccgccttttattgaataaatcaatattattactttttatttataatgtcaatcgtaaatattgtttttattgatattaactattattagtaataaaatggtgttaaaggaggtttttttatggaagaaaacaagttcagaatatcccctagcgaaattgactacaaagaaagttttgggaagcagcttaattatttacgtaaacagtgggcaaaaatgaccatgattgaattatcaaaaaggtctcatctatctcagtcttatatttctcaattagaaaacgggaaaaatccatccttagatgcactagaaaaattagcctggggattgtcgcgcgcaaacttagaaacacatactttcgaaaaagatacccaactttacgaatttttattgtattacgaggtattaactgttcgtctaaatgatgaaaggcagacagaatttaaaaaatctatagacaacgtaatttctcatttacctacagaagatgctagacgtttagaaggcattaaaaataagcttttgagagcaaacaaaatttcatttaaagaaatcaatctaaatgaaattttttcagataactcaccaataaaaataactttgaacggactatatccattagatagcgaaacaaaaaatgcttttaaacttttaactattggagctattgaaaaactaaaaaagaaagaagaaaattagtccctacataccaaacgccccacgttaggtactgggaggaaaaacaatggcaacatttaaacaatacgaaaagaaaaacggtacaaaagcatggctctttaagggctaccttggtactgaccctataacaggaaaagaaatacacaccacaagacgtggcttcagcacaaaaaaagaagccaagctagccctatcacggctaaaacttgactatgaagaaaacggcttgcaaaaagatgaaaaagagactttcaaacaagtatatgaattgtggcttgaaacatataaaacgactgttaaggaagtaacatttattaaaactgaaatcaagtttaacaaatggattttaccggtatatggtgatttacgaattaaagaggttactgtaaagcgagcgcaacaaatcgttaatgattgggcaaagaaaaccgatcaatataaagttttacattctactgcaaaacggatttttgagtatgctatcaatctgggtataatacaatacaaccctttagctcatatcatgatgccaaaacgtgaaaagaaagtcactgatagcggtgttattaaggtatacactaaagaacagctaaagacattgtttgcttatgtaaactcattaaagccaaactacagcaatgactataacaaaacattgttacgctttttattctacagtggctgccgaatcagtgaagccctagctctcaattggtcagatatagactttgaaggtaataatgttcttatcaacaaaactttgagtcaaacaaaacacggctataaaattagtgatcctaaaacagacaaaagcgctgctaaggttactcttgattctgaaacaattaaaatcctaaagaaatggcagattaatcagcgcaagtatatgcttaatcttggtattacggatccaacaatgattttctgtggtatctataaacaaatgattacccatcatgctattttctctcgcatgaaaacaatcacagaaaaatgtggggttccattcctaggtatccatgttacacgacacactcatgctagcatgttattagatgctggagcagacataaaagaagttcaagaccgactacgtcacgcatctataagtatgactatggatacctatgggcaccttagcaaagagactagagataaagctattgaaaagcttgtagcacatctaaatttctaattatcttggtcaatttcttggtcaaaagaaaaataaaaaaggagaaaccctgccataacaaggtttctcccattctttggaactattcttcttcttcagccatgaatgtattgaatacttcttcaatcatgtcccattctgcgtctgtttcgatttgttctaactcgccttctgttccatcttcgttttcgatgtatgcataagcttgtaattctacatcttcatcttctgaaacaccagcaggatataaaagaacatagttacgtccaaattcttcttgtccgtcaactgttagtaggatttcatataatgtttcatttccttggtcatccaccaatgtgatgtgttcgtgtccttcatggtcgtgggaatggttatgttctgtcataagattacctcttttcttttattattaaaataattgcttacctgagccgtctaaataattttgtaagatcatcacagctgctaatttatcgatgactttttttcgtttggctcttgaagtatttgcctgctctactagcatacgttctgcctgaacagtggttaatcgttcatcttgataatcaactggcaaggagaatagttctttgatcttttctccgtatgacatggaagcctctgcccttggtccgatggaattgttcatatttttaggtaatccaactacaaaccggtctacttcatattgtgctactaattccttcaaccgatcaaagccaaactcttcttctgcttcattgatccgaatgatctctactccttgagctgtccagccaaaggggtcactgatagcaacacctactgtcttagaaccgacatccaagcccattactctcataaattcactccatgatttgagaggtagtccttgacaattacttccatgatctcatcgcgttcgtgacggcgaatcaaatttcgagcatcacgataacgaggaatgtaggccgggtctccagaaagcaagtagccgacaatctgattgattggattgtagcctttttcttccaaagcccgataaacaatcgctaatgtttcgctcacttcttttttgcgactatcgtcaaaaccaaaacgtacggtttcatctgtaaaacccatgattctacacctctttcccgcaaggtaattccagcttaccttctacaaccttattttactcgaagaaagggaaaactacaaacaaatattccaaacttccgaataaattaagaaacactatttgtatgtttttttccttttttctgtagttttatcaaaagtactcttttcataaagtatacgctatatttctttgaatgtatgtttttacacaattttttcataatattcataaaaaattcgaatagctgctactaattttttgtttttgttgcttgtcctgtctcataattgatcgtgtagccatcttgaacattgtagataaagacattgaattcaatttttttgtcttcaatgctttctgcttccaattgcactcccctggctaccagttcatccccctcaaaatgaggagtgacacggtagcgtacatgatgatttgtttctttgatatatgccgcaatatcattttcgtgagcaagcatgtatggagcattcaacgaacgtgtccctgtcatcaagtttttaatgttgttattttgaccagtcagctggaaaccaattaaatggctgcgattatataaccattgcccgtcacttaatttcttttgtttccaacctgtcgggtcaatatacaaaggctctctcttttcagtagggaacaaatcttttccaagcatagcattggcttgtcctactctgttcaatttatcaatatttgaatagctttcccatgtccctttggaaaggctaagatcctcttttgtaaattccggctgattcccattgatttctatttcttgatgttttccatcatattctggcacatccgctacttgagaagcttgtggtgtggaatcaaaaatagttgtaatctgctgaaagatatctgaatctttttgtgtggtggaaacaccgaatgcccctgcaatcacagcagcgacgatccccacgatcgccttggttgtttttttgctcatttctttactcctttactaacagctccctaaatcttaacatatgttcccctataaataaatactagaaagaaatagaaacagcaaaaaataaaacctgttttaagatggcttaaaaatacaaaaaagagacggattcctcgtctctaatcagtcaccactctatctgtaaggtatttattattattcaaaaattttcttcatactcaagacaatacactgatttcaaaaccgcttggtaaacggtgcgcaaaagcttgcatctgcggtaataagtccatccaagttaaaaacataagaagttgtttttgcttggctgttcttattacttgttgcagagcagctttttcacaacctattttaagcgggtgacgggaatcgaacccgcgacatcagcttgggaagctgggattttaccactaaactacacccgcaatacaaaaacagtatacgcctcttttattccttcctcaagtttttttattctttacgcttctggtatgttttgtagtaaaataaaactaatcaatcaattattggagaagatgctatgacgggaaaagaattagatctgttgctggacacttgtttactcgctgggaaaatcatgatggaaagcaatgcggagatgtatcgggtagaagatacgatgagtcgaattgctttagcttctggaaatttccgtttggtcagctatgtcactcaaaccggtctctttattggtcttgatcgtacctcgaccatccgaatggaacaaattaccaaccgttcgattaatttagaaaaagtagtaaaagtaaatgatctttcacgtaaatatgttgcttcagagctaacattagaagaactttactgcgaactgcaagcaatcgaccgagaccgttctttctttcctgtctggttgcaaatcgttagcgcggcagtgatcagtggaacaattatggtgttatttggcggaaagatgaccgatttacctgtaactttagtcattggaggattgggatacgcagcttatctatatagtttgaaattttttagaatcaaatttttatcggaatttttatcttctttattgattggcatagccgctatctacagcgtacgttttggcttaggaagcaatcaggatctaatcattatcggatgtgtgatgcctttagttcctggagttcaaattacgaacgctatccgtgatttgctagctggacattatgtctcaggagtttctcgcggaacagaagcgatgatgaccgctacgatgatcggttttgcgattgcttttattttccagcttttttattaggaaaggaacacaagtatggggacgatatttattcagttttcttttagttttttagcgactgcggcatttgccgttattacaaatgtacctaggcgttcattgatttgttgtggtctttctggtgcttttggctggatgatctactggatctgtgttcaaataggcggatctgctgcttttggttcattgcttggttctttaggagtagcattcatcagcgatcttttctctaaacgtttgaaaatgcccgtaacgattttcaatattcccgggatggttcctctagtccctggtggtttagcttatcaagcggttcggaatctcgttactgaatcctatcgagaagcggctcattatgcggtccaagcaattatgattgctggagcaatcgctttaggtcttgtattatcagaagtctttaaccataacatccgtaatttcaaagtaaagcgtgacgcaatcatgatgaaacgaaaaaaacggctttttaaataaacgaagtgtaacaaagaaaaggttgtgaaagagacgttcagccttgagcgatgacaaaatatctcacaaacattgcgacaagtaaccgcaggagcaataagaagtaattatgagtattaaaaaaagttttgtaaaaatagcttctcacatttttacataaaattgacttaatactgagaaactgacttttgaacaccctctatctgtaaaaaaggggctgcgacatgatttttgtcacggcccctcttctttattcaaattttttccaaaacgttcgttgataataaacgatccatagagcggaaagtattagaactaaaccgatcacaggaatattcactaaccaaaatggataaaacaaagccaacattccgtataagacgataagaataatactgatgatcaatgaacccatcatagttgcgactaaacccaaacttcctgaacctctgttaaataattggttaatattggtccagttcagcagcagcaaccgataatctctagcgaaataacgtagtgacaataagtagcaaccgaataaagaaccaaatagcaagctagggataaaaaacaaaggcagctgaaaagacagtccgcttaataatgcgatcccaccagttaaaaaactctgcaatatccatccgaatctgaacttttcttttaaatattggttcatagagattggcaaagaacggataaacagaaaattttcttgatccaaagaaataagattactgataaaagaagtctgattaactgttaagaaagccaatgcgatccctaccaggaaaacaacaccgattaacttattatctaaatcagttaattttatttcgcctcctagggcaaaagcaagaataaaaatgattggagttaacaaggaagaagaaagaacttgcataatcaaattaggttcttttactaattgagcattgtaactaaataaaagctgatgcacattttggttctttttatgggttctttttattttgaactcactgtttgaatcagtcagttgctctgtaagctttggtactatcagctgttttacagcaaggaaaaatcccagagccgtgatagctagtattccccaacccaataaaccttgttgagaaagtggctgactggcagcatcatagaatggcaataatatcgaaatcggatgccgatctgttaactcattttcaatagtccccgtttgatgattcatccacatgattccagcaaatgcgatcagcatcgagctgccaagcaagatactagaaactgtttttctatgttttttaaacactgctgttcgagccaaaccaaaaacaatcaaactagccagacaaaaaagaataatcaaaaatagagaaaacaaaaggattgagataatgatagtaagcaaaatccctagatcagctcgccatccggttaaaataaacatgactagaagcggaaaaacaaaagggatgatggtcaaagcaactaccaaaatctttgctgaaaaaacctgtccttgtccaaaaggcagaggcaaaaatacttgcaggtcatttccttcaaaaaagatattataaatgactgatatactttgagttaaacctaacataccaaaaagtgccacgtaataagtaaagaaacctggcaatttaacaaagttcatagcaaacatagcaaatccgtaaatcagtaaaaaaatcagccctgaaaaaagattttgagacaaaagatagatagttaatcgctttcccttttttcctttctctcttgctttattcgtgagctgtggattaacatataaaagattaactcgaattaattctaataattgtcgcttatacatacggtccatctcctgtcgcttgccttccagccattttcaaataaatcttttctagcgtttcatcaggtgagccattcaataattcactaactgccccctgataaatcaattcacctttcttcaaaatagccagtttatcgcataactgttgtgcggtatccaatacatgtgtagaaaaaatgactgtttttccttttgcggcatgagccttcatcatttctttcaaatcaaatgctgcttgaggatcaagtccttgcaaaggttcatccaatacccaaatatctggatctggcagcaacgtgccgatcaaaatcgttttttgacgcattccatgtgaaaaacttgcgattgtttcattttgatgactatacatatcaaaaatcgctgtcaattctgctaaacgcttttcttttttttgtgtgtctaattcataggcagctgaaatcaagtcccaatattctccagccgtcaattgtaaaaaaatatctggggaatcaggcacataaccgattttttgtttgatactcaagcgattttccgtcaatttcattccatctactaaaatcgttcccgatgatggttcaataatactaactaaacttttaatcgtagttgattttccggcaccattatgtcctaaaaatccaaaaatttccccttgtcttatcgagagagacaagtcttttaatgcttgttttttcccgtaacttttacttacattgatgaattcaatcatttctgtactccttttgtttgttattactttttattgtacccttcgttattggtggagtaaatgtcaaaaagagtgcataacaaaaaaggatagaaacgactaggctgctacttgggttgttctcttctacaggaaaacactcttctaacaggtaagatatgagtctttgttttctttaaaatgattcattttctatcttttcttgcataaaattctttaatttatcaatacttctctttcccatctctagttgttctccatttgcaaatgttactatttcgtttactctgctaatagatgtgatgttttcagtattaatgatataagcttttaaatctttacataaatactcatattcgagtgattttttatattttttaattgtgccgtttacgagaatctcttcatctttcaatactaggcctattttatttttataacctggcatgctcattagataaaggatttcatcgtaatggacatagtgatcgctattaccataacggacagttgtccacctttttttcgtagcatgttgaacaggatagttttctttttctttcaataagtaactttggatgctttttttatttttttcataagtgaattcttttatcaaataaccactaggcgtaatctttcgattaataacagttattgctttattcggatgagacgttagataaacaattttacacttttcattcttttctctaagcatttcgcctagttcgataccgctataataggcgttcaaatcgatgtctaggaaaaaaatatctgaggaatagatttcattatttttaatgaattcaacaaattgtataacgttcaatccctgaacgatctcaaatttccaaggacttaataaaattctggattcttccaaaatttctactagcattttttcaaaaaccaaactatcatccaaaataaatatacgcgttaccataaaaagtacctccactcgatattttactatcaaaatcatttcatacaacttttcaacatacatgttaggaataaattgtaattctcttcacaatcttttccaacacctttgaaaccgatatcaaatactttcaggatgctgcttctaaaataaatatcaaacaaatgaatacatcatgcaaaaaaagccagacaaccgacgtccttgcgtgtcagctgtctgagctatgtttatttattttgttcttttaaaaagaacgatacacatactgatttttcggagcagagactttctcagcgtttgtaacaactacagatgggatttcacgcttgaatggttgataatagtctgattggatggttccttctattttataccattcatcatttttaaccgttactccttccggcatatgcgtcaacaaaccaaagactcctgaatctgccacacaatggataatgccgaatcggaacaagaagatatctgtattgctatcgttcggtgtttggtaaacaaatccttcatagctgatttttttgccaatgaattcgctagggtaattataaattagctccataacttctaaatagttttcatctgtgatcttgatagtttgcttatccccatacttttctttcaactcattcatttggtctaagtagtctgatttgttgaaataaatactggtatccggctttaagtattgtgtctgcatctccggatcccctactgattctttacttactgggaaattaaatcctttggcttctacgatcgtagtgtcgagactaactgttggaaacaacgtccccacgattactggcaaagctagcagtacataagcgattccacgttgataaggttttgacaacccatggtcatgatcgtgctcgtgtgccttttcctctgcttttccgtttttgacccacaaatacagctgaactaaagccaaaagagcagataaaatcattgaaagaatagctaagtagcgataatggacattgatatattgatcgagtttgccagaaacttgcaagtacatcatcaattcgaaatacccagataaaatcaaaaaccgcagcatatttttcctcctaaataaataatgtgaatccaataacgctaagggcaatcagtccgatcagcgataaaataaagcgtcctgtaaaatatcgtttcatcatcagtagatttttgatatcgaccattgggccaaagaccaaaaaggcagctacaggtgctgtgccgaacagacttaacaaagaagatcctataaacgcatctgcttctgagcaaagagacatcgtaaaggccaataacagcatgatgataatggctaaaatctttgttgagccgagcgttagcataattctagttggtaaataagtctgcatcgcagctgcgattaatccgccaatgatcaaataacgacctgtatcaaaaaattcgtcgattgaatgtgtcaacacatgcccagtttgatggatcagctgattttttggttcattcttctcactttgttcttcttcatggacatgatgatggtgattttctgctactttagacgtgattttttctttcaatacagcgtctttttgaaaataggcaagccagacaccaatcacaagggcaacaaaaaagctgcctatcacccgccagcttgccatctgccaagaattgccaaatgcgataaaagtggaaaaaatcacgattggattgatgatcggagcagtcagcataaaagcaaacgctgtgtgaactggtacgccttttttaacaaattgatgaacgatcggtacgatgccgcattcacatgaaggaaagaaaaatcctaagatcgaaccagtaaaaatagagaatatacgattttcaggaagccatctcttcacacgttctggggtcaaaaatacttgtaaggcgcctgagataagacagcctaataatacgaaaggtaatgcttcaataacgatcgataagaaaatcgtactcatctgcaaaaccgaatttggaataaaagaaaacatgagtttcctcctttttatttctagttcattcgctttgcaaatatacgcttttattcaaaaaaaaacaagttgctctgtaaatttttacacaactcttattttttaccaaagcacttcaattgactttttctgttattcccattaaattaaggtctcatacatatcacttctatcacaaaagggagaataaaaatgaaacaaaccactaacttgactgaagttcaagacatactgcaacaatcatccgttgtcgtcgtttatctttcgatgcctaattgcagtgtttgtcacgctgttcgtccacgactagaagaactgctcacacattatgatattccggcacttcatttggatgcatttgaaacaccagaagtagctagtaaatttgaagtgctgactgcgccagttgtcctgatttttcatcaaggaaaagaagtctttcggcaagcacggttcatcgactttaaaaaaatccgttatctactagatgaactgacagcagaagatgattccctttcttatgaagaaatcttccgaacaaaataatcgttgtccaaacagaaaaaagcgattgaacaagtgaaagttttgccttcatttgttcaatcgctttttatttttattctgctgtattttcggaatgcgcatttgcgtcagaatgcaagaaatagatcaaggtttgcaattcattcgtcaaatcaacattttggatcaatacatctgacggagcattcaatcgagcagcggtaaagttcaagattcctttgattcctgcttccgttaactgattgactacttcttgtgctctttcagcgggtatcgttaaaattgctacttcgatttgttggatcttgatttgttctgacatatcttccattggataaacggggataccgtctacgatgcgcccaacgatttcctcattcacatcaaaagcacaactgatacgtatgctattactttgatggaatttgtattttagtaaagcacttcccaagttccctacaccgatcagcgcaacatttgtcaattgatcgtcgtttaatgtctttgcaaaaaagtgcataagatcttctacatcataaccatacccacgttttcctaattcgccaaaataagaaaaatctcgacggatcgttgcactatctacttgaacggcttcacttaattcagttgaagacacttttttctttccagcattatttaaaatccttaaatagcgataatacaaaggcagtcttttagctgtcgcctttggaataatatgatctttcacgaaatgacctccacgtattgtctaattacatctttgatttctccatcatagcagtatttataggaaaaaatcaattccattgctcagatattgtgaaattttattctttattcatttatttatcatttctgcaaatctcgcagtataatggaatttatggtagactactaattgaaaaatagttttttatttgaggagaattcacaaagtagaaaagaggattccatgatattattacaagccaatcagattgctcgccattttggtgcagaagtcttatttgaaaacatacatttagaaatcagtacaggcgctcgtgtcgctttagttggtagaaatggcgctggaaaatcgactttattgaagatcattgctggaattgaagcacctgatgaaggaaagatcgctaaaaataaaacagcgactctcggatacctcgctcaggacacaggacttgattccaatgaaacagtttggaacgagatgctgaaagcttttgaacaagttagacaaatggaagagcggatgcgcgagctagagattttcattagcgaaggtacgccagacacacctgcatatacttcttatttaaaagaatacgaccggctgcaacacgatttttcagatcgaaacggctatggttatgaaaatgaaattcgttccgtattgcatgggtttaaattcgattcttcattttatgatcagaaaatcgatactttatcaggcggacagcgcactcgtttagctttagctcgcatgcttttgcaacaccctgacattttgattctagatgaaccaacgaaccatttagatatcgagacgctttcctggcttgagaattatctgcaaagctatactggtgcattattgattgtttcccatgaccgttattttttagataaagtagtcaatgaagtctatgaattaagcagaagaaaaatgcgccattacaaaggtaactattcgaaatatctagatttgaaagcagaacagctagcaagtgaatggaaggcttatgaaaagcagcaaacagaaatccataaattagaagacttcgttgctcggaaccttgttcgcgcctctaccacaaaacgagcgcaaagccgcagaaagacattagaaaaaatggaccggctggatcgtcctcaaggggatgaaaaacaagcaaactttctattcagtatagaaaagccttctggaaatgtagtcttgcaaatcgaagatgccgctatcggatatgataatgtcaccttatctgaaccaatcaatctagatatccgtcgtcaagaagcgattgctctagtaggtccgaatggtatcgggaaatcgacattgctgaaatcaatcattcaccagatcccttttatccgtggaaaagaaacgctagggacaaatgtcaccatcggctattacgatcaaggtcaagctgatctgcatacaaacaagacgatcctagcagaattgtgggatgagcatcctaccactccagaaaaagagattcgaagtgctttaggtgctttcttattttctggcgaagatgtagaaaaaccaatccctctgctaagtggcggtgaaaaagcacgggttgctttagccaagttagcgatgaacaaagaaaactttttgattttggatgaaccaacaaaccatttagatattgacaacaaagaagtattagaaaatgcattgatcgattatgacggcacactgctttttgtttcccatgaccgatatttcatcaatcggatcgcgacaaaagtcgtcgaactctctgaaaatggcagcaaagtctatctaggagactatgattattatttagagaaaaagcaggaagaagaagaaatcgccgaattgttggcacaagatgagccagaatctgctcctgctcccacgaacaaatctgattattaccaaagcaaagaacagcaaaagcttatccgtagccttcaacgaaaaattactcaggttgaagaagaaatggcgcggatcgatgaatggatcgatcagttggaacaagaaatggtcgcgccagaaaacctggaagatcacgtaaaactcaatgagctgaaccaagatttagaagctgctagacaagatcaagaaacaaaattgacggaatgggaagaactaagcttggaattagaagaatacgagaattaaaagccaatggaaagaggttgtgacagcactgttgtcatagcctctttcttttttatgcagaaacatagcgaaacctttctctttttcttactatttttctctactgacaaaataaacaataattttccggcacaattatttgctgttttttaccataacatagtacgatcaacgtagaaaaggagatgtttttatgaaagttgttgtcattggcggtgtagctggcggtccttcatttgccactcgtttccgtcgattgaatgaagcgcacgaaatcattatctatgaacgcggagaaaatatttcttatgcaagttgtgctttgccttattatttaggaggtgtgatcactgaccgtgactcgctgatcgaacgtacaccagaaatattgaaaacaaaaaacaacatcgatgtctttactaaacacgaagtaacagcaatcgatccttctactaagcgattaacagttaaagacctatccacaaatgaagaaacaaaaacagattacgataagttgatcatctcttctggtgctagaccagattatccggatattcccggagtttttgaagcagaaaacggctttgtcctccgtagtgtgacggatgcggatcgaatcaaatcgttccttgaagaaaaaaatccacaacatgtcgtcattcttggtgcaggtgttatgggtctggaattagctgagaatttcaagcatcgcggcttagacgtgactttaatcgatcaattgccacaagtcgctttcccttatgatccagaaattgctgatttagtttatgacaaattgctgaaagaaggattagccgttcatttagaaacaagagttactgagatccgtgataaaggtcgagaaatagtattatcagatggctccgtcctttctgctgatatgctaatttttgctgttggtgtttctccgaataatgaagtggtgaaagcaaccggcatacaattatcagatacaggccagatcattgttgatgaccagttacaaaccaatctgccggacatctatgcgattggcgatattatcgaaacgactagtgtagtgactggtcagccgatccaaagtatgctttccagtgcggccaatcgtcaaggacatatgttggcagatattttaaatggtacgcctatgcgctatcgcggatatattggtgcaggtgtcgcaaaaatctttgatcatacagcaagttatgcgggaatgacagaacatgcattaaaagcatcaggcataacaaattataaaactgtttttatcactccttttgaccatgcctatttctatccagaagctacaagattaaatctaaagctgatttttgatgcagatagcggtcgtattttaggtggacaagcatttggagaaaaaggtgtcgataaacggatgggagaactttctgtagcgatcaccggaaacttgacagtctttgatttgcctgatttggagttgccttactctccaccgtattctactacccgtgacccgttgaatatagctggttatgtcgcaatcaatcaaatgacgaatatcgtagaaacgatcaaagcaagtgatatacccgaaaacgatttgaaagaagcgttctttttagatatacgtgaacctaataaagcaccttctggcagtatctcggcaacaaaaaatattccaatgaatgagttacgagatcgaatcaatgaaatcccaaaagataaaaaagtttacattactttcagaagaggattgaatacttatacttctgcccgaatcttggcaggtttgggtatcaaagcgattttgattgaagaataaaaaaacgaccgcggtgggtagccgcggtctaggagttatttttacttgaggagtaaaaatgaaaaagtatatagggttgttggttggtacgtatatagaatagaagataaatgtgaagaaattgtgcattatttcttcacatttattaggttatagtttaagaaagtttaaacattgcgcaatttaattattttagctgtttcttttcataaaaaaacatgttgtgactctgagacaaatcatagtccatagtgatgtctctagagtaactacgcctaatattacgaggcataatattaattcatcagcactagtacctaaactagcatccctttcgaatattttttcttatataataaagtttgctttcactcctctaatctcaccaaatcgactggcttgcgttgtgtgatactaggaactgatttgtttagaacgacttttctattgtaatcatatttttcgccatcctcgttgtcttctaatccttcaatgaatgatccctaatgtgtgtattaagtaatttaatttttttgttcctatttatttaacaaataaataatataaaaggtaaataaaaaagagtggatttctccactccatgaaaagccgactttttgggacgcttttttttgccaagcctcacatttttatagccaaacttcttttgcgacttgctgcaataattggattttcttccattgttcttcttctgttaaatggtttccttcttctgttgaagcaaacccacattgaggactgatacttagattttccaatggtacaaattgttgtgcttcttttattcgttcttttattttctccgtatcttccaaatctggaaacttagaagtaactaatcctaaaacaactttactttctttgttactccaatgtcttaaaggagtaaaatctcctgctcggtcagaatcgtattccaaaaagaaaccatcataatttgttgaaaacaactcttctgcaatgggttcatatccaccggaaaacagccaagaagaagcgtgattcccgcggcagatatgtgttgtgatcgtcaaatcttctggtttgtcttccagtgcattattgataatctctgtacaaatatgggccatttctttcggatcaattcctttttgaagaagtgcttctcttttagtttgatcagctagaaacgcccaatttgtatcatcgaattgcaggtaacggcaacctttttcataaaaagcatgaatcgctgctttgtaagtagaggacaagtcctcataaaaatcagctagatcaggataaatctccttgatttttgaagaaccatcattagatagaatctcttgtcgtaaaatcatcgtgggactagggatcgttgcttttgcaacaaaagtatcatctgtttccactacttctttcagaaaagcaaaatcttttaaaaatgggtgatttggattgaaagataatttatctactacccgaatattataagctggagctgcttttccgtggaatgtttgattatatccagtttctggaacatagccttcgataccatttagttcttctaaaaaatcaagatgccaaaatccacgccgaaattcaccatctgtaattcctttgatgccgactgctttttggtcttccactaatttttttatttcctggtcttcgattgcacgaagttcttcttttgaaagtaagccttcttgaactttttttcttgcttctttgatcgattgcgggcgtaagaaacttccgacatgatctactgtaaatggtctatttttgctcatttcactcactcttttctttgtttttttgtaaaaaaaaatccttttactagcaaatactagtaaaaggacgattatactcgtggtaccaccttttttcagaaaaaacattctttctctcagcctgacaataaaatcagtggtcttggtaacgaaagactgttcgtttttgcctacctttcgacaaaaaatcctctaaggccattttcgacagtcaacttctagctttttacaccaaccaaagcctctcttgaaccattttctgtctactttccttctcatcggatactattagaataaaattagaatagcatgtttgaaagaaaagtcaatagggaataagaacaaacaaaaactaatttgttattcttagtaattggtttgtggaatacaataaagcttttctaatatgataattgttcagtcgtcctttcatcttagatcacttccttaaaatgatcatacccgtttcaaccacataaaaaaggacttaattttgaaaaatttcccatcaaaactaagtcctttttattatagttatacaaatttgcttattttctcgctatttccgatacatcttgaattctaagaataggtcattatagatgcctaggtatttcgatcctagatcttcgtagacttcaagatgggagatcgtgtcatcagatggatagaattgttcgtccgacgaaatgtcttttggcaataacgcttttgctttttcatttggtgtagaataaccaatatactctgcattttgtgccgcattttccggttctagcataaagttgatgaaatcataggcaccttctttatttttcacggtttttggcataacgatattatcaaaccaaagattggaaccttctggtgggattacgtaatgtaaatgttcattttcccacatcatatcggcagcttcgccagaaaatgtcactgccacggaggcttcttcattgatcatatacattttgatctcatctgccacgattgctttgacatttggcgttaaatgattcaatttatttgctgcttctgtcagctgtgccatattcttactattcaaagaatagcctaaactattcaaagaaagccccataacttctcgtgcaccgtcaatcagcatcaaactgtcttttaattccggcttccacaaatcatcccaatgcttaatttgatctgcatcaaagaatttatcgttatatacgatccctaaagttccccaaaaatatggaatcgaatactgattatctggatcaaaatccaagtctaaaaatcgtggatcaatattatttaatcctttgatcttcgaatgatctaatggaagtactagtttttctttgatcattttttggatcatatattcacttggtatagcgatgtcgtagtttgtcccaccttgctggatttttgtgaacatcgcttcattagaatcaaatgtttcataattcactttgtatccatattctttttcaaatttcgtgatcagactaggatcgatataatctccccagttatagatggtaagtacctttgctccactcatgccacttgttttttcaagttgacgaacaccaagcagcagcaccgcaataatgatgagaatacctaaaaacagagattgtaattttttcatcgcagccgtgccaccccctcgcgtactcttctgtttttcttcagccgttttggacggttttctttactaatgaagtagtatccaatgaccaatatcatggagaacaagaaaactaacgcacttagcgcattgatttctaaactgattccttgtcttgcacgagaataaatctctactgagagcgtcgtaaagccatttcctgtgacgaaaaacgtaaccgcaaaatcatcaagagaataagtaaatgccataaaatatccagctatgattcctggagaaagataaggcaaaatgatatttttgactacttggaaattattagcaccaaggtctctagccgcatcgaccattgaatcgttcatttcctgcaattttggcaagaccatcaagacgacgattggaatgctgaaagcaatatgggaaagcaatacactctgaaaacctaatccgaatcctagtagtgtaaagaaaatcaagaaactagcaccgataataacatcaggagagactaataagatgttattcatgctcaacaacgctgtccgtgcacgtcgtttcttcgtgtaatagattcccatagccccaaatgtcccgatgatcgtggcgatcaatgcagataagaaagccagcatgaacgtattcaatacgataatgatcaaacgagtatcttcaaaaacagcttcataattttcccaagtaaaccctgtaaagctgttcatcgttcctccttcattgaaggaataaaaaatcagatagaagatcggtgcatataagaataaaaaaacaatccctaaataaagatacgaccatttaaattttttcatttatgagcgacctccttttttcttctcgcctgtcaggagcatcacgatgaacatagcaatgattaaaatcacaccgattgtagaacccatcccccagttttgtgtaaccaagaaatgctgttcgatagccgttcctaaagtgatcacccgatttccgccaatcagacgagtcagcatgaataaagaaagagaaggaataaatactgcttggacgccgcttttcacaccatttaatgataacggaaaaatcactcgtcggaaggtctcaaagctattcgcgcctaaatctctgctggcactgatcaaagaaggattcatctcttccaatgcattgaaaattggcataatcataaatggaatctcgatatacgttgccacgaacagaaaactgaagtctgtgaataatatctgtttcggcccgatcccgataaaatcaaagaaatgattcacgctgccgtgcacactgaaaattccaataaatgcgtaagctttaagcagcagattcacccatgtaggcaaaataatcagcatcagccataattgcttgtgcttcagttttgttaaaaaataagcagtcgggtaactgatgatcagcgtgaaaaacgtgatcaaaaatgcataccatacagaattgatcgtcatagaaagcgatgtccccgacgtaaaataagatagataattattcagcgtgaattgcccattcatatcaaaaaaagattgataaatgatcattaatacaggcgcgatcacgaataaaccgagccacaaaatataagggacggaatagatcctgcgcattgttttcattcttgtcccccctattcttcgtagctgtcaagacgtgcatcgaattcttcttcagactcgttgaaacgcatgacatggatatcttctggctcaaaggccaatcctactttgcttccttctttagcttttttcgttgaatggaccatccattcattttgctgttcatcataacagatgatttcataatggacaccacgaaacagctgagtatcaaccgttacgactagttttcctttatctggtgtcgtgatcgtcaaatcctctgggcgtaaaacaacttcaactggttcatttagacgcatcccgccatcgacacattcaaattgcttaccaacaaactcaactagattatcttcgatcattacaccgtccacgatattgctctccccaacaaaatcagcaacgaaatgattgattggctcatcataaatatctacaggtgtaccactttggacgattttccctttattcatgacaaaaatctcatcactcattgccaacgcttcttcttggtcatgagtaacaaaaataaacgtgattcctaatcgttgttgcagatcccgcagttcatactgcatatctgtacgtagtttcaaatcaagcgccgataacggttcatctagtagcaatactttcggttcatttacaattgctcgtgcaatcgctacacgctgtctttgaccaccagacatttcactgatctcccgtttttcgtatccaggaagctggaccatacgcaaagcatcttttaccttcttttcgatatctgatttggacattttcttgatcttcaatccaaaagcaacgttatcaaaaacattcatatgaggaaaaagtgcataatcttggaagacggtatttacttgtcgcttattagctggcaaatcattcaaccgtttcccttcaaaatagatgtccccttctgtagcttcggtgaatccagctataatacgtaggatcgttgttttaccacagccggaaggaccaagcagtgtataaaattttccttgttcgatctcaaaacttactttttttaatactgtttcatcatcatagcgtttcactacttgatcaaatgaaatgattggtttccccacgtttttaccccctatattacaaatatgattgcgttgcaacaatcaatacttttgttcgttttttgagatgattccttaattgatgttgttttgtcgcttgataatagatcgactgtcctgcttttgccacatagaccgtctctcctaagcttaactctaattccccttctaatacaaaaataaacgtttcagataatgaaggttcaaacgtcttatattctcctgcaccttcaaaagtcagcaagacaggctccatttctttttcattcgaatcagccacgagccattccaattcatacccgttttcttcatcaaaataaaccgtatgatcttcttttgaataaaccacttgcagattcgctgcttcttgatgaaaaaattcttctggagtcacacctaagacttcaagaatagaaaagaatgtttccattgatggtgaacttaaatctcgttccaactgggaaatatacccttttgacaaatctgtgcgttcgcctagttcttcttgtgtcaaattcttttggatgcgcaaatttcttaacttctcaccaatttccataatttcctccgaatcgaagttttctaatagtaaacttcctgtttactaccactcgtattagtatacgaaatttattgaaaaaggcaaccctttgtaaaattttttttgctgaatatttctttatcttttggaataaattctagttgtttgattctttatttttcacctaatttttgtctaaatttacggaagaacaagaataaaagagtaggctttatggtatgataaaagaaaattttaaaaggagtgtctcacgaatgaacgcttttcgatcttttcaggtaataaaggaacctgttttccatacagcaatcagtgatctgccatttactgaattggctgaaaatgaagtcttggtaaaaattgcctattctgatgtcaattataaagatgcattggcaatgagcgaatctggtcaggtgatacgaacatatccgatgactccagggattgatttatccggaactgtcgtccaaagtaacaatccacgtttttcaaaagaagatcttgtacttgctactggttttgggcttggtgtcacctatccaggcggttacagccaataccaaaaagtaccaggagactggttagtccctctaccgaaaaatatgacactgcgtcaagcgatgatttttggtacagcagggtttactgctatgttgtgtgtgaacgctttaatccgtcaaggtatgacctccgataaaaaagttgtcgttactggtgcttctggcggtgtaggcagtacagcgatagccctgttacataaactaggattccagtcaatcattgccttttccagaaaagaagagtctgtcacatggctaaaaagtctaggtgcttctcaagtcgtacgacctgatgaatttctgccagagacaacaaaagctttaggaaaacagcaaatcgactatgtcatcgacacagtaggtggcgagcagctaagtagtcttcttccattgatctcttataacggtgcagtagctttatgtggcaatgctgggggaatcaaactaaacgcgactgtcttgccttttattctgcgaaacatccagttgattggaattgattctgtcaatgtaccaatagatcaacgtctttctttatggcaacagatggcggatttgcagattgcagatgaactggtcgtccaagagattactctggatcaattgcctgaaacagcatctaaactacttgctggaacacaccaaggaagaacactagtaaatgtaggtgaccataaatgaagattctaatcacagctggaggaacgactgaaaaaatcgatcaagtacgtgctattacaaatcattcgacaggacgattagggcaagcattagctgattatttagctgccaatccggataccacaatcgattacgtgactacgaaacaagcactgaaaccgaaaagacactccaatataacgatttatacgatcgaatctgcactggacttatttttacaattagaagcactaacgaaaaaagaacactacgacgcgattatccacagtatggcagtcagtgattttactcctgcttttagtttttcagaagaacagctggcaaaaaacctacccacttcttcaacgcaagaagaactggacaattggtttgcggaaaatgaacagacagataccactgtttcaaagatctcttctgacaccgagcatcttgtgctcgttttgaagaaaacaccaaaaatcatttcttatctacgtgaatggcagccaaaagcaaaaatcattggtttcaaactattagtagatgtaccaaaggaatctcttctggcagtcgcaaaaaatagtctgataaataacaaaactgattttattttcgcaaatgatttgacggaaatccatggcgagacacaccacggctatctcttatctaaagatggaacagtggaagaagctcaaagtaaatctgagattgctgcattgattactgagaaaattagactggaggaatcaaaatgaaaaagatcttactaggcgttactggaagtatttctgcttacaaaagcgctgatcttacaagtcaattcgtcaaattaggtgcccagatagatgtgattatgtctaaaagcagcacacattttatcacgccattaaccttgcaatctctgtcgaagcgcgcagtccatacagacgtcatgcaagaatcaaatccgcaggtaatcaatcatatcgaactagcaaaacaagctgacttgtttctcatcgcgcctgctacagcaaacattatcggcaagctagcaaatggcattgcagacgatcttctttcaacagtcgcaatggcgcttccagtgggaacaccaaaattgattgcccctgccatgaacacgaatatgtatcaaaacccgatcactcagcgtaatctggaaacattgagatctgtcggctatcaggaaattgaaccaagagaatctcttttagcttgtggagattttggaaaaggtgccttagctgatattcagacgatcatcgaacaggtcatgctgactcttaatgaaagaaatgcttagaaaaaaggagtacttatgaaaaatacaaaaaactttacattaactgcgatgtttttagctattttgattttattagctgttacgcctttaggttttatccctatcggtccaatcaatgcaacaaccatgcatattcctgtaatcattgcttcgatcgttttaggaccaagactaggtgcttttcttggcggtacatttggactgatcagcatgatccgtagcacagttatccaaacacctttgtcttttgtcttttctccgtttatcccagtcatcggaacagaacatggaagctggaaagccttgctgatcgcgtttattcctcgtatcttgattggggtggttccttatttcgtttataaaggtctgcgcaaactaatgaaacaaaaagcagattccgtttctttattcttagctggactttccggttcattgaccaatacgattttagtgatgaatatgatctactttttattccagcaagattatgccaaagtcatcggaacaaatttaaatgctgtttattcagctattctagcggttatttttacaagtggtatacctgaaggaatcgtcgcaggtcttgcgactgcagcagtatgcaatgtcttgttaagatacttcaagcacccttctcttactaactgatagtcatcgtagccgatctctgatttttttctcttttggtgttactattgaatggaaagatttgacgtcgaaaggatgatccaaatgaaaatttttgttgtaggtgcaaacggacaaattggccgacacctgataaaagatttagctccaagttcccatgaaatttttgcaggggtgagagatgtcgcttcccaaacattagtaaaaaaagagaatgtttcgtatgtctcttttgatttaacttggtccgtggaaaaaatgaccgaagcattcaaaggcatcgatgtattaatttttgctgccggctctcaaggaaagaatcttctgcaagtagacttggatggcgcaatcaaaacagtgatcgcagctgaaaatgcgcatgtctctcgctatctgatggtcagtgctgtttatgcagatgaaccagcaaaatggcctgagtccatgacagattattatattactaaacattatgcagatgaatggctgaaacgaactaacttagattttgtcattcttcaaccagtcacattgactaacgatgaagaagttacttccattcaattaactaagcctaatgagaaggcatcaaaaacgatcactcgctctacagttgctgctgtacttgccgctctagtggaagaaacggatatttctcgtacgactctagtactttctgaaggtagcaaagagttgaatacagcattccaagaatgggcaaaggagggatagatccatgcgtgccatttcaatcaagcatcctggttctgtagatgtattagaacaaattgaagtgcctgttcctaaaccaaaacaaggcgaattactgatcaaagtccatacagcagctgtcaatcgaacagatattatgaaaagagaatcagtctctttgaaacctccctaccctattttgggagtcgaagtagctggagaggtagttgagaataaaagtgatatctccacttttactcctgggacaaaagtatacggattagtcaatctaggtggttatgccgaatatgctgtgatgcctgccgatcgtgcaatccttctccctgatacgctagactatgtttctgctgctggaatctcagaagtttttttgactgcttatcaaacactttactggcttggaaaattacaagaaggcgaaactgtcttgatccatgcaggagcaagtggtgtgggaacagcagcgatccaattagctagacagctttctcacgcgaaaatcatcgttactgcaggatcagaagaaaaactcgccttttgtaaagaacttggtgcagatgaattgatcaactataaaaaacaagactttcaagaagaggtacgaaaaatcactgaaggtcggggaatcgatgttattttggatttcatcggcgcttcttactgggaaaagaatttagcttctatagccgttgatggacgttgggtcttgattggtatgctaggtgggaccatcgtgcctgagatagaccttggtgtattgattgggaaacgtgtccaactgcttggtacattattgacacctagaagtgatcagtataaagcagagctcgcacaaacttttatgcaaaaagctgggccttttctagaaaatggcaagattcggccaatcattgaccgtacattccaattcagcgcagtcaaacaagcgcatgaatatatggaagcaaacaaaaacatcggaaaaatcattttgaagataactgaataaaatcatgctgatcaaaaaagaggctgggacagaagcgtttaactccaagaaataagaagaaattcacgaaaattgcttttcaaatttttgtgaattccagctaatttccaaaggagttgcttctgcttccgccgtttatacgtgtttagagcgtgggacaaaagtaaagaacacttttgtctcacgctctttttccgaacaaatggtgttcaaaagcttgcatctgcggtaataagtccaaccaagttaaaaacataagaagctgtttttacttggctgttcttattacttgatgcagggcagctttttcacaacctcttcactaaacagtgttcaatcagctgaccctcggtattagctcaaaaaacggcaaaatatgaggaactattttgccgtttgtttctctaatactcaggtcaaaacgctgatttcacaacctctttttatttacgttctatttcattcattttccgaagcaaatcgagctgcttgtatgcccgcttgtcgcccaaaaataatgatctccgcaactgaatttccaccgatccggttgtttccatgtaagccacctgtgacttcaccagcagcatataaccccctaattggctggttttctttatctaatacttcagtgttcgtattgattttcacaccgcccatcgtgtaatggattcctggtgcgattttgatcgcataataattcggagacgataagtcatgttccatggctgtggcacggttgaattgagcatcttttttctccgcaacatccgtattccatccatcaactgtttttgctagtgtttcttttggtaaatcgattttttctgctaattcttccattgtctttccagttgtgacatatcctttttggtcataaaattcaatagctgtggcacgatcacgcacgccttggtcaaaaatcaaataagctgatttttcaggcaatgctgtaattgctgcagatactttatcccttgtatccatttcattgacaaatcttttcccctcttgatcgaccaagattgctccttctccgcgaacaacctcaccaatcaagaccccctcatcctgctgcacagttggatgaatttgtattttatccatatcaacggtttgtccacctaatttttcaatcatggtgataccatctccagttgatccttcttgatttgtcgtaatataatcagctaaatcgggacgatatttttcaataaattctttgctggcaccaaaaccgcctgtggtaactacgattgcttttccggtgacctcttttggttcttctccttgaacatgtacagtcacttcattgaccgtttccccatttttcttaatgtctgtcacatctgcgttgacaaaaatagggatttcccgctcatggacgttattcaataacccctccactaagtatccaccaatagccgagccatcagacggacgatgtgtcctcttttcactcatccctccagtgatcgttaagttgtccagtttgataccgttttgatctagccaatcgaccgcatcagcagagtgatcgacaaagtatcgaagcatttctttatcattcgttcctccaccaccttttagcgtttcttcatagaaggcatcattcgagtctttgattccttcttctttttgaaattttgtttctgaagcattcataccgcttgatgatttagatgtgtttcctccggcaacaggcatcttttccaaaattactggattcaacccagcatcttttgcttcgatagctgctgccatccctgcaccaccagctccaataatcacgacatcataagattctttcatttcttttggatctgtatatacttgttcagaagcgcctgatgatacttcggcagattccttcgtactagaacttgtctgcgctgtatttttctgatctgcgccgcatgcgctcatagcaagaagtgcaacggctgttaataaaccagcaactaattttttcatttgtatcccccttttctccttatactatattaagtgatttttttcacaatatcaactctgtttttctttaagtcatatagctttggtaaacacacgcttcttagtataattaaggatatacatgaaggagttattttatgaatcatttgaaaaccttttttacgaacagtacaaaaactgctggcagaatcacaaatggaatctatattttattacgtatcatcgttgttattatgttggctgatcagatttggaaccaacattggggaaatacgatgcttttattattgacactgattttgtttgaaattccttatttcctagaaaagatattaaagatacagattccaaatatgctagaaatcattttgttatcttttatttttagttcaacagttttaggagagttaagtgatttttatggctatttttcaatgtgggatacttttctacatgcattcagcggatttttagctgggggtgtcggcttttcccttgtttatttgctcaataaaaatacaaaaaccatgaacttgactcctttattactagcagttgtttccttctgtttttcgatgacagttggtgttatgtgggagtttgtggaattttcagcagataaattactgcaattcgatatgcaaaaagatacgatcatccagcaaatcaatagtgtggagttaagtaaagacggaaacactgtctatcatgttccagatatcactcggacaatcattgaaagtcaaaatgcagatggtaaaacagataaaacaatcatccaaaatggttacttagacgtgggaatcatggatactatgaaggatttatttgttaattttattggagcagttgttttcagtgtatttggttacctctatagtcgaaacgattaccaaaaatttacgttcatcaagaattttattcctaaaaaaatcaaacgataaaacatgctaaaaaacaagagaaggggcagtgacaatacttttgtcactgccccttcttttttgaatgtatggcatgccattagttatccgatagtattaactcaaaaaagtaagatatgaggaatgactatttcgttttttatcccaatactgaggacttatttcaccatttcgttatttatctaatttacttaaaacctgcataactttttcataatctggattaggtgtgccgtctagattttcagcaataaaagtaaaatccatttttttataaagagcaatcgcctgatggctccatgtctgtgtgtgaagatagattggtccgtccgtatggagggtaggaaattcttgcaagactctggcagtcaatgcttttgcgagcccttttccttggtaatctggtttcactgctaaccaatgaaaaaccggatacacttgctctcttgatttttttcgccaagcggtacaggttgctactttttctcctttttttgtctctacaaaaaacatccttctttcaagttcttcaggataaggagcaaagttttgttgaaaatactcaagtgcttcatctgtcgtttgaaattccccaacggaagtctcaatctccgcccaagcagattcatcttctttttgataaaatcgaaattcaaaaccttccgctaaaggcgtgattggaacattttgttgaagtggtcttgtcatccagatttctgcgtaaggtaacgttttatctaacatttttctatccctcctcgtctccattatgccaaataacatatgactcagctacttatttgactataacagatagagatataaatcagaaccagtcatctgcgccaaattcatttcgattagcgtatacccatgttcctgccatacctcgcatgaaatctcctaaagcagaagaaggaatacctccaccaggtgcgggtgttcccggactaggaagtggtacttgcggctgcagatgctcatcggtggaatcaatagttgacaagcgttttttcttcgtttccttctggtcatctgattcattctgatctgccgactgtttagcaacaaattctttttctgattgttgttttattttaggctctaaaatttcattttccaatccagaaacttgtggggccaaatgagcttcttgccttatcgttttattagattctgagatttttctagatattcttgctggctgtaaatttcttgtttgctttgcttcccctgttggagaaactgcatgagccatttgttgttttttttctgacaagttttcttcttgttttttttgttctttttgtcttatctgtttttttaatggtaaaacgtgtaaaagcgactgagcatggagttcttggagtgaatacgggtcatgataactatacataatcgtaaaatcacctgtttgtttggtcaaataaccatcctccaatggtacttcattgattgtaaccgatacatcctttaacggtacgggtttatctaaggaatttgttgctgattggatcaactcttctttgtttattttttcgtttggatgaacaataagatcatggccttctaatgaacgattgtctggtatataaacataagtaaaggtaatttcccctcctgattgcttcctgttattcatcagttctgagtgaagtacttcaaggatctccgaccagtgactttttctgtctaatccgtttgcttgcatccaatcagaaatagaagtgacttttccgtcttgttcataagtcgataaatctatatttggcactcgatcagaaaattcagcaggtaggcgcaaatcaggaatacgatttacactactcatatgtgtttctgcttgaagttctttatttgtttgactatctataaaatgagtgatgacagtcgatgaagcagcagatgcttctacataaactacagctgttgtttctgccacatttgatgttttcgagtctatataagttaatacaacgggatattctcccggagttgtagtatctactgtcccgttcattttgatttcttctttatttcctgaagttccatcgctttttgttacatattcaacaagatctttaggggcgtagctctctcctgttcttaagtgaagatcttttcctttgatagctgtttgatcagcacgaacatggatcacagcagatgcagtcattgtttttaaagcaattggatcaaaataggacaaggaaatagtagatgttcctgtattagtcgtatccacgatattcccattgtttgaaattactttggacatatctccttgtgttccatctgcgttcttcagcctttctaccagatcagatatcgaaacttttgtccctgccagaacatcgattttctttccttcaaactgtgaataatctttttcatatacataagaaacttgtgcgcttccaccgttctttatatctgtcaaagcatgattcaaaatatcagtgatctgttttaactgatcaccttttgtaagatcagtcatatcggaaaagatagaaagcggcacactgcttccggtttccgatgtccataatgttttgttaggaattaaccagtagtggtttatcgttggaggataactgactttattataggaagtcaatgcaggaagtagctgttttccatttgcatcagtgaaagtatgagtaatagtgataggggaatcagtggtctcagaaacagaggtacgtacgaccttgatggtttgtgccgttgcctgaacgggtacatgcatatagacacctacagataaactgatcatcatcgtgcgcatcataaacttaacgtagtgtttttcagaacacgaccgttccttatctaaacgacaagcgtgtttatttagttgttttgaacgtctttttgaacacatttattcttagtcctccctactcttgtctaaacatgaagtagtaattttcataagatgatttcattatataaataaaatcaaaagaagatggactattaggagagtattttttttgattttttattgtttcaagaaaatcggaataataacttatgtaatttttaattttgttaagtaatatatctagttatatctagttaccttttctttgaaaaaaacataaatcagctaataaatatgtgagacaaagctgccatccataaatactagctgattttttcagttaaatgtctatttttttctctgatgatgatatttccaaaatattcccagtcatctggagtcggtggatttttccaaattatctgttctttattaaatttttcaagtaaacaatcagataaataaatattcgtacgagaagtgattcgactctcaatcacaatattgtaatttttaaatcctttcacttgagaaataatgtaatcggtataagcagatccttgcgaaaaatcaatacagacatgaatcggtgcttcaaaatatgataccggacaaataccgaccaataaaaagagataatcataaaataagcgaatcatgaaacgttcatcttttcccaagaaatagcgtttattctcttgtatgaccttttggattgctgtactgaatattggatacgtctcgaagaaaaactgtagctgctttttagacgtaaagctagtcatctcaaagtcgaatatccaattttttcgattgacatgcatcatacccatacgaagttcttttcgtatatatagtctttcttcttcagagatttcaatcgaaaatggtaattgatcaatcaattccactgacattttttgactaatcatgtggatatcatgaaaatgagcttccgcaagtccaaatgcgccatctaattcaaattcttcttccgtgatcaaaaacaacatgatataagaaatctcatcaatgatctgctctttagggatatgaaaaaaagaaatatgtgataaatccttgatgatcttcattccttctgagctcttaaagtattcatctgaaaagaaacgttttccgattggttgattcccataggccctcaacaaactaatagtggttagcaaattgaatttgattcgttttgttgcagacagttttaaattgaacagatattcaaaatattgcacgatactctttgcttcattcatgacgctttctctaaatggcatagaaaaaccattaaagaccccgaaatataccccaaataatacgttccgtatgtttatttcttccccaactaatatgtttttctttaactttatttgatgctgttcaagaaaagagactaattctcttctttttacataggctcttgatatgcttaaaaaatgattctctgcaaatttttcgatcgttacttttgaatccacgatctccgttaacagtcgagcaatttttgatcgttgaaagtagattcttcttaaatttttgatatccgtcaaattcagacgttcgacatggatctctgcttcttctgaaatttggatctctggctttgttttgaattcagtaaattctttatttaattctatgatataatttcttgttttaaatttagacaaacctaatgtttcatataacttaggtagcactacataattctttttctcaaattctaaatatctagctagcagcagtttttctctatcttcctcttctataaggtaatccaacttcatatcctacacctcaaaaaatgcctcataccaattacttgatatgcagatgaaagttcatcttttcacctatactgattttatgatggattatgcttgttttttcatcagttattctcattttttatcttttttttgagaatattgcaaaaaatggaaaaatttatgaggaaatattctatattttttgttttattgtgttaaaatgtacaagatttgcgccatttgcgtaaacaaccacaaaaaagagcagggcggccaccgtcctgctcttttacttattttaagttccattacttattaattggctaaacttctgcttgtttctgatattgcttgtttttctccaatgatccgcacttctgtttctaaagacacatcaaatttttctttgattacttcttggatgtgcgcaatcaattcaatataatctgtcgctgtcgcatgatcaatattgacgatgaatccagcatgtttttcagagacttgtgcaccgccccatttcaggccttgcaatcctgcttgttggatcagctgacctgtatagtgtcctactgggcgcttaaagacacttccgcatgaagggtattctaatggctgttttgattgacgcaattcggtcaactcatccattcttgctttgattgcttcataatcccctgtttgcaaactgaatcgagcttccaatacgatagcacgtaattcttggactttactgtgacgataagaaaataccatttcgtcttttgtcaaagttttcaatgttccatcttcaagcaaaagatccacttcagcaaaaacatctttgatctctccgccatacgcacctgcattcatataaaccgctccaccgacacttcccgggatgccgcaagcaaattcaaatccagtcaatgattctgccaaagctgcataagtcgtatcaatcagtgaggcacctgcttccgcaatgaccatcgttcctttgacatgaatctgtttcatttcagtcagcatgatgactacaccgcgaatcccgccatcttgaacgatcagattgcttgcatttcctaataccatccaaggtatatcatggattcggcaataatcgatgatttgctttacttcgtcttgctttttcgggaatgcaaggacatcagctggtccgcctgttttcgtaaacgtatagttcatcaatggttcatcaaacaataaagtaatcgtggctaagctttcaactatttcttctttattcactgaggattttcctttcttttctcaaacgtcctcattattctatcacgcttaatacaatcttgccagtcttgttcaaagttgatgacggtagtgatctttaagcacttcctcacataattcatgacttcttacaacttctttttgtttaagcatttctgtttccgatttacctaaacggatctgagaaaagaaggcctctaccattggctcaaacccgcgtttgactagcgtgtttgtccagtcgccaaattctttcactttttttccatcagcatcttgaatgacaagctgggtcagatcgtttacttcataagtaccatttttacttgttacttgatatttttctatattagcgccacttgctaaatccatcgttaaaatagccgtttgattttgtgtttctaattgtaaaatggcatattccaaaaattcttttgtttctcttatctggtattttgttctcaaaatgggttcatccaataaatacaccgctgtatcaataagatgtaaaaacaaatcataaaggacgaattctgtcgtttcttttgccgctattcgatttttttgcaggtggatcaaccgcttatctgggatacatttcaattcttctaccataggagcaaagcgccggttgaaaccgatcatcaaaattttttggttcttatcagctaattcttgcaattcacgaacttcatttagatggacactcagtggtttgtcaatataaacatggataccattttctagacattttttggctaattcataatgtacttttgttgctgcgtggatcatacatgcttcgattttttcttctaaaagctcatcgatcgtttcatatagatgttggaacccgtactctttttgaattctttcttttgtttctttatttcttgttgcaaaataaaaatcaagtgttccttgttttttcgcataagttggtaaatatgctttttctgcgatattccctacaccgattacaccaatcttcatcgactttcctcctggatcatttagttactttcatcttacaccattttttactaaaatgaggtacaatagtatcgcaaaggtaaggaaattaattcgaaggagtgtgcttttattgaaatttatctcttggaacgtaaacgggcttcgtgccatcgtaaataaaaattttttagaagtttttcatgagttagacgccgattttttctgtctgcaggaaacgaaactccaagcaggacaaattgatttagatcttccaggttattatcaatattggaattacgcagaacgaaaaggctattccggcacagcgatttttgctaaaaaaccagcattgaatgccacttacggaatgggtatcgatatccatgatacagaaggccgtctgattactttggaatattccgatttctttcttgtaacctgttacacgccaaattctcaaagcgaattaaaacgtttagattaccgattagaatgggaagaagccttttataattatttggaaaatctaaaaaaacaaaaaccagtcatcgtgtgtggggatctaaatgtcgctcatcaaaagattgatttgaaaaactggaaaacgaatcaaaaaaatgctggattcactccagaagaaagagcggctctttctcgactgttggataacgggtttatcgatacattccgttatttttatccaacccaggaaggtgtctactcttggtggaactaccgattcaattcaagaaaaaacaatgctggttggcggatcgattactttttgacgagcaaagatttagagccaagactagctgatgcaaagatccatacggacattatgggcagtgatcattgtccagtagaattagatttgaaataaagaggatgtgaaaaagtcgtttagtttcgagtattaagaaaaattttgtgaaaatggctttccacattttgcataaatttggcttaataccgagaaactggcttttgaacaccgtttatcgagaggttgtgaaaaagctgtcctgcatcaagtaataagaacagccaaacaaaaatagctcttcatatttttcgtttgattgggcttattgccgcagatgcaagcttttgaacaccgtttattaagaggttgtgaaatcagcgttctgacctgagtattagagaaacaaatggaaaaatagttcctcatattttgccattttttgagctaataccgagggccagctgattgaacaccgtttagtggagaggttgtgaaatcagcgttttgacctgagtattagagaaacaaacggaaaaatagttcctcatattttgtcgttttttgagctaataccgagggtcagctgattgaacaccgtttagtggagaggttgtgaaatcaacgttctgacctgagtattagagaaacaaacggaaaaatagttcctcatattttgccattttttgagctaataccgagggtcagctgattgaacaccgtttagtggagaggttgtaaaatcagcgttctgacctgagtattagagaaacaaatggaaaaaatagttcctcatattttgccattttttgagctaataccgagggtcagctgattgaacaccgtttagtggagaggttgtgaaaaagtcgcctactttcgagtcgtaagaaatttttttgaaaatggttcctcacaactttgcataaatttggcttaataccgagaattcatgatccctatctaactccaaatcacaaggaataagttcaaaaactagcttttttcaacaaatattacataaaaaattctatgttttttgttaaatttatttgcttttttcaaaagtatgttacagtaatttcccaaggaggttttacagaaatgaattttgttgccatggattttgaaactgccaatcatcagccttatagtgcttgttctcttgcgctagtcatggtaaaaaacagccagatcgttgatgaattctatacattgatacagcctgagactccttttttctggcgaaatgtccaaattcacggaatccatcaagaagacgtacgcaatgcgccgaaattcccagaagtctggcaaactatccaaccatattttcaaaaaaatcgtttagtcgttgcacataatgctgcttttgatacaaaggtcttagcgggatgcttagattattatcatcttgaacagcctaattatctttctttatgtacagtgaaaagtagccgtcgcttgtttcctgaatttccaaatcatcgattgaacactgtgtgcgaaaatttgaacatccaattagatcatcaccatgatgcattggaagatagtcgtgcatgtgcggaaatcctgctttatcaagaaaaaaaattcgggacagatccattgaaaaaacttgtgactataaagtaaaagaatacttatgaaacacacaaagaggtcgtgagcctgccgtttcactccgagtcacaaggagcaatttcaaaaaatagctcctcatgtttattaaatattgtgactggtaaccgaggagctggcaggagaacaccgtataaggaagaggttgtgaaaaagctgttctgcatcaagtaataagaacagccaaacaaaaatagcttctgatatttttcatttggttggacttattaccgcagatgcaagcttttgaacaccgtttaccaagaggttgtgaaatcagcgttttgatctgagtattagagaaacaaacggcaaaatagttcctcatattttgctgttttttgagctaataccgaaggttagctgattgaacaccgtttattcagaaaaagggactgtgacacgtattttgtcatagtcccttcgtgtgtttttctgccttctcaaaaggatgacagtttctcactcttttcctatttcttctattcaatcaaataactcattttatatacatctaaaaattcgcctagatctgttcttgcccctctaggcatgaccgcttcgatttggaagcccatttttcggtaaaggtgtacggctctttcattacgaacttgaacgtcaagctccaatcgaaaaagtacacccatttccttcgcccaactgatgatttcttctagcataagagtgcctagtcccattccccaatattcctgcagaatactgataccgacttctcccacgtgagacaaacgaaattgactgtctgccttgacagatgctgttccaataatcgtcccttcatagattgcaagcagcaataaattattattgctttcgtatatataatccaactcttcttctaaggtttctggtggtaacaggagttctgcttcatccaaaactaaaaattctgtctccttattgacttgtcccatcatcaaaagaatgtcttttgcatctcctggcactgcttcccgcaagatgatcccaacttcttcactcatgattttcagcccatttttctagaattcgctgtttgaaggtttcactttgctccccgtatgagattagtttcacataccgtttttctaaatctgtatcacttttttctaaaatcagttccaaataatcctccggcagtgcttcttctaatagatttccccattcgacaacggaaagcccatcaccttcaaaatattcatctaaccctaaatctgctccgctagctgctacccgataaatatccatatgatacaacggaatccgaccttgactatattctctaataatcgtgtatgtcggacttttgatcatttgcgttatccctaatccttgggcaattcctttcgtcaacgttgttttacccgcacctagatcaccagtcaatatcagattgtcacctggcattgcggaatgaccaattgcctctgcgaattgttctgtcattgttaatcctgatagttcgatcatttttcatcttctcccgctcttctttctttttgccagtatatcgcgtaatgaagtttttttaaagaaaaaatgaactagtcaagaacagcagctgctgtttttggctagttcgcgtgtatttgttaatcaatcaatgtttgtgctgctgtgataatcgataatttatatacatcttcttcatttgctccacgagacaaatcagaaaccggtttgttcaagccttgtagaattggtccgattgcttcaaagttaccgaaacgctgagcaattttatagccgatatttcctgactgcaattctggaaatacaaagactgttgcttgaccagctacttctgaatctggcgctttcagttgtgcaactgaaggaacataagaagcatcaaattgcaattcgccgtcgatcatgtattgtggcgctagttttttagcgattttagttgcttcaactactttgtctacttctggcgatttcgctgagccttttgtcgagaagctcatcattgctacttttggttcgatatcgaacaattctgctgtttttgcagaatctacggcgatttcagccaattcttgcgcagttggattcacgttgatcgcacaatccgaaaagacatatttttcttgatctcttccacgtaccatgatcatcgctccgcttgtccgactgatgccaggctttgttttgatgatctgaagtgctgggcgaacagtgtcgccagtcgaatggatcgctccagagaccattccgtctgcaatccccatatacgtaagcatcgtaccaaagtaattcacatcttttaaaatcttttctgcttgttctttggatgcctttccatttctgcgttcaacaaaagcatccaccatttcatcccacttatcgtaattatcagggctgatgatcgtaaagctagatgttttgattcctctggcatgcgctgcatttcttatttcttcttcgttccctactaaaatgggttccacaagttcttctgctttcaaccgggcagctgcgcctaaaatacgagcatcagtagcttccgggaaaacgattttgatcccacggcgaacaatcttaaatcttaaactatcaaacaattccacaagatgacctccagacgtttttatatgtattatcatacactattccagaaaaaaagaacagtttattttatctgtatcagtcaaaaatgctggaaaaattaagtttttcacatacatagcgaactgcgctataacaggaaagcgctgttttattacactgtttcaggcagttgccaatcaatcggttcttctcctaacgcaaggagcgcatcattcgttttcgagaagggtttggaaccaaaaaagccacgacttgcagataacggactgggatgtggagatgttatgatgatatggcgactcttatcgatcattttgattttttcttgtgccggttttccccacaagataaacacgattggtttttcccgttcatttaatttttcaatgatcgtgtctgttaatctttcccaacctttcccgcgatgagaatacgcttgcccttcccgaacggtaagaacggtgttgagtaaaaggactccctgtttagcccatgacactagatttccatgttgaacaggtgcgattccaagatcatcataaagctctttatagatatttcttaacgatggcgggatctttacgccaggttgcacagaaaaagataagccatgagcttgattttctccatgataaggatcttgtcctaaaatcaccactttaacttcttcataaggagtcaattccaatgcttcatagatatgatacatatctggatggatcttttgggacgcatattctttttttaaaaattctcttagatgcagataataatcttttgaaaattctgaggacaaaacttcttgccaactgttatgaatgatttctttcaaaaactccacctcctaataaaaagaataactcacattttcttcaatcacaagggacaatcttcaccctcagcacttgattaatatggtaaactaggaacaagaagcagaaaggaacgataatcattatgatcaaattaattgcatcagatatggacggcacattattagatgcccatatgagtgtttctcctgaaaatgccgaggcgatacgttttgcaaatgatgccggtgttgagttcatggtcgctactggtcgaaactatcaagaagctcgcgcagctttagatgaggtaggaatcgattgtgcgatgatcactttgaacggggcacaggtatttgataaagaaggaaattcattgtttaccgtgtcgattccaaataatcaagcaatctctgttttagatattctagatgctaacggtatttactatgaagtagcaaccaacgatggtctttattctgaaaatcaagcgaaacgaattgaaagttttgcttccatggtggctacccatttacctcaccttacgtataaaatggcgattgccatggcctcagctaagctggagttattgcacatcacatacgtggacagtattcgtgctattttggaagaaaagaatctggaagttttaaaaattatttgttttcatacagaagggccagctgtattaggtccagttggaaagcagatttctcttttaggcgatctagccgttacttcctctggtcaaaacaatatcgaagtgaaccataaaaacgctcaaaaaggaattgctgttgcccatgtcgctcacgagcgtgggatttctttagaagaagtcatgacgattggcgataacttcaatgatgtcagcatgctgcaagtagcaggagtcagtttcgcaatgggaaatgcagaaatcgaagtaaaagattatgccaaatatacaacggacacaaaccttgaatctggcgtaggaaaagccatattgcgcgcgattgcagaagacttgtagttttatctagaaaagagggatatagatgtcagaatttttcattcaggaaaagcagcttggacgtgcaactcggacaattgtcaaaaacgaaaaaggacattccctgtttttgatggttggtcgctggggaacaaagggcgatgcattgtctctttatgccatgaatggcgatctcgttgctcacatcaagcagataagcctgacattcggtacgcgttttgagctgtataaagagttcgaaaaggtgggaaccatgcagaaaatattcaattggcccggtgacttttattatattcgtagacttcactggacagtccaaggtgatatctataatcatcaatatcaaatccatcatttcaatcagcaaatcatgaaaatggataaagcaacacttttttcaggagattactatgtattggatgtctcaaatgatgaagatgctccagtttgtatttgtattgctgcggttttagattactggctctaccgtaaagacaaaagtcgcgataagcctgtttcttaccgacttaacttaagttaaaaagatgtacctgaaatgcggaaatacgcatttcaggtacatctttttagatattcttttgcatatgatcataaagatgaccactgatcatccgctgaccgacaactttgaagtcatggcgttcgtataattttttagcctttggatttttttcatccacacttagaccgatgacggagcgattagctttcttcgccaatttaggtaatgcttctaataatcgcgaaccgatgccttgtcctctaaaatcttctgatacactgatagagtccaaataccattcgttgggaaacgtttctttatcaatgaacaaacgtgtagacgcatctagctgatatttctctaagataggtaccagtggctgatcgatgattgattcttcttcatctgtataaccgtaagcaactcctgcaactttaccgtctatttcttctacgatacctcgtgaataactgtaacgataatttggatcagtgattgcttcttctaaaatctctaaagtcttttgttcccctgtctgcttcaaaaatggcagttccatatcttttagaatcactaagatcaatggggcgatttctggagcatcttcttttctcgcaaaacgaatcatagtttcctctccttttctccattctaacatgcagaaaaagaaatcgcaaaatcgttattttaaaaaatcttcaatcttttcagtaatgaaataaccatgagtaacgattcttgccgcttcagttcggcaataagggcagacgactggcatttctttatcattatgttcgactacattattgacttcttcgtatgcaaatttttttccgcaattagggcatttcattttttccatgttatctcaacttcctttcatctttactctcttagcttactcttatattgtaaaaaagagaagcaatatccttcttctatgcagatatccatacctgacggtcctgttctccatctattaatcggactttataataaggacgttcatctttgactagaagtgtccactctttcacttttgcttttttcccgtagtagctgactgcttccttcatcgctgcttgcggttgtttgaattcttccgttttttctatatcaaaaagatgttctgcggccttttccgtgtcatttcgtacggttgttttcccagtggatggattgactgctatgacttgtccttcacaaaaaaactggtattcatatgttgcattcgtaggattctccaaatctttttcaactgcaaaatgaatagcagatatgttatgttcttttgtttcgttttttacgattgctgctgcttttttcaatgagatccgatattcctggtcactaatatcatccatgtgaaaagcggcattgagcagtcccgtcataccggtaatccctattacgatgagggcagcaacaccaaacatcatttttttcattcttcattctcctgtttcttttttttaaagaatatcaagaaatgaacgaatgaaaaatcgaatgaaacgaaaaaaaagtgacaattttgttatctttattcgtgcagttctaatggcaatccgtctggatcaaagaaaaacgtcattttttttcctgtaaaggtatcttctctaatcggttctgattcgatccctaaggactgcaattctgcaattgtttcttcaatatcgtctactttgaaagcaagatgacgcaagccacaagcttctggatagtttggtcgttgtggcgcattagcaattccaaaaatctccaattcagcacttcctagtttcagatctaatttatagtcatctcgttctttgcggtaattttctctgattacttcaaatcctaatttattaacataaaaatcacgtgatttctgataatctgaaacaatgatggctatatgatggatcgttgtaaggttcatatgagcactcctattcttcgtttaagctcggatctatattaatctccagttccattgtaaatgtgtcagattgaaaaaaatagctgtttttcctttttataagaaaaaaggaaaaaaaaacagaaagtaggtcctccaagacactcttcctgttcccaatataataaatgaaagtaagaaattatattttcaagaaaacaaacagaaaattatcataacacaaattatttataattgaaagactagttttttttcaagaaaagcatacaatagattgtgttagtaaatacagaacacactacatttagtgtcttaaggagtcctcatacatgaagtcatattttcagtttttagctcatcagctaaaaggctggccgcaacaaaattattatcttttctttttcagtcttggctgccaggtcatgaatcttgtcaatagtcccatcacttggctgtccgttattacatttatcggtaccacgcttggtgtattgtgtattttatccatcaatgcggcaaaatcagtcaacggtattttaggtattttgtctgcgatttgttttattatcgttgggttttcagcaaagaactatttaagtatcggtgaacagattgcttatatgatcacattggatatccccgtattgttaagtaaagaatggaatcataatatggcttcaaaaatccgaaaattcactggaaaaagctggtttatcgcaatcatcagtactttccttgtctatcttgtttcaggattcctgattggtcgttatacagatgatcctcggccgtgggtagatgccattgctttttctattagcttgactgctggtatcatcagtttcttgcgttacaacaaccaatattactggtggttagcttcagggcttgctcaaatggtcctttggtatatttcatttacgcatggatctgcaagtttggcgatgttcgtgaacagctctgtttacttgctgaatgatgtccttgcatttaccgtttcaccttggtataaccaaaaagaacgtgaacgtatgcaaaaaatggaagaagaatactacaacgcacaacaacacgcataaaaaaactgagcgtgggacaaaagtaaagaacacttttgtctcacgctctaaacacgtataaacggcggaatcagaagcaactccttcggaaataagctgaaattcacaaaaatttgaaaagcaattttcgtgaatttcttcttatttcttggagttaaacgcttctgtcccagcctctattttttatagtaattccttcagatactttcttgcctcatcattgaaacgcagtgattcttctaacttctgataatattccaacgcttgtttctgagcttcagtaaaacgataatgttttcctttccatttgtcgattgtctcttgcacatttccagattggatatctttcactactagttgccatttttcttttgagactgtacggtctttcttatcagcagattgtatagcttctcgttctttacgcaatacttttaaaaaaccatttctgactatccgaggaatgctgtcgaagaacccttctgtaaaaccatagcgacaatattgcttccaaataaatagatagatttttggttggatgaatcgttggtttttcgcaaaatattccatctgagcagtgacttctggtgttcgttgacgttttgtctttctcaacacggaaataaatgtttcaaaataagcattaggatgtactggcacttcttcatatacgatggattgccaatctttacgtaaaaatgcgcgatagttgatcaagaattcttctacatcctttactaattcttctgcaaagtcgtcaaatagttctttttttatctgtcgcttttttgactgcccattgatgtgttcacttattttcttgatttcattttccaatgcttgataatccgctatgtaaatcggcatttctacttggcgaaattctgcgagccgctgagctaattttatatccggtaaatatggctgtttcatccgacgattttggtacaagacaaaacagtatttttgccatagtccttcaggaaaatcgatattcttctgcttaagccataataattcgtctaaggccagatcaacttttgtcattccctgatggatcgaagctgccactgtcggagagacatgcaggtgatcggcaaagtggttgatgcctagttttaggatctttccggtttttggcgatttaacgatgtattgcacttttaattctctaccacactcacaatacaatttttgctggcttcgttttgttcgaaaaaacggattgatcttgaagtcagaaaacacccaatctgttgcagctaaataatgttcttccataaaacgagagctgattagatatcggcggtgcttatcgactagttcccgctgttttttcgttaattttgcatagatctcccaacgttgactgcttgtgtattgtttagaaattttgatgggatagcttttgctgatttcttttggaaaccattcttcaaagacggattgccattcttccacggctgtttctttcctttctaattacaaaaagctggctactaacataacgttagcaaccagccagtgtttcttgctaaattagtgagttgttccggcatttccggaaatatcttctttattttctactgctgcttcaactgcataagtcaaagaagaagcaatgtcttctaaagacatagaaggcgtacccactggacgatcgatcacttgatcgggtgagaatggcacgtggatgaacccacctcgaattgccgggaattgtgtttcgatcaaatgaagcaaacgatacatgatatcattgcagacaaatgttcctgctgtataagagatgtacgctggtagaccatgatcttgtacattttttgtcattgctttgattggcaatgaggtaaagtaagcggctggaccgttttcttctaaagccgtatcgaatggctgatttccttcattatcagggattcttgcttctgctagattgattgcgacacgttcgaacgagactgctgaccgcccacctgcttgtccgacacagatcacgacatctggttggtgctgttggatggcttctttgactacttgactgcttttttcgaatacggtcggtacttccactttgatgatttcagcaccgctgatttcatctggcattttttttactgcttcataggctggattcactttgtccccaccaaatggatcaaaacctgttactagtactttcatctgttgttcctccgtccgattgatttaacatatggttatcttttattataccattttccttgaacagcgtaaataaaggaaacaatagtttaaataacataacagatcaaacttaatatattcttataaaaaaatagtgttccactacaatgttagaagaggttgcgacaattattctgtcacaacccctctcttctattatttaaatagaatcatataagcaatttggaaaactagcataaataacgcaataaacaactggtttttgatcactccgtatttgtctttcatctccagcatcgctacaggcacgatattgaagttagcagccatcggtgtcagcagggtcccacaaaaaccgcaagtcaatgcaaccattcctattaacgctggattcgctccatgactaaatacgaatggtgcaccgatcccaaccgtcatcacggtgatggccgcaaatgcattccccatgattaccgtaaatatcaccatgccaagagcgtaaatgatgatgccgatgttcacatttccttctggaacgatcgtacctactgcattggaaatcactgtcccaactccagcgcttgtaaataccgcacctagagaagctaaaagcattggcaacatgcttaacggccctactgtgcccagcatatctgctgcatcatctaaaaatgtacttggtcgattatctcgagaaaagaacatcaagattagcatggctgcaaaaacaccgacgcccacgccgactaaagcacctaaattggtaaatagagcaaacaagatcgcaaagacaccgatactcaaagctggaataaaaattttcattcctagtttgtctgacattttttccatatattcttttgatggaagccggctttctcctttgctgactttcttagcaattgctggtatggtcatcgcaaagatcaagccaccgttcacgattgccggaagccatcttcctcctgcaataactacccctaagaccgtccagaaaaaggctgacccataacgatgaggattggttttatctgttaaatttcttactccagtgtaaatcaatacgagtcccatcacgatataaaggatctccagtaatttatcgcctaataaaatatcaggatttgtaaaaaagtccatcttattgcccctttcctggataatatttcttcgctaatttcttttctttaagatagaagtagacacttgccacaactaaagccgtgatagccactggaacttccactaaagcaagctgtcccaatgttacgtcatatcctagatctttcagtgttgattggactagcaacgcccctgctcctccgatgaatagtacttggccaaagaaccagcagacattttccatagctgaagccataccttttagttcttcttcatgcttaggatggacttctaacccttttgattcgatggtccccaatgccatcggtaaaatgattggacgaacaaatccagcaactccaccaaaactcacgttaaaagccgcaaagatcattcgaaagatcccataaatatctacaatcataccagcagatactttcttgaatcgcttgatcaaggaagccgctgattctttcagaccatttctttcaagcgttcctgttgccaacataatgatgataaaaatcgccatcccgcgattgtttacaaaacttgtacctaaaagttctaacattccttgaatgccaagaccgccagtcaaagctgtaacaactaaagcaaccattacgatcaatatcgagtctaatttaaatgcaaacccgagaataacaatcaagacgcctaaaaggctaagataattttccatatattttcctccataaaatgacaatatttttttaattataaagcaaaatacataaaaaatatagttgttttctcacgaaatagacactatttttaaatatttttcgttatttttttatcacaaaaattatcttacttattgtaaggtaaagctttttttaatttattgcccgataatatatagaaataaggtctagttactgtttttttaaatgattaataaataacaacttctttctatgaaattgcaaagcattcatcttcttttccgctaacgatatatccgtcagtgcttggtacactttactaaaaagtatgagattgccgatatctggataggtgtgctatactacagaaaaagatatacgatctgccaccgggtaggataaagaggatgatcattccattaggtctttgaagggatgattttcctctttttgtgtatttttttatagttaaggaggaatgtaagtatggcatggatggaattaatcatagcaggaattttggaagtattctggtcaacgatgatgaaatggagtgatggtttttctaaaatcaattattctttttacacagtgattggcatgattgctagtttttactttttgtcaaaggcaatcaaaagtttgccgatgagtctctcttatcctatctggacagggattggcgcagttggttcggtcataattggtgtggtcttgtttcatgataagctgaatctttccacttggttctttgtggggatgctactcatcagtatcattggcatcaagattactagcggccactagacacttggaataagtactgatcagaaaaaataagcctttttatttaatattcaatttttttatgaaaaaataagaaataagtccaatgacctagcgacttctccactcatcaggtgtatgcttgtactatctatagaaaaggagtgaatatttttgaaaagtctttcggtccaagaattatccaagaactttggtcacaaacaagccctcagcgatgtcagttttagcttatcccctggcaaaatcgttggattagtaggtcctaatggcgctggaaaaacaacgatcatgaaagctattttaggactgatccattactcagatggaacaatctgtattggtgaaaatgagatttctccctctagtcataaagggttggaacaagtaggagcattgatcgaatacccgggtatctatccattcttaacaggctatgatcatctgaagttattctctgaaaccaacgatgtatctgctatcgacactatcgtgaatcagctcaagatggaaaagtacattcacaaaaaagcgaaatcctactcgttgggaatgaaacaaaaattgggaattgctcttgccttactgaaccatccgtctatcgttattttagatgagccgatgaacggtttggatccacaagcaacaagagatgtgcgaaaaatcattaccgacttggctactcagggcacctctttcttgatctccagtcacttactcagcgagcttgaaaaaatggtcgatgagctgatcctgatcaatcaaggaaagatcatcaaacaatgtacaatggctgaattgaaccaaacagcgcaagatttcatcgttatctctacaacaaatgatctagctgctcgaacgatcttgacagaagctggatatactttggaagatcctgataaaatcaagcttttaaaagaaaacgaagaattattaggaaccgtgatccagctattgtctgcacaaaatatccatgtgacagacgtccagcatctgacgaatgatttggaatcttctctattggaaattctggattcagtaaagggggaagaagaaaaatgacattgcttgtaaaacaagaattatttaaattgatcaagaaaaagtcaactgctgttttatctgttctattagttgttttgctcataggaacagcacttctagccaaaaaatacacgacgatcattgatccagttgaaatgactgctcagctttttagtgccacatcttggattgtctttatcatgattgcagctgcaagcacgatcatttcgatggaagcacaatatggtacattgaaaaatctcctttatcgaaagtattctcgaggagaaatattagtaagcaaatggatcacattagttatttattctgtttatttataccttttagctattattgtcactgtgttgatgaaactgattcttttcccttcgatttccttcacggagaaggtttctactggtcaaacactgatccaaagcttgttcacttatactttgggtagttatatcggtttatggctgattttaagtttagtgttgatgattgcttgctttatcaatagttccggtgcatccatctcagcaggaatcgtcttttattttacttcgtcaatcatatctggtatccttattgcactcatccaaaaatgggagtggatcaaatggaatccgatcagtatgttgaatctgcaaaaccaaattggaaacgaagagatcatgaagcaattgactcatctttctactaatcaaatgctattcggtaatttagcttacatcgttttgttcttagcattaggatatctcgtatttaagcgaaaaaatgtatgatgactcatcaaaaaagaggctgtgaaagagacgttcagccttattgccgattggctgtctcttaaacaccgtttattctgaaaaaggagctgtgacaacatttgtgtcacagctcctttcctagtatgtttttgaataaacgacaggctcacaacctctctttatacttcttttatacttctatacgtgaagcatcccagtggcaaataaaaccattgcaatcactccgaccatcgtcacacctataagtaaaatcttatctaagtggatatgttgtacaggctcgttttgctccttacgtgctttgaggtaaaaataaatgcctggcaagaaaagaacaagaacaagcattacttcattaaaggctacgactagcatagcccatacttgaaaggcacttgctaaaagccctactaaaaattggacccattctttccgctgataagaaagtttcatttggtacaatcctaagaaaagccacgtgaagaaaatagctgctgtaccaagtgtgtaagcaaagttataagcactgtcagtgaataataatgaaagtaaaaagacattcgtacataacgtcgtcaatacgatagcataagttggtgccccatttttgttgagttttccccatgctttaggcaaaagtccgtcttcagccatgtttcccattgtttcaatcggtaagatcgtccatgagagccaaacaccaactaaagaaatgatcaaaccgccgttgatcacgactgctccccatttaccaaccatcatttcaaacacatagcccatagcaggctgcgccttgatcgtttgcagctgattcatcgtcattgtcccatatggaagcatggaaaccaagacgtaaataataatcaagccgaatatccctagaatcgttgctttcccaacatctgattgtttttttgctcgtgaacctacgacagaggctccttcaataccaacaaatacccaaagcatcaccatgatgcaactcaatacttgactggaaaacgggatcggctgtccattcgcattcaatataatgtcgctagaaaagttatcaatgaattgttggatcgaaaacgtgctgatagctactacaataaataaaaataatggcactaatttacagaatgtgacgatagcattgacgaaactagcattttcgactccccgattcactagccatgcatatccccataaaaagactgtactcatcacgatcgatgccagattttgcccaccttcaaatactgggaagaaatatcctaatgcgctcatcaacaatgttgcaaaagctacgttgcctaaccagcatgtgagccagtaaccccaaccgctgataaaaccagcgaaacggccaaaaccttcttctgcgtaactaaagatcccgccttttaaatctggacgttttttattgatattattgatcgacaaggagagcatcaacattgctgttcctacgagtacccaactgaaaatagctgggccgccagccgatccggagatgtccgtcataataccaaatacgccacctccaatcgctgaaccaattactaaggcagcaagtggaattaaaccaattccttttttctgttgctctgtatccatgtaagcatcctccaaaataaaaccgcttttatcaaaaagtataacaaaccttttttatttttacttaattaataaaaactttaatagaaatataattctaccggcttttttctcattatacaagcaaagcgcctagtccctttccaaattacaccaccaaaaaacttaaaaaagatgctatactaaaaggaaagaattggaggatgatccatgaacattttatatatatcgatttcaggaaatacgcgtgcctttgccaaacatctagcagaatatgctgaaaaaatgcatgcagaagatcctgtcaatcctgaagttactttaaaagaaatccatgaaaatagtgattttacgaaagaaacagaaccattttttactttcgttcctacttatttagacggcggaaatggtttagataacggtgatacagaaatcttgaccgaaacgatgcgtgaatatctggaacatgaagacaatcataaactttgtcttggtgtagtcggtagcggaaataaaaacttcaataatcagtattgtctaacagccaaacaatatgcacaaacatttggctttcctttcttggcagattatgaattacggggaacaccatctgatgtgacacgaatttatcagattttagcagaaaacaataaataataaaaaagaagaagctgaaaaatagatttcagtttcttctttcgtttctattgtttctatcatattaagctttgacatccatcacaggtgcttttgcttttgctttacctgttttttccaagacaaagttttttacacgatccatattggttaccaagacgatcatggatgtttctttgcctgctgctttgatcgcttctaagtcagcttctgctacaagcgtatcaggtgtcacttgctgcccttctgttactttcacatcaaatggcgtaccgcctaagtcaactgtgttgattcccatatgaagcaagatttctaaaccatttggcgttgtgatcccaatagcgtgtttcgttgggaagacagagctgactaccccagtaactggagaatagatatgtccgttttctggttctacaaagtagccttcacccatcatcttttgtgcaaaaactggatcacttgctttatctaaagaaacaactgttccgtcagcaactgatgagaggatagtcacactttcagctgaagtttgaggtactactttttcaggcacttcatttactgtggctgtttcagtcgctaattcttctttttctaaacggtctttaggaataccgaagaagaatgtagcaacgaagccaccagcataagctgccaataatccaaggatgtagcctaaccatttaccgtcagagatcaatgggatcaaagcggctcctgaaggtccaatagcgatagccccgacatttccgatcattccgatcactgccccgccgatacctccaccgatacaagcagtaataaatgggcgtcctagaggtaatgttactccgtaaatcaatggttcgccgattcctaggatcccgactggtaaagctcctttgatcatttctgttaattctttatcttttttgcagcgaatccataatgccaatgctgcacccacttgtcctgcaccagccatcgcaagaattggaagcaatagcgtacgaccagtttcatcaatcatttgcacatggattggagtcaaaatttgatgcagtccgaacataaccatcggcaagaataatgtgcctagaacgaagccggcaaatgctccaccaacgccaagtacccagttgatcccaccgaccatgccatcagaaatgaaacctgctaaaggcatgatgaagaaaatttcaatcagaccgatggcaatcaatgaaagagttggtgtaacgatgatatctaccgcatcaggtactactttatgcagttttttctcaacgattgacaatagccaaacagcgaagatgacacctaggatcccaccttgtccagctgcaagagcttcaccagtaaataagtttttcagtggtgcttccggattcatccctgtcagcatcacaacggccccgataactccaccaagagttggtgttgcaccaaaaacttgtgcagcattgatacctgtatagataactaggtagctaaacatcccgtttttcaagatgttcatcacatcgatatattgttgccatgttgctgcatcaagtgttccggctgtgactaagtttgctaaaactgcggcaatccctgccacgatcccagtaccgacaaatgcaggaatcattggcacaaagatattagaaatgtcttttaataccgatttgattttagatggtttttgtttcgatttttgtgccgctttcatttcttgtgcccgttcgtttacacggtcttttccagatgctgatgaatttgctgtagctgcacttacagaagaaagtttttctcctaatttcacgcctgccaaatcaaccatttgctgtgctactttgttcactttcccaggtccgatgatgacttgaagctgttcatcttctactacaccaagcactcctggaatcgcttttaattcagagacatttacaagatcatcattgatgatcttcatacgcacacgagtcatgcagtggacaatgctttctacattgcccatgccgcctgcccctttataaatttgttttgccagttcttccaaagtcagttcgttttttgccatggtcttttccccctcataaggtcccttttacaaatccgtttgcttcagctaattttgcttgagcttcctctttatcactatttgtcaaaatcatgacgatagccagcttaacattttgatctgcttcttcaaagtacttttcagctgtttcgtaatcagcttctgtcgcttgcatgatgattcgttttgagcgttcgattagtttttcatttgttggtttgacatcgaccatcaagttattgaatactttacctataccaatcatactgatagtagaaatcatattcaagataagtttttgtgctgttcctgacttcaatcgagtagagcctgtcaaaaattctggacctgcatcgacttcgattgggaaatccgcgtgtttactgatttcggcttgtttattgcaagaaatcgttcctgtgacagcaccgatcgattttgcgtaatctaatccaccgatcacatatggtgtacgaccgctagctgcgataccaataactatatcattttttgtcaaattcagcttgattagatcttcttgccctagctcataagaatcttcggccccttcgacagctacagtcattgcttcttctccaccagcaattagacctatgaccatttccggttctacaccgaatgtcggtacgcattcagcagcatctaacacacctagtcttccacttgttccggctcccatataaatcagacgtccaccttttttaaaggactcaatcgtgttagcaatcactggttcgatacttgtcagttctttttcaaccgcagcggccactttctgatcttctttgttcattagttgaacggcttgagaaatactcatctcatctaatccaaaagtttcttggtttctgcgttccgttgttaggttctctaaattgattttgctcatttttatcttccttcttttcttataaattgatagttcataccagctttgatttggttgatcaatggtagctcttctttgataactttagctactacattcactttttcatccgctggcaaatcatatttggttaattggatctcacccatatagcgcaaatacttttcgttatctaaagtaatagaccctttcatacgcgtagctgtatttcttgctgggataggcggaatctctcgaaaacgtgcatctgcgcttcgtatgacatctcttgcatcgtcttgccgattcgtatgcttccctaatatatattcgtaaaattcttcatctacaggttccgtatggagcaagactgtctgttctttttggaaagaagcaaattgctcctgaacgttttctgacagacctgcatctccgatgtaaacaatatccgtgttacttgctaatagatctagagcgcctgcaagaggatggatccctcgatgttcttccaaagttggcaatccttgatatagtgggcctctcaactctgtatctcctggtacaaaaccttggacaaggagaccttgaattttgagccattgattttttttctgataccattctttgtccagccctgtttcgggacgtggataataattatgccaagcttcaatctgtgagaaatcagcttctgcttctttcaattcatcgatatctttaggcgtgatcgtgctagcattcaaactgattttcaattgatgtgaccagtcggcaatctgctgattggaaatatgataatccattcttaaacctgttacaccaattgctttcaaaggcgttagatcttctaatgaaaaacccgctcgttccaatgcctctcctgaaatatcgaccatcaattctagtttattctttttcgcttcgcttcctagttcgatcaatcgcttttgatatgccgaaacatcatcttctggtatatgcatggaagtgaaaataccgacaaagccattggatgccatttggcggatatactgtttcttctcttctgacaaagaatcgttcataaatattgaaaagccaaacatattatccctctttttctgtatccgtcttcatttctatgactagagtatatatctaaagaaacaaaatttcaatacttttattaaaataattaaatttcatttctaaaggttgagtttatattaaaaaacttaacaactttcgaaaactttcgtcacaaaatattcacaactagtgactattatataagcataccaacaaacaaccctaacaacactttttcatttttaactccttatcctgctagctccccggctagcaggacctttttttatcaaaaaaacttgtaccatccaatcgattcaactaatcaacccaatgctgtcatgctgtgatactcatcctaaaacgttccgttttactgatatcagcttaaagcattcggttatttttgattagtaatgattgatggtacaagctcatacgtgcttttctatctggtataaattattttgataaccgttcctgttcccctgctggtgaaaggattgttattttttcaatttgttctacaggaaccatccggatctgctgttcttcgttttgtaggcggatcatcactcggtctttttcgaccgtttttgtcgccacccagcctgagatcgtttcatacttgctactcaaacgattcgctcttacttgtaagataactagactatgttcagtagcagctttttgcagctcaagaataaactttccttgcaatcgtacattcttagcatgttcttcagtgtcatttacaaaagaatcaaaaagttgatacgaagtatgagtaactaacttcgtaagcttcttcattggcgatactgtctcttcgttcatcgaatgcactcctcctttagctaagaaagtgttacttaattaattttattttacctaacattttacaaaaaaacaaggaaatgctctaacatcgccttaaaaagaaaacgttaactttacaaattgtttgttattttatttccgtcaacccaaatattccaccaatgatctaggccttctgtgatcaagtgatatgtctcatcaaagttattggtatagtatgggtcgggaacattttctttttcttttccaggaatgctacttaaaaacaaatggattttcccctgcgctgagcgtggtgctcttcgtttcagttcttctacattttcttgatccatgccaatgatccaatcaaaagtttcaaaatcgtggggtgtgatttgccgagcaaccatattcgtcatatctactttttcttggtttaatatttttttcgttccagggtgcggtgtctttccaacttcatacgtgcttgtagcagcagaatccacaaaaaattctgcttcccttccttctaatgctattcgttttctcagcaagccttctgccatcggtgaacggcaaatatttcccaaacaaacaaataaaatttttgtcatttccccatctccttttagcgatcattgcttttccaacaaaaaatttttctattactgttcttccaactcttcttttgcataaagacgataagaatataattccgtatccttggctaaacggaaaagctgcatagcgatttccatcggtgtttcttcatattcattcgtgatccaattgactaatacaccactgcaaccgtaagaaaaaaaacgagcataaaatagtttgtctcttgcagaaagttgtctttcttcatccatttgttcaaaaatcttgataaatgatttttggatcagttgagaaaactctttttgtaaaatttctgggtcagaaagcacagtatttgcataaaattctttcttctcagcaattgctttcagcattttcaatgcttgctcttcccaattatcaagtgaaagacattgtggatctaaataatgcaatgcatcctcacaatagacccaacgaagcaaatcgtatttatctgtaaaatgataataaaatgtttgtcgattgatttttgcttcatttgcgattttttggacgctgatttttcgaaaagattgcgtttggcacaaatcaatcaatacgtttttgatcaattgtttcgtacgtgttgtatcactcattcattttcctccaatctaaaagcaaaaatcatatatgatagtcgtaaccaaaatgttcataggcataagcagtagcaattcgccctctaggtgtacgctttaaaaatcctttttggatcagatacggttcatacatatcttctaccgtctcacgctcttctcctatgtttactgaaagcgtacttaaccctactggtccgccgccatataactcgatcattgttcgcaacaatttctggtcaacataatccaatccagcctgatcgacctgtagcaaagtaagtgcctgatccgctataggacgatcgattttcccgtctccttggacttgcgcaaaatcacgaacccgtttgagcaagcgattagcgattctaggcgttcctcgtgatcggcgagcaatttccaatgccccttcttcaatgatctctgtttgaaaaatatccgaagaacgtaaaacgatctcctgcagatcctgttcgtcataatattccatatgagaaatgatgccaaatcgatctcgtaaaggtgcagaaagcatacctgcccgtgtcgtcgcgccaatcaaagtaaagggaggaagagggaaatgaaccggatgtgcggttggcccttgtcctaccataatatctacatagaaatcttccatagctgaataaagcatctcttctaccactctaggtaatcgatggatctcatcgataaacagtacatcccctgcttccagttcattcaagattgctactaagtcacccggacgttcgatagcagggccactcgtcgtacgaatatttacggtcatctcattagcaatgaccatggccatcgtcgtttttcctaatccaggaggcccgtacaacagaacatgatctaaaggttcttcccgatttctggcagcttcgatgtaaatctgaagttcttgtttgacttttctctgtccgatatattgagaaagcagctgtggtcgaagagatttttccaaactcagttcattttcgccagattctggtgataacaagtattcatctgtcatttggtctcctccttattttttcatcattagcttgagtgcttggcgtagatattcatccgttgtctgattatcgacttcttttaattgtttttctacacgtttgatttctcgatcactgtaaccaagagccgagagagcttccattgcttcagatagagctgtagcgtcttttgtgtttgcttcatcaaatagactaaaaggtgtatcgatactcagctcaccgaattttccttttagatccaagatcatttgttgtgctgtctttttccctactcctggaaatttcgtcaaataagtgacatcactggattctactgcttgaatcaaaccggagtggtcttcgcttgccatgattgcaagggcacttttcggaccgattcctgaaacacttactaatcgcaaaaacagttgcttttcttctagcgaatcaaatccatacagaagatgcgcatcttcacgtattacctgatggacataaatttttattttttgatttagtttgctactgtagcggtaaggatttcctagtgcgatctggtagccgataccattggtttctactactatgtaataggggttgataaaggtaaccacacctgtcagatattcatacatattctagtcctctttcttttgcacacatacgttccctttattgtagcacatttcaccttgtgaaaaaaggagtctggggagcgtttctttcaaatagcaatcgcttgaataaaaaaagagcggacgatcgagtaaatccccgtattgtaccgctctttgtgtatttccattattctacaagtgatttgaattccccataacctaattcatccatcttttcatatggaatgaatttcagtgaggcagaattgatgcagtaacgtagaccaccttgatctactggtccatcggtaaacacatgtccgagatgagaatctgcttctttgcttcgaacttctattcgatgcatgccatgagaaaaatcggctttttcgcgcacttgtcttttcgttattggtttgctgaatgatggccagccacaacctgcatcatatttttctgcagagctgaacaacggttcaccgctgacgatatctacatagatccccttttcgtaaaaatcatcatatttcccgctaaatggtcgttctgttgcattttcttgtgtgactgcataagccatgggtgataacttttctttcagttcttctttttctggtcttattggtttatccattaaaaatgccccctttgtgatcctatcatagcgccaaagtggacagatgccaacaatttgctttcttttgaactatttacacttttcggcgtcgggcaaactcaacgaaacggaatttatctaatcggtgaaccgactcagaatactcgaaacagcgggtatcttccagatgaacgaggcttctgactactactgcataagtgtcatcgtgaagatccatcgctgttttcatgatgtccgttacttcttctactgtgatctccttttgcgcgtaagcaatcgtcagagaaagctcattttcaaaatattcatagatcgatccttgtgcttgtgctggagttaaaataggaacgatttcctttaatagataatcggtgtctaatataactacttcaccattgatttttctttcgcgtatcaaatgccaaacaggcgcaccgatctcccagccagtgatctcgttcaatgcttttgtcacttctgtttcttctaacgtatggatgatcgtttcacttggaatacgttgggtctcctgtagctctttatagctagtcaatccagaaataggaaagtcgaagcgattccgatccagtacgatcgaaccttttccttgttttttttgaatataaccttccgtagtcaaaagattcagcgcttttctaattgtttctcgtgaaacaccataaattttgatcaattggttctcactgggtaaaagcgaatgcggaggatattctttcgctaaaattttctgttccaaatctaaaaaaatttcattgaacttattcatgttttttccctcactcgttcttccatcatttcttcactatactacagctctttttgtatttcaatgttcctatttttaagaaaagcttattttaagctttttaaaacgatatcattttctctcgtactttttaataaaacgcttgcaattctctccgaaaaaaagtatagtaaatgaagaaacaacttgcatagacaagttaagagaaaggggtttattgatatggcaaaatatcaagcagatgccgagaagctgtttcatgatatcggcggaaaagaaaatattgctgcagttagtcattgtgcgactcgtatgcgttttgtcctgaatgatccaggaaaagcggacgaaaaagcgatcgaagatatacctagcgtaaaagggatgttcacgaatgcaggacagttccaagtcatcataggaaacgatgtttctactttttataacgacttcgttgcagtatctggagttgaaggggtttccaaagaacaaggaaaagcagctgcaaaacaaaaccttcatcccgttcaacgtgctattgccgttttagcagaaatctttacaccactgattcctgcaatcattgtcggtggattgatccttggattcagaaatgtacttgaaggtatccagtttgaaagtcttggtggaacaatcgttgaacactcgaagttttggaatggtgtcaatgcctttttgtggttaccgggtgaagcaattttccattttcttccagtaggtatcacttggagtattgcaaaaaagatgggtactacacaaatattaggaatcgttttaggaattacgttagtttctccgcaattattaaatgcttatagtgtagcttccacagccgcagcagatattccattttgggattttggttttgctcaagtccagatgattggttatcaagcgcaagttattccagccatgctggcagggtttatgttagcgtatctagaaatcttcttccgcaaatatatccctcagtcgatctcgatgatttttgttccattgttttcattgttaccaactgttttagctgcacacgttattttaggtcctatcggctggacagtcggaagctggatctcaaatatcgtaaatactggattgacgtcttctatcagctggttgtttagtgccgtattcggattcctgtatgctcctttagtgattactggtctccaccatatgaccaatgccatcgatatgcagctgattgcagatttcggatcaacgaatttatggccgatgattgctttatcaaatatcgcccaaggctctgcagtcttagccatcatcttcttacatcgtgggaataaaaaagaagaacaaatctcgattccagcaatgatttcttgttacttaggcgtaactgaacctgctatgttcggaatcaatttgaaatacgtctatcctttcgtcgctgcaatggtcggctctggattagctggcatgtttgctaacttgatgggtgttcgagctaacgcgatcggagtaggtggtttgccaggaatactagctatccaagcagaaacatgggtacctttcatcatcgcaatgatcattgctgtcatcattccatttggcttgacgatcatctttagacgtcagggaattttgaataagattgatcctgctgttcctgaaaatgctgctgatgtacaacttcaaacagcaaatggcgcaacagcaacgccacagtctttcgaacctgtttcagcaactggtacggcagttgcaacaaaagaaccattattcgcagtcgctgcagggaccatcaaggaaataactgaagtaaatgacccagttttctcacaaaaaatgatgggtgacggttatgctgtcgaaccgtcaaacggcaaagtctatgcaccagtaaacggtaaagtgacgagtgtctttgaaacaaaacatgccattggtattctttctaatgaggggctggaagtacttgttcacatgggattagatactgttgaactaaagggtgttcctttcaatgtattcgtgaaagaaggagaccttgtcacaccagagaccctgattgctgaaatggatttgccagaaatagaacaagctggcaagaaaactgacattattgttgctttgaccaataatgaaaaagttgcaggactttctcttgaccaaccaggacttgttcgcccgggcgaagcagtcggtaaagctgaagtaaaatcttagtcagagtagataagtaatcttttcaataaaaaaaacgggctatcatggattttcaatcgaaaatcagatagtccgcttttttgtttaaatgaatgttttcagtgcctgattgacagcaccaatcggaaatcctacgatactgtaataatctccagaaatttctttgacgaatacactcgcagcattttggatgccgtatgcccctgccttatccgcataatcccccgtctccaagtagcgtttgatctcttcgtctgtcaaaggataaaaagtgacatgtgcttctgctagtatccgttcttctcgttcctttgtttttaaaacaacagctgtatatacagtatgtgtttccccgcttagttttttcagcatgaattcagcctcagccagatcttctggtttacccatgatctcttgattgagaacaacagtcgtgtcactggcaatcactaaatggtcttctttttcatcttgttcccagacagttcgtgctttttcttcagccattctacgaacataatcgacgggctgttcgtctggaaatggcgtttcatcgatatcagcaggttcaatctcgaattctgaaacgatatgagccaataactcttttcttcttggtgattgggatgctaatacaatcttcatgttttccctcttctctttgacttaatgcgggtcttggattcgtttgaacatcctttccatatccgaattggtaaagtgaatcaatactggacggccatggggacaattgaaaggattttcgcatcgtgccagatccttcagcagcacacgtgcttgtgcttcattcaaataatggttggctttaatcgatcgtttgcaactcatcatgattgctgttgcttcacggaatttttttacactcacacttccagttgtcagcagcatatcgatcatctcccgaataatcgattcttcttctccattgggataccaagtaggatgggcccgtacaataaagctgttttgaccaaattcttctaaataaatccctgcatcttctagcaagtgtttttgctcttttaatttcaaagcatcactgtttggatagtctaacacaaatggaacaagcaattcttgcagatcatcagatacttccccaattttttcccggaaatattcatacttaatgcgctcttgggcagcatgctgatcaatgatgtacaacccatcgctactttgggcaaaaagatacgttccgtgcatctgtccaaaatattccaactgaggaaaacgttgtactggtttttccgtttctaatttcttgatggcttgttctaatgttttgtcgtttccttgagtgaaatcaaattcaggatggagtgtcaattcttcctcgtaaatcttttcatcctcttctacggatttatctgcttgttcttcatttgttttctccatgttatccacaatgggaaattctttcttttcagatttttccactgttttttctacaaagttatcaacattttcaccaaacttatccaccgttttcgctgttttttctggataagtggtgttttcttcagaaaaaccagaatagttttcaacattttccacagacttatcaacaattctgtcaacaaatgtgttctttggttcttctacgaaaaaggttcctgtctctcgatcaaaattcaaactacttggctttttaggtttttcttcttcaaaagcgtaggacaaatcgatttcgatttgttctgttttaggctgatcgggtacttttttcttaaaccgtagattatccgctgcacttggaatcagattttcttgagacaatgctttttgaatggcgttactaattagctctgttagttctttttccttcgacagccggacttcctgcttcgtcggatgaacatttacatctactaaaagcgggtccattttgatttccaatacagcaatagggaaacgaccgaccattaattttgatccataacctgcaacgattgctttatttaaggaaaaattcttgataaaacgtccattgatgatcgtcgataagtaattccgactggcacgagtcacctctggcaatgaaacataaccaaataactcaaaatctagatcttttccttcgattttcagcattttttttgcggtagataacccgtagattcccgcaatcgtttgtttcagatcgccatttccagcagttgccaacattttgtttccatcatgtactaaacgaaaagcaattgttgggtgacttaatgccagacgattgacgatgtccccgatgtttgctaattctgtgtgcagtgttttcacgtatttcaagcgggctggtgtattgaagaacaggttgctgacggtaatcttcgttccttgacgcagaggtgctggtcgatgctcaataacttctccgcctttcagcgacagataggtgccttgtttttcttcctgatttgccgtttccagagtcatttcagaaaccgaggcaatacttggcaaagcttcccctcgaaagcccagcgttcgtatgcgaaaaagatcgtcgcgattatggatcttacttgtcgcatgccgcttgaaggcattctctacgtcgtctgccaaaatgccttctccgttatcaatcacttggatcgtccgcagtcccgcttcttcaactaagatatcaatctgagtactaccggcgtcaattgcattttccactaattctttcacgacggaagctggtcgttccactacttctcccgcagcgatctgattagctaaacgttcagataattcttggattttggccatcgatatccgccttcttcctacagttgtttttgtaattcatataatgtgtttagtgcatccattggcgtcatttctagtaaatttatttgcttcagtgattcaatgacttctgtttcattttcggataattcaccgaataaagaaagttgttggttttcttctttgacactgtcttgtatagggtcttggtttactttttctgcaggtggttttatttgctcctgtttggctgttttagttttctcttctatttcagctggaacagtatggtgtccgttatcgccattttctagcgtatgcagaatatctgctgctcgttctagtagattggaaggcaatcctgcgatctttgccacatgtatgccatagcttttatccgcaggtccatccatcattttatgcaagaagacaacttctccgtctttttcaacggctccaacatggacatttttaagctgcggaagttctttctcaagtaccgtcagttcatgataatgagtagaaaagagtgtttttgcttgtacatgacgatggatatactcgatgattgcttgggccaacgccattccgtcataggttgctgttcctcgccctagttcgtcaaacaaaatcaaactgtttggcgtagcataacgcagggcttgattggcttccatcatctctaccataaaagtactttgtccagcaattaagtcgtcacttgcaccgattcgggtaaaaatccgatcaaaaataggtaaaactgcttgttttgccggaacgaaacagcccatttgcgccatcagaacagttaatgccaactgtcgcatatacgtacttttaccagacatattcggtcctgtaatcagcaagatcatttcgtcttctgccatttctacgctgttagggatatattcctgatgtcctaatactttttctactacaggatgtcgtccgtctttgatcagaagctgatgcttgtcactgacaagttctggccgaacatactgatagcgttcgctgatcgttgcaaaactttgtagcacatctgctgcactgattgcttttgcaagtacttgtagcggctggatagcctttttgacttcttctctcacagctaaaaacaactgatattctaaatcaacagatttttcttctgcttcgaggatttgtgtctccaattcttttagttctggtgtgatgaaacgctctgcatttgctaaagtttgttttcgttcatacttctccagttctgcatttccaagatttgcttttgtaatttctatataataaccgaaaacgcggttaaatccgatttttaagttcttgattcctgtttcttgacgctcttttgcttcaagttctgccaaccatttctttccgtttctcatagcagaacggtacgtatcgagctgctcattgaatccatctttgatgatgtttccttccgttatttgtaacggcggatcatcttggatagcttggtcgatcaattggacgagatggtccatcggctgcatttctgaaagcagactttgccattgaccttgatcgattccttcaatcaaccctctgatcattggcacttgttctaaagaagttttcagctggatcaagtctcgcccattgacattaccgaaagctactcgacctgctaggcgttccagatcatagactttcgttaatgctgactgcaaatcgatacgttcaaaataactgtctagcaaagaagcgaccatttcttgtcttgctttaatttgttttgcctggataagcggacggtctagccattgttttagtaaacggccacccattgctgtttttgtttcatctaacaaccatagaagagtgccgtgctttttcccagtccgaatagattggcttaattctaggttgaattttgaataataatccattttcaaaaaatgatctggttggtattctactgctttttggatatgagctaaactccgcttttgtgtcaccgataaataagtcaatagtttgccggttgcttctttttccagcggatcgactagttcgcttgtcaaaaagctaaattccgcgttttcttccatctcattttgttgagaaaagactagccctaaacgcccgcttagctgttcacgaagggtatcagtgatctcactgcctaatacgagttcttttgtctgcaatgcagaggcttcatttaaaacagcttcttcatcatgcaaccgagccgtcttcaattctcccgtacttaaatcggcataagcaaagccaaattcatttccttgactaactacagctgttaaaaaattgttgtcttttgccgacaatcctttgctgtccatgactgtaccaggagtgactagctggatcacttcgcgcttgaccatccctttagtcgtctttggatcttctacctgctcgcaaatcgctactttatagcctttttcaatcaaggcatcgatatatccttgtgctgcatggtgaggtacaccgcacataggaataggttcttctgcatttcgatttctgctcgtcaacgttaattccaaaagctgtgacgctttgatcgcatcttcgtaaaatagttcataaaagtctcctaaacgatagaacaaaaaagcatcttggtattgggccttgatgcttagatattgttccatcataggagtatttttagttttttgaggcatgtttttcctcctctatttgtccattgatttcttcttgtatcatagttgttaaatgatgaagcagatcatctgcttccaacagctgttttctataagctacaacaagcggatgctgatcaaattcttgcatgaattgatccgcttgtttgattgcttcttgttctgctgctggtttgtcatagtgggcaaaatgaacagcatctttttgcgcttgtttgattttttctctcaactcagctaaatactggttttgctggatcttttcttcaagttctttgtagcgaatgatcgtttcattctctcttaaaagttttgtcagtttccttacttctttttgaatttccggctcctgctgcaaaaaactgcctctctttctactccatgaacggtcgatcatcgttgatctgaatcagctggatctcttttgcatggcctgtcgtatcatccaattccaagatacagccgcttaaaatcgatcggccttgttccacaacttcaaaacgttttggtaatgcggtcagaaacttttcgattacaggttctctgcgcatacccaaaataccatcatagggacctgtcatcccaacatctgtcagatacgctgttcctcttggcaaaattcgcgcatcatttgtctgaacgtgtgtatgtgtaccgaccactgctgaaactttcccatctaaaaaccagcccattgcttgtttttcacttgttgtttctccatgaaaatctacaaaaatgatcggcgtacgttttctggcttcttctaccagctcattcattttacgaaaaggatcatccaagtccaccataaaagaacgagcctgcatgttgatcactgccagttcgacttggttcactttgacaaagaccatcccttgtccaggcgtcccttccggaaaatttgccggacgaaccatctttttagcttcatttacaaactcaaagattccgcggttgtcccacgtatgattccccatcgtcacgacatctacaccgtcttgcaaaaattttttatagattttttctgtgattccacgtccagaagcggcattctcaccatttacaatcgttacttgcggacggtacttcttcttcaatctaggaagatattcagtaatcatctctcgtcccattgaacctactacatcaccaataaacaatacccgcacactaaattcctcttctcttttaacatcactctatattatagttgttttcaataagaaagaaaaggtcaaacaaaaggaactctttcctggtatttcttagttttgaaaaataaaataaaaaaatgggactatgacaaacatcttgtcacagtcccatttcccgaataaacgttgtttcatctatttcttcagaaataagccgtaattttacaaaaatttgagaagcaattttcgtaaatcccttcttatttcttgaaactgaccacttctgtcacgacctcttccttaaacggtgttcaaaagcttgcatctgcggtaataagcccagaaaaacgaaaaataggaggagctattttggtttggctgggcttattacttgatgcagaacagctttttcacaacctcttttaaatcacgcttaactctttcaatgccttccaaattccatcctgatcgtttgtatcagtgaccatcttagcttctgcttgtacttctggcacagcattccccatagctatcccaattcctgacatgcgcaacatttcacggtcgttttgtccatcgccaaagctgatgatgtctttatgagggatgcctacttgttctgctaagtgcagaattgtcgctgctttagaaccatttttaggtacgacatctacactgttctcatgccagcggacaaatcgaattttatcatatgaagagaacttcccatcatatgtttgatcgaaaaatgctaacgcttggtatatttcttgttcctctgcaaaaaactgatctaattcaggcaagacagcaccgaaagaatgcatcgcttcttccatcaccgttacatcattggaagaagaacgcttgatattgtctaagctgacaaaagctgtatcgatctgctcacgatgcgcttcttgaacgaacgcatccaactggtcgcgatctagtaaattcttatatacttgttcatggtctaaaaaaccggccgctccattacataaaatgtagttcgtaaaatcaagatcgcgaatgatctcttgcgcatgaaatcggctccgccctgtagcaatcgtgaccagatgaccggctttgcgtaatttttccaatgcttctctcgtgctatctaaagcttgtttgtttgaatctaacaacgttccatcaatatcaaaagcaaataatttgcgtctcatctcttgtcgtctcgctttcttataaatacttacttgcctctcgaacagctaacttactcaaatctgttgtcagctgtctttttacccaatcggcatcggtcttactataatcgcgtaatgcccaaccaattgctttttggataaagaattcctttgtttgacgatcttcgtctattgctcggatcaatagtcctgtgtctgtttgctgtttataacctaattgcaacgtgattgctattcgacgtagccaaaaatcttcctttttttcaaacaattgaaagacttcttcacgctgctctgggtaggctttacaccatgtgctgtatacttttctccaagagtcgatgctgtcccaccattcttttttctgaactagtggcaacaatacgactaagtcttcaaatgtaagccgtttgatgtttttctggactaaatcgatcgctacatactgatactctctttcgatttgttcataataataatgaacaaaagctaaaacttcagaaatagataaatttttgctctcatccagtaacggttgttgtaaaagagcgcgttccggcttaggtactccagcaaaggaaaaaagatttttcatgtacttttccatttgtaacgctttttcctcattttttggaaaaactaaaacttccatggcacttcccctttaatgaacgactttttagtccacataggatgattttgactgattcagccaagcatatcccagtcccattactaaaccgccaccaatataatttcctgccaaagcaaaaaacaaattatgtaacacattgctgactgtcattccatccatctgtccgtgagaagcaaagtaagcaagcgtaaaggcaggaaaattcgctatcacgtgttcatatcctaaaaaagcaaaaatgaaaatgatgaatacgactgtgatcacttttccggcatcctctttcatccgcatgctgatcagtacagcggtattgacaacgatattcgcaaacatcccttccaccaaaatcgttgctgcaggttttgctagttttactgctattgattctaacataaagttgtccaacgttaaatcttgaaatggcgtagtcatagaaattagaaatccacataatataccgccaatcatattgaaaaaaatacaggcaaatagaatcttggctgccttacttaaagcaagtctctgccgaaaaacacccacggtcatataaagcatattcgatgttcctaattcggcgttcatgtatagaatcatgaccagaccccagctgaacataaatgcgtataaaatctttcctagaccatgcgcgatatcttcccccttcatcgcgatcgcaaatgccacagccgttcctaaagtcaaaaacaaacaggcgagaaccgctcgaacagcgtaacgtgaaaagctgttttcaaaaagattcgccttcttttcaattgaagcatcgattttctcaaataatggtgataccggattcattgattttctccttaaacttccttcgcttttttccatttgcacataccctctcattttataaagacagcctaggtttgtaaagcgtttttatgtactaattatcttgacattcatggatgatctatcatatactgtagtttgtgtaaaataatgcagcagaaaaataataactcatccctagtttgttgccccgtctcgggttcgattgtgtaaccgcggctgcaaaggtgaagattgaagaacaaactatatgattatgaatttttcaacggattattttactccaaaaacttatattcattggaggaaattttaatgtctcgttatacaggaccatcatggaaaatttctcgtcgcttaggcatctcattgtcaggcacaggaaaagaattagcacgtcgcccttacgcaccaggtcaacatggacctaacagccgtggcaaacaatcagaatacggcatgcaattaactgaaaaacaaaaacttcgtcacatgtacggaatgaacgaacgtcaattccgtaacttgttcgtaaaagctagcaaaatcaaagaaggtaaacatggtgttaacttcatgatcttactagaacaacgtttagacaatgttgtttaccgtttaggacttgcaacgactcgtcgtcaagcacgtcaattagttaaccatggtcacattttagttgatggcaaacgcgttgatatcccttcataccacgtagaagtgggtcaagtgatctcagttcgtgaaaaatcacaaaacatcgtaacagtaaaagaagctgtagaagcaactgttggacgcccagcattcgtaagctttgacgctgaaaaattggaaggttcattgactcgtttaccagaacgtgacgaactatatccagaaatcgacgaagctcttgtcgttgaatactacaaccaaagcttataatttcaaaagctttcttgaaaaagaccgctatctattggatagctggtctttttttatattttctatttacaaagcaatcactttgttttacaatttcgttaaccaaataaaaatattaagttaacgaaaagaggacattatgaaccgaacgttgaaagaattgatacttgctgcggaatttgccgcgattatttctgtcctttctcagatgaccattccttttggtttggttcctttgacagggcaaacatttgctattggattaacagcaacttttctcggaagaaaactaggattgatatctgttgcagtttatcttttacttggcttgattggtcttcctgtattttcagggatgactggaggtatagctgttttatttgggccaactggcggatatttgattggatttctcttacaaacgtggataactggttggatgatcgaaagaacggatgctcattacttatatgcaatctttgccaatctaatgggctctcttgctgcattgatctgcggaacgatctggctgaaaataagtggtgatcttacttttacaactgcatttgccagtggactactgccgtttttactgccggaagcaatcaaggcaactggagcagcttatatcggtatcttgatgaaaaaacggctaaatcgatttcttcatacaaattaatcaaaaaagcagcatggaagaagactttgagtcttcttccatgctgccatattttaaattaaacagatctttattttgacaaatccacttttttaccgatccaataaataattatcccaccgacaatcattgatgccaattctcctaaagcaatcacccaccaattcaagaaaaaaggtagttgatataaaatcgttagctgaccagctactgtaaacatggaaaaagcaaatacgcatgctgtcacagccattttgattttcatgtttttgatgcgactagtgattttatagttgataagcaatacaagcagcgtgctgacgcttcctactacaacatctatcagtccaagaggagaagcaatattagccaaagctactcccgctgttaccgcgacgatgtatcttttgttatacaaggacagatagttgaacatctccgagagacgaatctgaatcactccaaagctagagacagacaaaaccagcgtcactgccacatataaaccagtgactagcgccatccgagtcacatctgtcgttgtccagcgtttggctgaacgggtattatttttttccatgttctatttctcctttgcaagataattttatcttggtaatgactgcgaccaaaggatgggaagaaaattccaactgaagtgccgcagaaggtagtgaaaaagctgccctgcaacaagtaataagaatagtcaaataaaaatagctccttatatttttcatttggctggacttgttaccgcagttgcaagcttttgaataccgtttatatcaagaggtcgtgaaaagccgcttagtttcgaatattaacgattattaaaaagaattttttgaactggctgttcggcatcgaatgtcgggaacagtcatcgactttttttatcatcaaccgttgtttctctctttagttttatcatacagaagcttgaaaaaaacacaaggttattttaacaaccatccgccgtcgattgggatgatcgttccttgtatgtagcttgcttgaggagaggcaagaaataacgtcagctcagctacttcttccggctgtgcccatcgcttgactggtgtttcatttgccacccactctgccatctcacctttcccttcaaaatcagccgcattcattggtgtttggatggctcctggagcaattccttttactcggataccctgtcctgcgtaatccagagcgagttgtttggtaaatccgacaatcgcatgtttcgcgcttgtataagcgatcccacctccaccagcaatcaagccagcaatcgaagccatattgatgatcgttccgcttttttggcggatcatatcaggaaggatgatttttgtcagctgatacatgcttttcacattcgtctcataaatcagatcccacagcgattcgtcagtttccatcaagggtttgtaggcatccaatatccccgctgtattcagtaaaatcgtaacttcaccaaaatgattttggcatttcgataccgcttgttggagttctttcatttgtcgaacatcacctagtgcgtaggcaaaagtttcaggaaatcgcaaagaaagttcttccattttaccgaacttttgatctaatccaaatacaaaagcatcttgttcaagaaacgctcgggcttgcgcagcaccaattccagaagcagctcctgtgataaatacaacctgtttagctagatctggatactggtttttcattctacgatcgcccaatcatctgctaaaatatcacaaactgtaggagcgaagctggaaaaaccttcgtcacttgttttgatcaataagtacggcgtcaccggacagccatcaaattcatcatcggatacgagaacaacataaagttcaaatccactccatcctttacgaataatctttgcaccttttttcaattctggtaaaatttcttcaaatgtcatcttttttctccttctttgttatggttttaatagtttttgtttttgaatcatttcaaatttttgagatagttggatgtaatcaattaattttagttcttcagtcacaataaaatagtcaagatccgcccatggtttgcggtggactttacttgtcgaaatcagaagatcaacttctctcccccgataatctgttggcagaaaaatcagctgatactcattacggaaaaatgtccgtaatccctcctctaacagttgctcttcaaataatgggaaatctgtcattaaaaggatcgtgatctttggaagctgtggagtaaaggctcctaatgttttaaacacagtcagataccgacccatcaaaaacgcatgatttttaaatgccagatgattgggatgtttgtgtctactttcaaaaaaatgtacgagccattgtttcaattccttgttttcaataactaaatgattaataaaatcactactattgccatcaatcgtttctttcgcattaggaaaaagataggcgaaaaaatgactgctgaataaatagttttctgcctcgaaggttagattttctgctggcagcccctgctcttcctgataaagagaaagagcggcttttgcttctgaaagggttgtaaagggcggtgtttttgcttgttgatgaaaatcaaaaattttcttccgtatcttaggatcactataatattcttcacgagtcatcagtacaagaaataatgcgcctaactcgtcttctacttgaaaataattaggaaataccggctccatgacttggcaaaatcgctggaacaacagattgtcagaaatcagccgtctttttttctcattcaatacaacataatgcttctgtgattttcttaaaaaaaaggcacctagcatgtattccaatcgtctttttttgatctcgttcagacgaacattaaaaaaagccatgatatgttctgccatattctttacgtccatttgagaaatcgtttcaaatggccagattttccctcgaaacaactgccagaatgtcatatgcaagtaaagtcgaatgatttcttcttcgccttgagcgatatatgtacctcgttgcagccgaattccgtaagtttgcagttgctgtttccattcattgatttttcgatgagcagtagattcactaatgtaatgcttttgcgcaaattggtacattgtatggaattcttcaaaaaaaatgtcgtgcagcaactggaatttcagcgtactttgcacgagatagatcaaaaaacgctcatgttcaattgaatcgagcgtatcataaaagttataaccagaacggtgattttttgtaaacaaagggtgtgtcttaccgctaaactgctgatagtttttagacagctcgttcaggtatttcgacacgctgcgggcatccagctgaacaacttgcgctaattgtgcagcggtatgccaagcttgatcctcaaaactttctaggaggagaatcttataatatagatctttatcaaattgtttaagatactcggaagacaaatacacgtctttccctccttttttatgctcgaacgttttggttattgtagcataaaatagtggttttcgcatcaaaacaagccagcaaaaggctgaaagaataacggtagcaataaaacggtcaatattccgttgacgcatatcgcaagtccggaaatgattccttctatttcgccaatctcgattgcttttgctgtaccaatagcatgagaagtacttcctaacgccacaccgcgagcaactggactttcgatcttgaataggcggaaaatatgagtggcgatcagcgaaccaaaaatacctgtagagacaacaatagcaagtgtcacggcattcaccccgcccatcgtatgagataaatcgacagaaatagccgtcgttacagatttaggtagtaatgagatcaccatctctttatgaagagagaagaagtaaccgaaccctacactaaccaagcaatttgcgactattcctgctaaaatcgcagccattacaggataaaaattctctttcagtaaacggaagtttttataaagagggatggcaagtgccactgtcgcaggagtaatcagcatagtcaaaaaattgcccccgatattatagtctttatagctgatcccagaaaaatgcaaaaataagataataacaacaatcgataatacgagaggattcaaaacaggcagtttatatttccgcaaaaatttatcagataatacatacactcctaaagtcaaacttaagccaaatagtggattcacaaaaaactcagtcaatttgattttcctccatttcgtttacagataccctttctgcttttttcttacggacatagcccagcaaagcttctacaccttctgccgtttttcccgctgcaaccatcgtgacgatggaacatacgacgactgctcccagtaaaacaggccatatcgaagcaatatcatcaaaatattccaataaacctacaccagcaggaacaaataaaatagctagattattcaataaaaaatcaccagttgctccgattttttcaggatcaacaagatgcatttcaaatgctaaaaataaaaaaagaatacctaagatacttccaggaataggtaaatgagcaaaaatccgtatgccttctcctaatacagaaaagaaaataataatgaaaaactcttgaaaaaaattcatcaaacaacactccttacgtatagctttcattttactaacaaaccttttctgaaagtttcaaaacatgctgtttctaagatacaatttttgagaaaaaaaacgttttttttttggtatatttatagttaagcttggtgatttgtggagaacttttaaaaagagttggagttttactgttggtctggtttcttataagtaatggaattcatttttttattcacatttgttaagactgcagaaatccttccgacacgaaacactgcaccgatgcttttcgtgttgatgtttctttttttttgcatttttataacttttggaggtatttatggattactcactaatgacccgtcttgcggcggaaatgattggtacagcattactaatcgttctaggtaacggtgctgtagcaaacgtagatttaaaaggtacaaaaggatatggcagtgactggatgctgattgctgtcgggtatggattcggggttatgatgccagcaatgatttttggtggaatcagcggtaaccacatcaacccagcatttacaattgctttagcatctaatggtctattcccttgggctgaagttgttccttatatcattgcacaattgattggtgcagcgattggacaattgatcgtagtagcttgttacaaaccttactacgaccaaacagaagacgtaaaccatgtgttaggtacattctcaacaatcaacagcgttggttctaaattcaatggtttcgtcaatgaattctttggttcattcgttttattctttggtgccctaggtattacaaaagcaccattcttccaagataatcttggtacagctcacttagcactcggtttccttgtatggacattagttgcttcacttggtggtcctacaggtcctggactaaacccagcccgcgactttgctccacgtcttgtacacgcacttcttccattgaaacataaaggttcttctcaatggggatatgcatgggtaccagttgtagcacctatctgtgctggtgtcgtagcagtattcttatataaattattatttatggcttaatcaaaagctaaataaaaaaacttggtgcagcgattgcgtaccaagtttttttatttttagaaaaagcagtcggactttctaaaagaagttcactattcgatcctgtcgatgatttcttcaggaaaatcgtctatttgcttgtcaattttgctgtctttgtatttctcttcttggatagtcaacaaaatctttgtaagattcccccagtctactgctcttggcggatcgagccaaaccactacttgagatgcactttcttcatatagattattcctattcgtgattataacatccgggaactcaggctttcctgcctctatcacttccgtgttcagattaatgtacaagcttaaatttttcttgataaattgattataggcagcaccataagaaaaatcgatgatgatctttactggttcagaaatcagttgaatgggtatgtgattgatcaataataataaataactgaaaaaaagaaaaaatttatcttgaagcaactctttgcgttttgacgttagatcatttatatactctatcaaatagcaataaaatgctggatagttttctctaaaaaaagaaacatcaagtggaaattcatcagctttattaatagtgtaatgcaaaagtttaaaatgtattttggttaactctcttcggatcaattggctcgtctcttctcgcaacagattaaactgattttcaaaactttcaatgaatcgttcattcaaccattcgattgtttcatcttcattttttctcaagtatttttgatccaatttatcatgaagataaagccaagagagtgtcttattgataaaaataacggatttttctcctaatactccttttaagtggtaaaatcctatatccgaaaaaaatagcgactgattgctagcaatatctaaagaatcagcttgttcagccaacaggttgattgctaaaaagtggaataatttctttttttcataagcagacagaggataatactgttttaaatcttttaacattttttctgtttttataattataggtagcgtatacaattccacaaaacttatctctgttgagttaaaaagattatataaaaaaagccgaatgtttttaggattccctgtcaactttctcttttcaaaaaaaatttgatatttttttagatttctttttagtctttgtaatactttataagccacagaataactcacgtgatgctgtttagcaaaattttctactgagatatatttttcctgaaagaaagccaataccattttcatagataaagaatccgttatataacgagataacagagctttgctagaacattttccattaatttccagacatatatccaattcactgacggttactcgcaaatttttctctagatcgaacttttgtaaatcatgtttcagcttatcgatcgtttttttcaagagaaatgtcgatagcgacaactcttcttgaacattcgatattgactctgataaatttgagcttgattctaaatatttaagtaatgaataacttctgtgatcttctttgcttaaaaaaaactcataattcattagtcatcagctctttctacgtatattactttccatgcattcaccaactagctggggataaaactgatttcctggatccgagtcactgttgtcagcgattcttgtttgtataatatacatcgtcctgtctttttttaacattttggagagcgttttatttggcctttctcgcgatcaaacctgttataagaattatatcatttactagtatgcatttttattaataaaatggtatattttatattattataaaaagagcccaaccatcctacaataataaaaatttactatttgttatcttaaccttacttttctttctcttctttttttctcaaaaacaaacaaaagtatgcataataaaataaacaataagaaaagtgaagctactaagatataaatccaattattgtcttttttaatcgtaacatccgtcgtgttcaattccttggctacttttccgtctattgtaaaatctttttcaaatacccattgattggtatagttgatcgtagtatttcctttttttctcgaaaattttccattttcattttcatttcctaaaacagtcattgtaaggtgatattcacctggggttagcggttgaccatttaaagcagttggaaaagaaaaatttgtattcggagcaatctgcaacgcttctttttcttctcgatataaaactttagaatgccctttttttgtaatttttgtttcaataattacttgattgatgtaagttttttgatcattttgaacgtttgctaagatgacatttcttgcattgatttgatctggtttaacttcatgaagagtaaggttcggagcaacttcgttcagtgtctgtcgcatcaacaaagcaataatataggtgtattcattctcaatcgataagctttgatccttagtttctgtttggtccttttccgtctggatttcttggaatgtgatcccaccagccaatacaccatcaaatcgctcattcggcatcctgacatgaaaagcaacggtttggacacttttaggttttagcgtcactatctgtggatagctcacataatctaccagatcaaagatcaggctcatgtctttttcaatctcgttttttccgtattcaaccatcacatttgaattggtggttgcgctattcacagaaatatcgattttcacttctttttctgtatcatttctcaattccgcttttacttctacttcctgatccggatcaagttgaagatcgaagtaagtttttctcttgtcgatttgattctctgaagttatcggcgtcactgaaaaattaaatgcactagctgacactgatatattgttaaaaagtgcccctaaaataactaggagtgttataaataattgttgttttggtctcaagaaaatcgctcctttaatcatatgtaagagaagactataacaaaatcttgtctctgtgggacacaagagcctatggtacctgtgcccttcttgaaactcaataattttgttatattcttctcttcctgttaatttcctgggacatctgcaagtatccaagatagtttcccctcaaaggttccgattctttggttttctacaggaatatctattctgatcccacgatgagctgtagaatctaaaagagaggacaaatcgctttcacccttttgatcactttcgaaaatcgtaacagcggatgtccctataaccgttgtattttcagaggtaacaaaggaaagagcttctggaagctcaaaatctccatttgtaagaactttctcttgtttcaattgtaatttccaacttccaaaagcccgttcatctataattttcaacccacctgaaaactgtccgaattcacttaatggtctactggatattttatgttttccaaaattgacatattgaggagcagttgagagataaagtttgccttttctgtaataaaaatagatatcctctgtattttcggagaagatgccttctgtattcgctgaatccgagtcaaagacatacccttcaatatcaataggagtttctttatacttctctcctattttcccagtgattgttttcatttcagcaatatcaatctgactgtctttatctttataataaacatggatatctatctccttcagctttgcgatctttaggtttatttcattcgattgctcaatcaaattctcgttttcaaggtattcaaaatgcatagtgagtactttttcaggaattacttcctgcaaagttgtctccaattcgattattaacgtatctccagcaataaaataatctgtcagatttagcgtgactcgatttccggttatcaagatatctttggcatcaatttgatttccattgatcaagatatgctcgggaatagttaattcttgtggaaggtcgatactagtctgcattttcttatattcaagaaaatccccctcgaccttcaatgtatttctgatagttatcttatcgtttcctccagcttcagcgatggccccataatcactatcgttgacttttacatcagctgttgatgtgacattcgatggaagtcgcgtgacagcgacagcattttcttgaaaaaaagtacctgttgaagaagtaaacccccaatttacttctgtagaaccaaactgcctaatgagatcaggtataatccgagaagagcgaccgacaccttccaaatcataagtaagacttctttgctccgcgtcccatttaattattaacaagcgccatgtgccattagaaagaaatgtaggagctaccgtcacgccagtatgctctccagaataattattattatttggtttaggcgtgacaaaagcgacatgtccatgccctctattatcagcagttatctctcgatccattcgatcagaagaaccactatttttatacgtatcaaactcaatcgagagcgcattcgcaatgtaaggttggccagaacgagtagaatatgagccaattcccatacctggcgatccaataacttgactgggattactagccattctaggatcgccagtcaatgtaaaggtcatgccatctcccgctctatctcgttgatttcctaagtataaataagatttaaatgtaaaatccgagagtaaactaatcttcttatttgaccaaatagcacctctttgagacctttctgctgggttcaactgcagtaacttcccattttccaatatggacgtgctagtaccgataggtgtttgaaaaattttatcgatagaaataatattgggatcgtcaggcagctcaaccgcagaaattggtgcatcttccagtccttgtttgtccgaaccctcagcttctacgttgtcagtggtctctccactactcgaaatacttaaatcctcactgctttcttgtgtctggttggattctattaaactgtcgaatgtcgaagtgagtttgctttcttcgtctcttctatttccatgctccaactgattcaattccaaagagtaccctatgatcggaaagatattagtcactaagagactgcttaaaatgagcacgatcctcctctttttcaatatatcttttcctcctgatcgttaaattcctagatgaactattcgtatccaaacaaatttagcctagcctttgacaatttttgctcgattacctcgcaagacaatatgactacgtatttatttttaacagttcttttcagtaaactagttgttaggtgtatcttctaatgtccaaactaatttagtggaatattgttgcgctaacttgacagatttaccgggtaccgaaagctgtaccgcatcttgattttcattttcatttgcaccaaatcgatagacccaagtccccacacctgttcctgatttagcattaattgctaacgtattgtttcctcccggtgtcaacgttaattcagaattcaccgtttgcggtgtatatgttggatcaaccaaagaaacagcctgccctttcgtaaatttcagctgtgctccaactagttcatccccactggcagttttaaactgttctggttgagagacacttaatttccacccagataaggtacctctcctatctgtcacttggacatatgtcggttttctagacccatcgttcatcacatcagcagctgcataatacgttttatccgcagtagaaattttttgagtcccaaatttgaattttgatccataatcaatcgataatgcccctcctgttccagggcttggaggatctgatggatcgacaggtttattgggatcaggattctctggatcaacaggaggagttacaccctcatctcctgcttcaaatgtaatcgttccttctgtgttatattcctttgggtatacttcagttgcagaaacaaaagtcgtacttgctaccatgctgaataacatcgttgctgctgttaatacgatttcttttttcatcattgacattcctctttctttatttactaaacatatcagtcgattggattaatccatagcaaaattctgttttacgatacttatgaaataaaagaacatagacctatatttggtcctatgtatcgattagttataaatgattatcagcccgatttgatttctagtttttattgcaacttgatgcaaaaacaatctagaaatacagctgtcatagcctttaaaataattcgtaagtccccctcctatctatcaaaatgtgacttgactgcctggacttcaatcaatattaattataattaaatacaaaatgtatattatatttttttttgtgattatcgttcaaaaaaagaataaacgcttgcatctagtactccgcgagttacaaatcatccgatcaaataaacattcgctgattattttccacaaaaaaagcagcatatccacgataaatggatctactgctcttacttatccttatgttttacaaggtattttcttttacacattactaatgctgtctcaatacggaacgattgtcatcgcttgttcaaattcctcttgcaaatgttgtgtttgataggcttgaaaggccggatgatgggcacgcaagaggacacgtaatttcatgggttcatagctatctaacagctgttctttcaagacaaaatctcgggtcagctgccattcataataataaccaaaaggtctgcagctgtaaatcgtgtgaccgatggatttatcttcaaagcgacgatgcgtatggccaaaaactacttgtttgatatttgaataacggtcaagtaattctccgaatgattctgatcctaaaaatgcatttaatttgttccaacgctcataaggagcagattgatacatgataaatgcccgtttaggaacgaaatgagtggataaaatcacctcaagtttttttgcttccagctggtctagcaaattttttgcagctgcaagcatttctgcattgacctcgagatctgttttcccacgctggatgaaccgatcataccaatacaaacgcttcattcgtacgattgcctcgtaatctttcaattcggaaaactgatagtcgtaccagccattcatccctaaaagaacggtctgctcatttaaagcaatataccgttcatttaaaaaatgtgggtctggaaaatggtccatcatctgttcattgggcacatctgccaactcgtgattgccgaaatgaaatgtcgtagataatcctttattggcgaaaaattcgacaaccgctaggcagcgatctactttattagccgtatctccggctagatgaagccgagtgattttgtgcttttgcaaaacttgccaaagctgcattagctctggttcgccgaatttattgatgtccacatgtaggtcgctgatgattgccaaatttcccattttatccctctagtcttttcgaacaacttgcaagttgccttttctcaagccgcttggtccttttaattgtaaactattataagttggttctaaagcaagtgtggatggatcatccatgtaaagtattgcactgtctttgattttgattggtccaactggtgtatcagccactacagaataaagacttagatctgtttgtgtatcttttttaacaatgatcaatcgaaatgccgtgtctaattgacaactgacttggctttctgcaaatggaccgtcaccgttttcgatatctaataaaagttgatcgtctgcttctaatttattcttcaatacttcttgtgcttcttttgtcacttctaatttcatctgtatcacctcatgtcatagaataatcactttattcatcagatgcaactaatttgtctggttctgactgttctcaatttattggaaagtaagtcattcgtttattatgatttctcttatcacaaaagagacaactttcccttttcttcgttcagtttcttgaacggaaaaagacccaaaaagcaacctgttatttgtttaaccttattcctttcttaaataacaaaaaatactataaaaaataaaaaacctttaacaactattggaaaaagaattactttttgttcacggattattaacaactcttcggtagagtaaacttatcaaataaaagacttctttggaggaatcactatgaaggaatatataaaaaacatctattttatcgaagaaacacaaaatatcgagggttcttatattgaagtaaaaacactctttgtcaatgaagataaaaccaaagcattggatatttataaaaaattagcttcaaaaaaaacgaatagttttggattgatattaagcgagtataaaatcaaagcagaagaaagttatttctatcaattattaaaacggtggagtaagcttcccgccgatttttatcgaaaaatgcagatcatcaactatcaaccgcttgctgagacacatgcctaaatagaggttgtgaaatcagtgctttgagctaataccgaaggtcagctgattgaacattgtttagaagagattgtgacaactgcgatttgctttgagtaataagaacgctggacagaaaatagcttctcatattttctagtctagtggacttattgccgagaagcagcagatggaacatcgtttagaagagattgtgacaactgcgatttgctttgagtaataagaacgctggacagaaaatagcttctcatattttctagtctagtggacttattgccgagaagcagcagatggaacatcgtttaaagaagagatcggtacaaaataaaaatatctaaatttaagttttatctaagtttcgctttgtacctttgattcaaatcaaaggaggcgatcttgatgctgaaaaaatggatcacactattttttgccactccccattctagaatcaacccgtatgatgtagataatgaattcacgttgaaaaaagatttcccaaataaataaaaaccatccgtaaaatcatcaatacgattttacggatggtttttgataacttctttgaggataggctcttgctatttaagaatgtaagaaacattattgttacatagtatgagagtttaatcctctgttatttatgctatttaaatgcttgattcacatcttcgatcatcagtttcattgattctaaaccgcccccgcttaaataccagacatctggttcaagggagatgatctgctgatttttaccagcattcgtttgtgctaccagttcattggcagaaatatcatctttgctgtcgtctccaccaatagcttttgttctgtctaccacaaataagatatccggatttttttctagcacatattcataagaaacactttgaccgtgagtggatgcttcgatttgatcatctgcttgttcaaagccaaataaatcatggatgaaaccaaatctagaacctgatccataggctgataattgcccttcattcacaagtgtgactagtgcttttttgtcagtagcttctgctttctttttcgtctgatcgattgcactagataattcctctaattgagttttagcttcttcttgcttaccaaagatctcccctaaagcagtgacattttgctggaaagattcccatggatttttcgcatctaaagaaaggaaaatggtcggagcaatttgacttagatctttttgaaaatctctttgccggccagaaatgatgattagatctggctgaagctgattaattttttctaagtctggttcttttattccacctgctgattctacttttttataggatgaaagatactcaggaaggctgcttgtagctgctccaactaccttatctccaacaccaagagcatccatcgtatctaaagaaccattgtcgaatacgacgactttttctggattatttggcacctcgatttggtctccattactatctgttatcgtcaatgtagtttcagtttgtgtgctgcttttttttgtgtccgactgactggtgttatcactatttccacatgctgctaaaccaaatgacgctagaatcaagatacctactactaattttttcatctcttctctcctaatgttagttttagaaataaagacagaatctgcgaccttcaatctcacaaattcgtatgtccatttcgtacaattcgtccagtacatctttttttatcatttcttgggtcgttccttgcgtgaataactgcccgtctttcattgcaacgatctcgtctgcataacttgcagcaaagttgatatcatgaagaacaataacaattgttttcccgatttcttgtactaaattttttaaaatctgcatgatttgaaccgcaaaattcatatctagattgttcaaaggttcatccagtaaaatataatccgtgtcttgcgctagcaccattgcaatatacgcacgttggagttgaccgcctgaaagagtgtcaatcgattgatccgctatttcttctaacccaaggtgttccagtgattcctgaacgatttcctcgtcttttgtcgtcaattttcctttcgtataaggaaatcgtccaaattctactaattctttcacggtgatttggacatttatttcattcgattgtcgtaggatcgataattttttggctaattcattggatttccaagcctttacttcgttatggtctaaatagatttcacctgtatcttttggtatcaaacgactgatcatcgacaacaccgttgactttccagcaccatttggaccgataaaagcagtcaacttcttttcaggaatcgttaactgtacatctttaaccactgattttccatggtacagtttattgaccttttgtaaatcaatcataggatactcttcctttcgcgaatcaattttgtgacaaaataaattcctccgacaaattcaacgacgacactcactgttgtattccagccgaaaatctgctctactgcgagctgtcctcctgtcagaaacagcatagctaccagaaagcttccgataaatagctgaccatgacgataagtagaaaagacacgataactgatatttgcgacaataaaccctaaaaaagtaactggacccacaagagccgttgatgtccctgtcaaaagactgacacaacataaaatcaaaaattcaaaacgatctgtgtctatcccgaggtttactgcttgttcatttccgagatggaaaacgtctagcacatgtcgatatcgaaataacaggtaccagcagccgataatgatcaaagaagcaggcaaaagatactgactctggatattgccaaagcttgcaaataatctgccttgaagcaaatcatattcattcggatccatgatgacttgtaaaaaggtactgacactaccaaaaagcgtacctaaaatcatccctgacatcagtaataaaaaaagattcgctctcatttttttcaaaagaaagaaaaataacaacagactcagcccgaccatcagcccaacgttcaataagaaaaaacctgtacctgtctgctgaagcatcgtcactcctccgataaagaagaaaaggaccgtttggacaaggacatataacgactcaagtcccaatactgaaggagtcaaaaactggttatgcgtaattgtctgaaagctgattgtggcactgctgacagctagcgagacgaggataaatgcaaaaattttcttactcctcaatgcccatgcaaaatgccagtttccatatgtatggatcgtcaagtacattcctgtaacaaataaaacaagaacaagcataccaataaaaatagatggcttttttttaagcatatcgtcgcccccttatcagaagataaaggaagatagccccaccgatgattccaacgatcacactgactggtatttcataaggaaaaatcaacacgcgagcgacaagatcgcaaaatactaagaacaaactacctgctaaagcagttacgccaattgttttgtgcacttgatctccatatattctagagacaagattcggaatgatcactccgataaaaggaatgcttcctaccatgatcaacatgactgcactagccaatgatactaagccaatgcctaaaaactgcatcttctggtaatctattcccaaatttactgcaaacgattcgcccagaccaatgatcgtaaatcggtaagcaaatagccaaaccaagagcaacaatggaacaacagcatacaataactcataatttcctcgtatcacagtcgcaaaattcccttgaagccatgaagtcatattttgtaccaactggaattgataagcaaaaaaagtagcaactgaaccaatgatattccctaacatgactccaatcaacggaagcatcaattgatttttctgggggaacaatcgcgtaagggataaaaaaagcaatgttcctgcaaaagcaaagcaaaatgctgtcaaggatcggacaatcaaggatgcaccaggtaggaaaatcatagccactaaaatacctaaacgcgcactatccatcgtgcccgcagtcgttggtgaaacaaatttattttgggtcaaatgttgcatgatcaacccacaaatactactggtcgctcccacaaggatcaaacaaatcgttcgtggcaaacgagtcgctagcaagatttgtaagctttgcccatctaactggagcagttctgacaattgtacattcgatactccgatgaacaatgaaatactacttaaaataactaataatgctactagtcgtccgtagcgcatccaatccacctttctaattgagaatgattttcattcttattttaagtgaatcgttgaacaaaagcaaccgctttttcatatgttttaggtattattgggaatatgctataatcgtaagaaagacaaagagaagaaggagggtattttttatggcacaagatgatgtaaaaagccatttggataagggactttatggtacacctttagtgaaccctgaagaacagcataaatatttagggacattcagggaacgctgctatcttagtatgactgttgctgaaatgatccaaccaaaaaacaaagaaaactttttaaaagaactcaaaaaacatccagatgcttccatactcttgaatggggctctacccctttctgtccaaaaccaatatatccagctagcaacgaaaaacaatagccgtttcactgtagtcaacgattacgtcactgcaaatcctgaggaattcggattgctcttaacagcaaaagaagcagtaaatgaacctgtgattgatatcgaaaaaaaatacccagaagaaaactcttcgccagctgaaaaagaaaaaccaaaaaagaaaaaaagcttctgggatcgtttattttaaaacgaaaaaacgcataaatttttacatgcaaaaaaagcttttgatcagattgacatcaaataggacaatctgtcaaaagctttttcttttaaaatacttcaggatataacaatttcaatacattcatcgtcaatcttctgccttttcctgcaaagggataaacatgcatatgcatcgctggattgaaatttgcttcgatgatcccatatgcttttttatcagttgtaggatcgatttctttatctggtataatcaaatcgataccactaatcttagctcctagtgcttctaccgcagaaacggcgatttttttgtaagcttcagaaaattcatcagtcatatcgatcgaatcaccacctgtactgatattggagttctcccttagataaacaatttgattggcttggggaactgattcgatcgtcaacccttgttctttcaacatcaattgttctaattcacctaattggatcaattctaaaggtgcacgatgattcgttccacgcaaagggtcactatttttttcttcaacaagttctttcactgttcggataccgtcaccaataacattagcagggactcgcaacatgatggcttggacttctccgtcgatcacaaagaaacgatattccgttcccggcataaattcttctactaaaaccgaactgtcttcacgaaaagcaatggctaaacctgcttgataatcttccagactagctccttccttgaaaatcgtgatacctaacccgtaattggttgatttaggtttgatcacaaatgcctgctcggcaaatctcggataagcttttaccgcttcttccatggatgaaaattctgcgcctcctggtacccggaacccagcttcttttaagacttttttcgttactgttttgttttccatgataagtgggacgatatagctgtccttacttgtcatgtttgcatttttcacatattctacatggtcttggaattgcagacgcaaaaattgatccgactcatctaatactttgacttggacacctttttggatagcatcgaacataaatatctgagtagaaagttccatttcgcgaaaaccggccaactgatagggacgttcatggctttctttataatattgatgtcccaatgccacagcaacttcttgctgactcgatagctgtgcttcttgatagagtttcgctgctaacgtttgttcaggatgatccatttgagtcaatgcttcctctactaaataaagagaatccaaccaatccaattcaaccagcatttgcttcatcccttcaagaatttctctaccttcttgatgaaattctgtttgatctgatggttgttctagtgctactttgttatttcgagtcgtaccttctgctacccattggtcacagtcttctttttcttctgtccataacatgtacatcaggaataattgtaagaaccgaacttgctctggattgatacccaatcttgcataaggattcaaatcgatattccgcaattcaatataacgaacacctgttgttgctaaatctgcgactttctttccgcctcggaaacgaagcggcgtataaaattctttctcctccgaaagtttcccttcttcgatcattcgctcgatatctgctaaatactgtttcatagaagcataggaaactttcacatttggatgattcgtatagcccagcgcactgttacgaatactgcgaacaggttcttgcggatgtgattcatctaaaaagtagttcttctcactcattggtgaagcaccgaataaataagtgatcatccagcgatagcgcataaagtttctcgccgttttcaaataaagttctgttttgaattcggaaaaatcttgaaattcttcctgatggctgaacaatgttcttagcaactcatcgccaaattcaaaattgaaatggataccgcttaccatctgttttcgcttcccgtattcttttgctaaataacgtcgatacaagacatcttcgaaattttttaattttgcaataatgatctcttcgtctttttccggtaaggcaggtggcatacttaatggccagatcatctcttctttcggtatagaacgagcagtcacatcataaacagcagcgagatactgaaataattcgggaatagaatcggtaacaggggtgatcatctctgtttgtgtttcgctaaaatctgtttggatataggggtgataggatcgatcgccaaagattgctggatgatcggtttttgctagatttcctgcaagatcaacccgctgtccttcccgttctataccaaatcgagcttggtcgataaaagggcgcgcattgacatgcaataataattgcttaaaattcatcattaagtgacctccaattcatatgaatctaattataatcaaaaagtctaagaaaaagaacgaaattgtttgagaaccgcttacaaataagtataaaaatgaaggcatcaaaaacacagctatgttaaaaacaatcattcaaacaaggagctgcaacttttgtcacagctcctgctttttagacatgggttattcttcttttagtaatcctttgaacaatccaacgacaaaatcatttgggtcaaacggctccaagtcatcgattccttcaccaagaccgaccaatttcactggtaaatgcaattcattacggatagcaagtacgataccgccctttgctgtaccatctaattttgtcaaaacaagaccggtcacatctgttgtttctttgaattgttttgcttgaaacatcgcgttttgaccagttgttgcatctagtacaagaagtgtttcttggggtgcttctggtaattcccgctggattactcgttttattttttctaattcgttcatcaagttcactttattttgcagtcggcctgcagtatcaactagtaaaacatctgcctgctctgtctttgctctttccaaagcatcgaatacgacagctgctggatcgccgcctgcattgccacgaacaacttcaacaccagcgcgttcgccccagacaactaactggtcgattgctccagcgcggaaggtatctgctgctgccatcaatacttttttaccttcgtttttgaactgatgggcaagtttaccaatacttgttgttttccctacaccattaacaccgacaaacaaaataactgttagtccgtcttcttggatatttagttcatttacttcattgattccttccgcttcatagagatccacaagtttctcgatgatcgcattttggacttctgccgattttttcgcatttctgagtttcacttcttgacgtaatgcttcggtgattcgtatcgctgtttcaaaacctacatctgcaccgataagtgtttcttctaattcttcaaaaaagtcttcatcgactgttcgaaaattggcaaacaactcattcatccgttcaccaaatgttttacgcgtcttttctaaacccttgtcgtacttctcctgtacttcaacttcttctgttttctcttcgccagtaaaagcacgcttgattttatcaaaaaatcccatttgactcccccctactctaatacaaatttttggatcactttggctacgccattttcttcattgctggctgtcacgaaatctgctgcttctttgacgaaaggcacagcattctccatcgctacgcctagtccagcatattggatcatcggtaaatcattttcctcatcaccgatcgccatgatttcttcttgtttcaatccaagatcttttgccaataaagaaataccataagcttttgtaacgccttttggcataaattccaaaagcatacttcttgttttgatgatctcatacatttcatggaattctgctggtatttctttgattttaggatctaattcttcttgatcataagcgattactgccttattaagcacaaattcatctgtaatatcgcttatatccgctggttggaattgcagcagcttattcaacacattgtataaggattgcttccttggggcactaggcagctgtaaaaccacattgtcagacaaaacatctagtggcagatccaattgctgagccaatttgtataagcgttggatatctgatacttccatcactttcttttccatgatttcaccagtatcatttttttgtaccaaaccgccgttgaaagtgatgctgtagtcaccttcatctaccagtcctaattcttgcagataatgcgccatcgcagctaaggggcgtcctgtacatagaacgatcttgaccccttgctgttttgcttgtgctaatgcttgtttattctcatctgaaatcagcttttgttcatttaataatgtaccgtccaaatcgattgctactaatttgatcattttcgttcctacactttcgtttcgttgattttcgcctcttcattgatatcttccatccgtacagaaacgatttttgatacaccggattcctgcatcgtcactccgtacagtacatctgctgcgaccatcgttcctttgcggtgtgtgactacgataaattgtgtgtcatcttggaaatcgctcaagtaacgaccaaaacgtttcacgttggcttcatctaacgctgcttctacctcatctaagatacaaaacggaacaggacagacacggataatagaaaagagcaacgcgatggctgtaagtgctcgttctcctccagaaagcaaacttaaactttgcagttttttgccaggaggttgtacttcaatctcaatacctgttttcagcaaatcagttggttctgtcagtactaattcagctttaccgccgccaaacatatttggaaagacaattttgaattcttgacggatagcttcaaatacttctttgaatcttgtccgcacttcatcatccatctcatccatcgtttcaaacaattggtttttcgctgctaacagatcatctcgctgtgttgctaagaatgtatgtctttcactgacttgttcgtattgttcgattgaatttaagtttactggtcccagtttttcaatctgttcttttaaggatgaaacctttgttctactgtcttcgatatcggttgtttcttgatagtcttgggaagctttctcaaatgtcagctgatattctgactgcagataggtcaaatgattatctaaaatcatttcagctcggtctttttggacttctaatttggattgttccgacagtcgtgctttttgctcacgattacgctctgccaagactgcttcaagcttatcgatctccttttgccttctatctcgctgctctttggcttttgccaactcggcttttaatgtttctcgctgagcagataattcgttaatttgtttttccaaactttcttctgtgacttcatgatcagaaaagtctgctgtcaatgtcgccaactgcttttctatcgcttcttgacgttcggttgcctctgctttttggactcgagcaccgcggagctggatctgcagatgattaaactgctctttcaagacagcaagatctgcttgttcttgtgctttttgactttgtacttgtgctcttctggcttccatctggtcgctttcttgacttaacgatttgatttcttcgtcgattttttgtcgttgcgattcaagatctgtttgtttgtctttcaattcgttcgtttgcttttcgtaatcttcgataaactgctgcagttcacgtgtctcaaaagttgagatttgcttttctttttcaaaacgttcaagttcatttatgatgttttgcagctgatttgtcgcttcttgttcttcaaaacgtaattgttcgcctcgtgtacgcaaaacttcttgttcttcggctaaacgagctgtttcttgttgcagctcctgaacttttttttcttgtgcttggagttgtttatctgcttcttcaaattcactagtcaactgtttcaattcttgattttgtacaaacaaactgccttggtttcctcgtttattcgctccacctgtcatggatcctccggcattcatcacatcaccttctaaggaaaccactcgatattgatagcggatcgtttgcgcgattgcattggcactagttaagtctttggctaaaaggatcgttcctagcaggttttgaaccacagtttggatttgatcgggataactgacttgttcactggcaatccctataaacccttctacagctgctgcttgtgtcaatatatgagccggtaattgtcttggtttgattgtcgtcagtggaaggaatgttgctcttcctcctctttgctgtttcaaatacgtgatggcttgccgagcatctttttcattttcaacgatgacatgctgggctgccccacctaaagctgtttcgatagctaacgtgaaatctgcaggaacatcgatcagttcagccactgctccgacaatacccgaaagctgctgtttatgctgcaagaccaatcgaaccccttggtaaaaaccaaaatagttttcttggatttcttgaaggcttttcttacgagcacgcagctgctggacttgattcattaattgatacattttaggctgttcttttgctaatgcttcttggaactttttcccgttttgttggatcatttctaacttctcttttgtttcagttaaagatgattttagctgcgcctgcttttgtgtcaattcttctttttgtaagatcaatcgatctactgatgcttctacttccgattgcttggctaacgtctgcttgctttttgctgtttcttgtatatattgacgttctagatacttcagttcgtttcctacagctgcttgttcttgcatcaaatcaacatattgatctcttaattctgccaataattctttcgttgatttttggtatttttctaattcttgctgtgtttttatgagatttgcttcagctttttggatctctgtttctttttctgctgcttctttcatcaagctttcttgaagcttttcaaaatgtttaacctttttttgtgcttctgctaatgaagtttgatattcttgcgagcttttttgtgtatgctttgtccgctcctgcaaaacatctttttgtccttctgtctgcttcagtttttccgaaagatctaataatacttgctgatttttttcgatcagacggtcggcttgcgcattttctttacgctgcttcgccaaaatggattcttgttcttggatcgactcagatagtttgcctaattctagattgaatttcgcaagctgtgcttgtttgttgtcccaatctttttttgctgtcttgatttcagcaaccatcaaagagacatcggtttgagtcagtgtttcttttagccgtaaaaactcctttgctgcctcactctgggcggccaaaggagttaactgttcttccaattcgtggatgatgtcttggacgcggctgaggttgtcttctgtttcaaaaagcttctgttctgctttctttttccgctgcttgtatttcaagacaccagctgcttcttcaaagatcccacgacggtcttccggtttactactgaaaatcgcttctacttttccttgagaaatgattgagaacgattcttttcctaatccagaatctaagaacaattcttggatatcttttaatctgcagctttgtttattgatgaaaaactcgctttccccagtccgtcgataacggcgggttacactgatctcattgtactccaatggcagataatgatcactattgtctaaaatcactgtgacttctgcaatattcagctgcttacgggtatcggaaccggcaaagatgatatccggcatttttccgcctcgcagacttttagcagattgttctcctaatacccagcggatagcctctgtaatattgctttttccgctgccatttggtccaaccactgctgtgacgctgttttcaaaatcaatgactgtcttgtctgcaaatgatttaaaaccggctatttcaattcgtttcaaatacaaagctttccctcacttacttttacagtgctgccaatgcattttccgccgcagcttgttctgctaattttttcgattttccttgtccagtgccaatcaattgatcatctacataaacttcgatccaaaatactcgttcatgagctggaccttcttcattgatcaatcggtattcgattgatacatcacctgatttttgcaagacttcttgtagttttgttttatgatccatctcatgtgaaaaagcacctgctttgactttaggaaaaatcactttttcgatgaatgcatgggtcgtgtcgaatccctggtcaagatataacgcgcctaaaaaagcttcgaataggtcgcaaagcaatgctggtcgcgtacgtcctcctgaattctcttctcccttgcccaacagaacatattgatcaaagtgacattctttggcaaatttcgacaagctgtcttcgcgaacgatcgcagctcgtgtttttgtcaattttccttctggcaaatgaggatataaacggaataaatactgagaaaccatcagttctaaaacggcatctcctaaaaattcaagtcgctcattatccgataattgcagattgcgatgctcattcacataggatgaatgggtaaaagcttgttcaagcaaatttagatcgtgaaaaacgatgttatagttttcttttagttcttttgtcagctggttgtccattttccacattccttttatggatattttttcgatacttccttattatactggttttttgtcaaatttgaaatggttcggtcaaaaggtaagtaaagctttaataatcctagtgattgacgagaagttgtgaaaaattcgtttagtttcgagtatgaagaaaaaattttgtgaaaatggctttccatatttttgcataaatttgacttaataccgagaaactggactttgcacaccgtttattggaaaagtcatggaaacagcgccttgacctgaatattagagaaataaacagaaaaatattaaaaaaccgaaaaaggacatcgcccttttccggtcatttttagtgattatgaacgtgaatctgctgtaacagaaacatttgcccatgggtttggtacatcataagaccaatcccagtctttgacacggtcgttgactggcaatacttcattacggaacaacgttggaatcgcaaatgcttcttcaaacgcatattgttgccatttttgatatgcttctttttggtactcttcatcaaatgctttgcttgaactgatatcgttgatcaattttgtattttcttctgattcataacgagtgtagttgaacgcagcatttggtccccatagtccacttggatttggatcagttcctgtattccaagcagcttggtaaacatcaatttcaggatcatcgttttctaatttatcatagaaagagttgaattcgatcagacgacctgttgtgtattggacatccaaaccaatttctttccactgttggatatagtaatctgccaatggttgcgctgtttccccaccggacatcgaagcaaagttgatggttagtttatttccatctttgtcttctcttaaaccatcgtcatccacatctttgtagccagcatcatctaatagttttttcgctttgtctagatcttgtgtgaatcctttcatctcatcatcatggtatgactggaatactggaggaatcaatgaagtcgcattgcttctcaaacctgcatagaaacgttcacctactgcatcattatctagtgcatagcccattgcttgacgtaatgatttatcagccatttttgaatctggattgtattccacactctttgtatctgcattccatttacctaacttgaatcctagataagtataagaagtttgttcacggcctaagtttgtatagccagcaatttctttataggtatcgtaagtatctgttggcatttggaaaatcatatcatataatttagagttcaatgcttcagttgcacttgcaatcggtacagatttcatcgtgatctttttcaatttaggcgtaccattccagtagtgctcgtttggcaagtattctactgattctcctgcaacgatattactcatgtaataagggccaaaagtcactggatttttacgtacttgatcgcttgattccatatctttgattgctacaccttctaacgtatgttttggtgctgcatacgaccagataccaccacccgattgaagcatgcttgggtttacttctttatattcgatttcaactgttttgtcgtctatttttttgattccggagattgtgtcggcacttccatcatgatattcttccatacctacgatgttacggaaagtgtcgtcataacggataccagtgtagtctttattcccaatgatttcgtaagggaaaatcacatcgtccgccgttacatcttcaccatctgaccatttgacgttgtcttttactttgattgtcgcttttttcgtatcttcatctagatcaagcgttgcagctccgtcgtctgtgattctgaaatcgtcatcgtttgcaaatagcggttcatgagaaggagccataaaagctgcatcatatgaatcttggtaaaactcccactggaacaatcctttaaactgactgtccgttgcgaccgcagcttctaattcgccgtcttcgattgcatcatcattattttttgttgcaattggaaaagttaattcctctttgttattgccgttgcctccagagttgtttccagaggtatctgtacctccgcccccgcatgctgcaagaacgacagcagacatcagcgctgcaaatccaaaaatcgttttcttcattcctatttcccccttcgcttctatactagcctaaccgttggcgcgcatctgcagaacgcttgaatgcttgtccaacataattgatactcaacatcaaaactaaaataaggattgatgcgggtaaccagatccattgccgattcactaagacttctccgttacttgcataaccgatcaatgtacctaaactaggtacatttgccggcaagccgaaacctaagaaagtcaaagttgtctcgatgccgatgtttgccgcaaagttcatcgtcaaattagtaatgattaatgaacttagattcggcatgatttcgcggaacatgattttaaaatcattggttcccattgtttttgaggcactgacataatctcttcttgcttcagataatgtcttgcttcggaataatcgggctttagctacccaataaaatgcactcatgatgaaaataaaggaccagacattgtatctggaaataatcgatacgaagacgataatgatcagcatgattggtagaatcatgataaaatcaacgatccgcatcaagatgttgtcaatgatccctccgtagtagccagagatgatccctaatccaaccccgatgatcgaagtaaggatcgtgatcgcaaatccgatcgtaacagagtttctagcacctatgatcaattgtcctaatacatcacgtccgccttcatctgctcccagaatgaacttttgtccttgcgtcgaaactgttcctggtgcagcgtatttgtcgaagatactaacatacatcactttgtcttgatcggtcagcatcgcaccgataaagatcactaataataaaaccactagcaaacctaatgaaaaaatagcaattttatcttttttaaattctcgagcaatcattcgtatccccataggaggaatactttcttgaactgctgtattgtttttttcactcatcgatccattctcctttctgattggttttattgaatccgaatacgcgggtcaacgatactcatgatgatatctgaaagtaatgtccccactagcgtcgcgattcctaaaatcaatactaaggatgtgatcacggtatagtcccgttggccgatggaatcaataaatagtttcccgactcccggataaccaaaaatcttttcgataactacagaaccagcaatcaacgaagtgatttcataccccatttgagaagccatcggcaacgctgcatttcggaaaatatgtcgactgaatactttattcgtcggtacccctttggaacgggctgttctgacaaaatcgagcgatttcgaatcgattacttcacttcgcagatattggattgtgacggcagtcgccaaaaatgcttgggtaattgatggtaacagaatatatttcaaacggtctatccattgagtgataaatccaccttgcaaacctagtgtttgtgatccacttgttgggaaccagcctaaacgataaccaaaaacaaatagcatgatcaagccgaagataaataaaggaacagcaaaactaaagaagttgtagattacgacaatcttatccaagattgaattttgataccggccagcaagcatccccagaggcacagcaatcaaataagtaaggacaactgtcaagatcgatagatataaagtgttgatgatccgttcgccgatcaagtcagcaacagagcgtttgtataagaaactttgaccaaaatcgccttgcaaagcatttccgatccaacggaagtactggacataccatgggtcattcaagccagctgcttgtcgcatctgttcgatcactgccggatcctgatttggattgatcaaaccggtaaatggatcccccggcatcgcttgggctaataagaagatcagaacacttaaaataataacttgcgggatcatcaataaaacacgtcgcagaatcgttttccacattagcttgcacctccatctttcaacgccactttgtgtgtagttgtgatcgtacgcaaatcgtagactcgaccagtcgcatcatagtattctttttggttttggatatactcttgttctactcttcgtcgattttctttgtggctttcccgattttctacatcgatttgcggaatagctgaaagcagacgtttcgtatagatatgtcgcgggtcattataaatgtcttctcttgtaccgatttctacaaatcgacctttgtacataattgcgatgttgtcgcacatgtgttttactacacctaaatcatgtgaaatgaataaatagctgaggccgtattcttgctggattcgtttcatgaaattcaatacttgcgcttgaacagatagatccagagcagatacaggttcatcggctacgattagttttggattggtagcaacagcacgggctactcctagacgttgacgttgtccgcctgaaaattcatgaggatatttatatagcgcatcttccggcatcccaacgatatctagcagtccttttacctttttcttttcttcttgatcgcttaaccgttcaaaatttcggatgggttcagcaatgatatccaacactcgctttttaggattcaaactggacattgaatcttggaagatcatctgcacatccttgttataacccatttttttgcggttgcttcgcttcgttacatcttttccttcatacatgatttgtccggctgtcaccttttctaatcccacaacggcttttcccgtagtagattttccagagccagactctcccactaaaccatatgtctttcctttttcgataataaaatccacaccatctacagcatatacatgatccgttactcgattgaagaatccactgcgaatagggtaatgaactttcaggtctctgattgtgattaattctgtcatctacacctctcctttttcgtctctaaagtggaaatgcttatagcaggagcaacgtaccaagtggttcggtgcgacttcatgaaggataggctcttcttcatgatcgcttgctggtatccatggaatacgtggtgcaaaccgacaacctttacgaggcatgtttttcagagaaggaacgacaccttcgatcacatggagttctgcatcatgatttccttcttgtggtatagagttcagtaaagagcgtgtataaggatgcttaggatgatcaaacagttcttttacacccgctacttcaacgaactgtccgccatacatcactgccactcgatcagccatttctgctacgactcctaagtcatgagtgatcaagatgatccctgtttttgtttcttcctgaaggtctttcagtaaatcaagaatctgtgcttggatggttacatctagggctgtcgtcggttcatctgcaatgacaattggaggtttgcaggcgattgcgattgcgatgatgacacgttgtctcataccgcctgatagttcatggggatattggcgtccaactctcgcaggattaggaatccctacttgttctagcaattctagtgcacgagcttgacgctgttctgcattcatctttgtgtgataggaaagtccttctttgatctggtcttcgattctcatgagaggatttaatgcagacaacggatcttggaaaatcattccgatatcatttccgcggattttattatagagcgtttcgttcaggtcgattaaattcagatcgttatataaaatctcacctgtaatttttgtgttattaggatcaagtaatcccataatcgtagtagccaaggtacttttcccgcacccagattccccaacgattgctaaaatctcgtttttgtctaaagtaaatgaaacgtcatctactgcatcgtaatagtcatctttgagtcggaatcctgtatgtaggttctgaacttctaataattggttatcggacaatcgaatacccctctctgcttcctaaatggaagtttttcttaataaaaaaggacattacacagaataaatcgttttataacaaaggttattcttatctttgtgtaatgaattattaataattatatagaaaaccgctttactttgcaacataatttctgtttatcgccagaattatcagaaaaatgacttttacgtgtcaaaaagattaaaaaaagaaggataaaaagctgtatgcagctttttatccttctttgcttttatttgaaattatttaagatggctgctgatataatctactgcgccaccgactgtttcaatttgttcagcatcttcatctgaaatttccgtaccgaattcatcttcaagctctaaaacgaattccataatactaattgaatcagcttttaaatcatctttgatgttcaattcatccgtcactttatcggtatctatctcaaaatgatttgaaataattttcgctactttgttaaatacttcttcgcgagtcaactttttcacctccaagaatcatacacttgtcaattacctacaccatggctaattttactggcatttttcaggaatgtccacctttttttcaatggaacggattgcttcagatatccaaatactattcttcgcttttttcaaattgttcgactaattgtccaactacatctgtctcaagcattgtgtggatttggcggatcgtatagcgaacagcatcggggcctgttgctccatgagttttaatgactggtgctttcaagccaaacaaaacggcaccgccatgtttggaataatccatttctgctttcaaagaacgtaagccgtcttttaaaagcatagcgcccatttttcctttgatcccttcatttagaatagcagattttaatagattcatcatattcattgctgttccttcaatagatttcaaaacagcgttgcctgtaaatccatctgtgaccactacatcagccacaccattgagtagctcacgagcttctacgtttccaataaaattcaagcttgtttcattctgaaggagttcataggcttttttcgtcacttcactaccttttgttgcttctgttccgttgtttaagagtgcgacacgaggacgtccgatacctcggactttacgtgcataaaaagaacctaaaataccgtattgcaacaaatgttctggtttgttttctgcgttagcgccaagatccagcatatcgaaaccggcaccttctttccctactactggcaaggtagacatcaagccagggcgttcgatatttttgatacgtcctacgatgaacaaccctgctgctagtagcgcgcctgtattccctgctgaaaatacagcatctgcttcaccgtttttcactgcttgtgcagcaaggaccattgatgcagtcttttttcgtcgaattgcttttactggctcatcatcactattgattttttcgtctgtatggataatcgtgatgtttttttcatttgttaagtatttcttgatttctgcttcttttccgtaaagtaagaattctacttctggaaaatcttgctgcgctaaagccacgccttctacaattgcttgaggtgcgtgatctccgcccattgcatctacggcaattttcattgtttccactcctttttccgtcatcagtataaagtatagcacagtctgctaatcgaaataacgattatcctgattttctatttggaggctttgcgctaaaggctgatactcaggaagcatctgccaatcctttatctgccaaagggctgcagcctcttctctggctacctccaaaacatttccatccgtcaccaagtcagcaatcgcaaattgaggcagaccagattgacggaagccaaatacttcaccaggaccacgtaattccagatctttttcgcttagtacaaaaccattggtggtctctgtcatgattttcatccgttccacacctagttcatttttaggattagcaactaagatacagtaggaagcatcacttccgcgtccaacacgtccacgaagttgatgcagctgtgccaatccaaatcgatccgcatccatgatcagcatgacggtcgcgttcggcacgtttacccctacttcaattacagtagtcgaaactaatatctgcatctggttgtctttgaaggcttccatgattacttctttttcctgattcttcattttaccatgtaacaagccaacttcatattttggtgcaaatagttcacgaagtttttcatagatttccactgcattttttacatctaatgcttctgattcttcaatcagcggacagatgacatacatttgatgtcctcttgccagttcttttttcgtccaatccagtacactgtccaattgaggtgttcttacccagcgtgtttcgatcgggatacgtccagctggaagttcatcaatgatagatatgtccatctcaccatatgctgtaatagctaatgttctaggaatcggagtcgctgtcataaataagacatctggtcgccagcctttttcacgaagtactttccgctggttcacgccaaaacggtgctgctcatccgtaataactagacctaaattctgaaattcgactccatcttggatcaatgcatgtgtgccgatcacgacgttaatttccccttgctctagtttttcaaggagctcacgtcgttcttttgctttcgttgaccccgtaagcaatgcgatggttacttcattgggatcaaacagctgttgcaagctttccatatgttgttgtgccaagatttctgtaggcaccatcaacgcaccttggaaacctgctgtaacggtagcgtataacgcaatcgcggcaaccactgtttttccgctacctacatctccctgcaaaagtcgctgcatatgctgcggactgcgaagatcccgacagatttcattcgttacacgtttttgtgcatttgtcagttcaaaaggtagcttttgagtaaattctttcaatttttggacatcataaaggatctccaaaccattcgtttctgctttttctgcttttttcaatccttgaagacgcatttgaaataaaaagaactcttcaaaaacgacacgtcgtttggcttgatggttttcttcgtggtcttttggaaaatgcatacttcttacagcagaagctcggtcaagtagtcgatatttctccacaaggttgtttggcagattttcttcaatcaatgtgccgtattcttgaaacccttttttgattagatcaactaatgtcgtttgacgaattgatttgttgacgtgatatatcggcgaaaagtcatccattgtttgagaacctaaaatcttcatcccgttcaaggctttacgctttgcatcccatttaccgtatacggcgatttcctccgataaaatgactttttcttttagataaggttgattaaaaaaagaaacgttgaacacatcatgttcttgcatcatacgaaattgcaatcggctttttttataaccaaatcgattcatcacaggaggcgagactacgattcctttcaaagtaaccttttcttgatcctggatctcgtttagatttctttcctgaatatcttcgtagcgaaaaggataataagtcagtaagtcttcaatcgtttggatgcccaagctggcaagactagctgctcttttttctccgactcctgccagcatagtgattggatcatctaaagaacgcataaatttttcctccctcctttaacaaaaaaaggacttggtcagcgatcatacctgatcactaaccgaaggccttttatgaatgaatactgtgttagaaagatattctgacacagaaattattcagcagaaaatagataaggatagacaggctgatctccttggtggatctcgatttccaaatcaggatgtttttctgttagtttctcagcaaattcatttgcttgttcaactgttccttcatcacctgccaagatcgttacgatctctgtgtcctcattgatcatttgttctagtgtacttaacgctgttgctgtgatatctgggttagagatcaggatttttccatcgatcatgcccaaaaagtctccttctttgatctctacaccgtcaattgaggtatctctgatcgcgtgagtgacttgaccgctcacaacgctagacaacatttctgtcatcgtttctttgttttcttctaaagaagcttgatcattgaatgaaagcatagctgtcaatccttgggaaatcgttcttgaaggaacaactgctactgggatatctgctacttctgctgcttgatcagctgccatgaagatgttcttattgtttggcaagacaatcactttatctgcgtttacttcttgaatcgctttaacaatgtcttccgtacttggattcattgtttgcccaccactgataacataattagcgcctaaactttcaaacagctcttggacgcctttaccagcagcgatcgctacgataccatacgggatacgtggtgtttcttttttcgcaaactcgttcacttcttcatcgtgttccaaaatcgtctcatgctgcaagcgcatgttgtcgactttgattttgactaatgaaccgaatttttgtccataattcaagacttctcctgggttttctgtatgcacgtggactttgatgatctcgtcatcattgaccacaagtaaagaatctcctataccatctaaatagttacggaattcttcgtaatcgaatgtactatcgactgtaggtccttctccgatttttaccatgatttctgtacagtaaccaaaatggatatcttctgtcgccatttgaccttggacactgcgatgatgttctgcattgaccatatcatccatttctgctggagaaggttcatatgtttcatccgcttggaattctccattcaatgcacttaaaaagccctcataaacaaacagcagtccttgccctccactgtctacgacaccgacttcttttaggactggaagcaagtctggagttttagctaaagcacgctttgccccttttacaacagctgtcattacttcaacgacatcatcagtactttttgctttcttttctccagctttcgctgcttctctagctactgtcaaaatcgttccttctactggtttcattactgctttatacgcagtttcaactccatgagtgaaggctgcagcaagatcagaagcatttaatgagacaacatctggaatttgcttagaaaatccacgaaacaattgagacaaaataacgccggaatttccgcgcgcacccatcagcaatccttttgaaagcattgctgctaattctcctactttttctgaggttgaatctactactgccttagctccactagtcatagatagattcatatttgttcccgtatcgccatctggcacagggaatacatttaatgaattgacgtattctgcatttacttgcagacgattcgcacctgcctggaccatttcctggaactggcttgcacttatttctgttacactcacctagataatcctccttcagatcgactgctgagttaccagccagtctcctgcctagtctggcagtacacgaacaccttgtacaaagacattaactgaattggcagttacgcctaataatgcctctagattgtatttcactttttcttggacgttgcgggaaacttcagagattttcgtaccatagctgataatcgtataaacatctacagcaataccattatcttcttggcggacaactactcctcttgagtaattttctttacgcaaaatctcagtaatattatctttaatttgatttttgctggccattcctacaacaccgaacacatctgtcgcggcgccaccaacaactgttgcaattacatcattggtaatttcaatggttccagctgacgtttgaatttttacagccatgaatgagcctccttaacgggtaaaaaactcccatttttcttctatcatattttatcatagcgcaacttgaaataaaaggcagttacccaaagtactcaaaaaccttgcaaaatttcaggtataaccttgtttaatttacaattattcttctcaattgtcaattgtatctatgaaaatgtacttgcaaattcccattctatatgatatgttagtctggtatgagctgaattattctattgctccaaatcaaggcaaaggaggaaattaccatggcaaaagtttgttactttacaggtcgcaagacaaaaagtggaaacaaccgttcacacgctatgaactcaacaaaacgtactgttaaacctaacttacaaaaagttcgcgttatggtcgacggaaaacctaaaaaagtttgggtgtcaactcgtgctttgaaatcaggaaaagttgaacgcgtttaattgaatgatacttggaccgttcagatagtgaacggttttttatttaataaaaatttttgagggtgggacttttgattcctaccctttttttgcgtttatttttgttatacgaacaaattatgaagttatttattctaaattttatttttttgtgaaaactagactctttttaagcagagaaaaacaaggatatgataaactgaatacaacttcatagaaatttggtggaaaataaatatgaaaaaaaatttaaagtcattctttagagaaaacggacgctacgcagcagctagtttcctgattccgtttttgattttagcacttgtttatctaagtatcggaatctatcctggaagcagcagaagtattttggcaagtgatgccttttcacagttttctaattttcatgccagcttccgaaatgttcttcttggaaagcaaagtattttttatacatggaatgcttctctaggattgaattatttatctttaatttcttactatctaggcgggatcttcacgccactggtgttcttttttccaaaccagatgatgccagatgcactgtatgttctgactttgcttaaggtcggctgtgccggattggctttttggtttcttgcacgtacgttcaagattcctcgctgggggcatgttgcacttagcgtcagttacgcattgatctcatttatcactgcacattcggagatcatcatgtggctggatgcatttgtttatcttccattagtgattttggggattcaacgtgttatggatcttaaacggccgaaacttttatttgtcagttatttactcttgtttttatccagtttttatatgggttttatgattggcgtcttttctttcttatattttatcgcccgtctattgacaaactggtcagaatataaaaaaacgattgttccttatggtatcacttctttactggcaggcggcgcttcaatgatcattgtattgccagcagtgctggatcttcggtcaaatggcgaggcactgagtcagatcactacgttgaaaacagaagcgacttcttatctggatctaatcatgaaaaatatgattggtgtttatgacacgacaaaatacggatcgattccgttcgtttacgcaggtctgctaccattagtcctctgtctgttttattttgccagtcggaaagtaccgttgaaaaataaatttttgtacggcagtcttttcgccatacttatcgcaagtttttatcttgttccattgaatttgttctggcatggtatgcatgcaccgaatatgtttttattccgttatgcctatctgttctctttcttagtgctcctgcttgcaggaaaaggatgggaaaagatagaacaagacgatcgtgggctgttgttaggaatcattttggtcgtagctgctctctttgcggtggcatggggcatcaaacctgaaggaagctacacctatgtgacgatgacttcctttgtattgacagtggttttcttagggatttatgcttttgctgtgggattttatcagcataaaaaactttcattcaatcatctgagtatattgttattattgatcatgtctgctgaagcactggtcaatacgaacagtatgatccatggcattcttgatgattggaattatgcttcccgcagtttatatactgatccttatcctgacttgaaagctcttgtaaatgaaacaaaaaaagattccgactcgttttaccgcttggaaaatctggatccagtatctgcaaacgattcgatcaactacggttacagtggtatcagtttgttttcttctataagaaatcgtaattcttcctcttacctggataaattaggtttccgttcaagagggacaaatttgaatatccgttataacaataatactttgctgatggatgggtttacaggaatcaaatataacatttctaaaaacgaaagcacgttcagtaaatatggcttccgccaagctggtcaaagcggcgactatacactgtatcagaatgtcaatgcattgccactagcatttactgcaccgttgtccgttaatgatgttgagcagccagtgacagataatttgaccagtcagacaaacttgatcaatacattgtctggtctaaatgaacagtattttacattctatacacctactttgaagaatcagttgaatacgacgatcacaaagacaacgactggcgtcacttactcagaaacagcagataaccagccaaaagagctcacttgggaagtccatgtgcctgcaaatacacaagcttacttaagtttgttcccaaccaattttgcacaattagaaagttctagtgcgacgatcactgtcaatggtacatcgcgaaaaacgcaaatcaacatttctggtcaatactatgatcttggctattatcctcaagagacaacagtgacatttactgcaagtttttatggaacgaaagaagtaagtttcatggagcctaaagtcgttggtctagatgttgtagcctatcaagccgcaatgaatcagatcaaagaaaaaggtgtcgaaatggaagccactggcagaaaagcttctgggactgtaaataccgctgaagattccatgttggtgacaactattccttatgacaaaggatggaaagctaaaattgatgggaaaccagtcaagatcagcaatttcaaagacgcattcttgatgataaaagttccagcaggtaaacatactgtcactttcagttacttgcctgaaggatttatgataggtgcaatcctttttgtcttatgtattgcattgtttattctttatgtctggtaccttgaccgcaatcgcccctttcatggtacgattgatccagcaatagaagaacaaccacgaaacacacacagaagaagacgtagaaaataaagaaacgatggaacctgtgtcactcttctatttaaatggcaaaaatttcaatctttaaatgacaaaaaccacctgatttttggtggttttttatatacctatgactaaactatctcttgctgcttcgacaacttctacagtgatcttatccatttgattgattcttaaaatccgatcaatctgcgcaaataaacgatgaataagcctaaaatttccttttgtgatcttaatgatagttgtgatagcctcataatcagaaaaatcttctagcttgatatcaattcctaaatctgcccatttgtattccaaaatatgatgtgtttcgtccttactaaggttatcaaattcatgtgcaaatcctatgcgagagtaaagctgcggataacgagacaatcttttttcaataccaggcataccgataagaaccattgccagatcatttctatcgtaaatatctcttagctgttctaaatgctgaagctttaaacgatcaatttcatcgacaataattagattaattgcttcataggttttaggcacagaaggatctccttgattgtattttagtaccctatgcattgctttagtcagatctattctactagttattgtgttaatatcagaactgacacgagacatcttttcagctggtgtagtataaaagactttatttacacttaatatttcatctgttgcatttatcaaaaacaagaaaaagtctgaatattcaaaaaataacggtgtgcatttttaaaaggagatgtataatcgagattgagaaagcgtttttctcaaaatttaatgaattaggaagtgattactatgaaaaaattatttagcgcactttttattctgttatttggttttattggtattgggacttctggaaatatagttaaagctagcacgatggttgaacaaacaagtgaaatggcaaaaacttttagtcaattaacaccagaagaacaaagttacttcaaatccaaaggatttagtgataaagatactttttacacttaaaagatagagcctcaagatccgaaaacacgtttttctgcaaatgtattgcggttaaccgcatctactaaaaaaattactaatacgcaggggcggacagaatatattataacaagtcccaattcggcgatgtatcgtatttctacacgcttgagtttaggtagtgcaaaatcatatactcaaacagtaaatctagctaattcttatggttatggtggaggaatgtattttacatttactgggaaaagacaatattacagtgtaaaattagctatgcaagtttataatacatttggtgtagggtcagtctcttgcactgcgggaggattgacaataggaaaatgataatttcttactatgtcttaaatagaagtgatgatgaaggactcttcgtttttcaatcattacatgaggatacgatgctaaaagagttttataatcggattaagaataaacagatagaaacaaatttatattttttaagtgactctatcttgccttttattagcaaccctaaaattcttaacttgttgcagacaaaagatttgaaaagtttaccgattattgtcattgatgaggaaattgtaaaatatggcgcttatctaagcgtagaagaattagaaaaattaactaacattggaatgagtattcaggaggataatggggtaaatggaacatagaatgaatatgcacagttgagaacggaatttgacatttatttagtccaacagggtataccctgttggactttttgtgcgttcatgatatacttggatgtcatttttatatttaaatggcacaaatatttctaattatttgtcatttaacgctgaaaatttttgctatttatctaaaaaagtgacaggatactcatttggccttcatagaattttctaaatatgaatcatcaatgaatttaattaaaaaaataagtagggcaaaatataaatgtttttgccttacttgtttccatcagtttagttttaaattgataagttatatagttatggttgaatgtgtgtctcgcatattagtatttttaccatctgctagttttattattaatctataacaatagataatttataattcgcatattcattaagctgttccaaaaagctgttcattgatttttttgaagtaaatctacattccaaaagataacagccccctccactaatcttataatttctaatcaagaatttttcatgatttttaataaatgataaatagggtttatgatttaaattttgcgtaattataattaaaaaagcgtgaatcgaaaaccctagcttttccatatttaattttactgtataattttcaataactccactttcctctagttttgtcactctcgccgagacagcgggtccagtcaaatgtactttttctccaagttctttcattgtgattcgactattttttgatagttcctcaatgatatttatatctgtttggtctaacatggtaaacaacctttcataaattaagtaaaaatagtaaaagactttttttgttcggtttatttattgtatggaattgaattatactaaaaatatttcatatcaacaaaaaggagacaacgtttatgaatatacatcacattcgtaatgcaacagctatcttagactatggaggtaaaaaatttttaattgatccaatgttagcggaaaaaggaacacttccaccatttatttcgaaaggtccttttccatcaccaagaaaagatcaaatgaatcctctagttgatttgccaatgccagtcgaagatattatcaacggtattgatgctgttattgtaacacatttacatctagatcattgggacgatatagcgaaagaggtcctacctaaagaaataaaattatttgtgcaagatgaaaatgatgcgaatgaaattcgactatatggttttaaaaatgtggaggtactacgagaagacacagtttttgaatctatacaattggttaaaacaaaaggcaaacatggcagaggagaaatcttgaattatgtaggtaatgtttgcggtattgttttcaaacattcgactgagaagacactatactttacaggagatacagtttggtatgaagctgttaaacaaactattgatcagtataaaccagaaatcatagtagcaaatgctggagataatcattttttagttggagaatctcttattatggggaaagacgatttatatgaattgcataaagcaataccagattccacaattattgccgttcatatggaagctgtaaaccattggggactgtcaagagaagaattaaagtctttcaataaagaaaaaggaatttccgaaaaagttttagtgcctgaagatggagacaacatctttatttaaaaaaataaaagattattaataaagggatagatgctactgtatcaatcctaaagagtaaaataaagtacttagtttaagtactttaagaatgtagacaaaaggatcagtttcctctttactaagagtgtagactggtgcttttgctatttttgtataataaaagatatgaagacatatgttccaactgccaagtggacaactttttcagattcattgcagcaaaaacaatcagcgtatacacctgattgttttccaagtctcgatacttgatgtagcgcattccatgcttttcctttgcgactgcaaaaacgcgttcaatcgttttcttttttttatatttttcgcggttgtatgccgtatggcgtaaatattctgcttcatcttaagtagttatcacttttttagataaatagcaaaaattttcagcgctaaatgacaaataattagaaaaatttgtgccatttaaatataaaaatgacaaacctgttccgactgtcctcattaagggcaatcaaaacaacgttccatcgttttttggttacagaaaaaataggtaacaaaaagatgattcacttatcaacgcctcgtccacaagtcacgatattcatcaaagatgagaagctgttttttgaaattgttccttgtgactcagagttaaatgacaggctcacgacctctttcttaaacggtgttcagtcagctgaccttcggtattagctcaaaacgctgatttcacaacctctgattcacggtgttccagaagtagctccttcgaaaataagccgaaattttgcaaaattttgagaagtaatttttgtaaattccttcttatttcttgaagctgaccacttctatcataacctcttattcatatttcacttcatacaaatacagtccttcagggtgtgctgtaggtcctgctgcattacgatcttttttcgcaataatatctgggatactatcttcaggcaatcggccattgccaattttcaaaagcgttcctactaagatccgtatcatcttatacaagaagccatttcccctaaatgtaaacaacaattcgtcttttgtttcatttacctccatcttagcctcgtagatcgtacgtactttatcctctatcgagcttcctgatgcacaaaaagaggtgaaatcgtgagtccctaataaatcaggaagtgcccgctgaattttttccaaatcaagagggtaaggaaaataacttgcataatggcgtcgaaaaggactgcgtggtttccctatatccactcgaaattgatacgtcttttctttgaccaaatatcttgcgtggaagtcttctgaaacaatttctacttgtcttacagcaatatcctctggtgactgggtatctagcgcgaaacgcattcgttctaacggacgctcctctggataatcaaaatggattacttgcccgatcgcatgtactccggcatctgtccttcccgaaccaaagaccgtgatttcttttccatttgccattttttgtaatgttttttctacttcttcttgaacagtacgcccatttggctgtttttggaatccattaaaatttgttccgtcgtacgcaatgattgctttgtaacgtaccatgtttttctctcctttgttcctaaaaggttatctggaataatgatttttttataaaattttttcgttctttcttttcagataaaagaaagaggcctgtgaccttagtctgccacagaccctaatatttcttgtcatacactgctcgcatcctttcttgcaaacagatcagcaagaaaagaatagatagcggcccactgaacgtttatcctcttaaaaagatcagtagcacagttaataatacaaaagcaatgataaccatcgtgtctctattatgccaatgcaatacacgatatttcgttcttccttccccacctttgtagcctcttgcttccatagcagtcgcaagatcttccgcacggttgaagctgctgacaaataaaggaatcagcaaaggaatgactgctttcattttctgaactaggtttccttcaccaaaatcaacaccgcgagcgcgctgagcgttcatgatcttttctgtttcgtccatcaatgtaggcacaaaacgaagagcaatcgacagcatcaatgaaatttcgtggactgggaaccgtacggctttcaatggacgaagcaagtactcaatcgcatccgataattccaaaggcggtgtagtaagcgtgagtagagttgacataaaaatgatcaacacgaatcgacagaaaataaagaggccgttcatcacaccaaattcagtgatatggaaaacaccccaactccaataagtttctccgccacttgtaaacaagacctgcaaagctacagtgaagaggattagccagatcaatgggcgaatgcctcggataaaaaatttcaaatctacttttgacaagaagacagaaagtaatgtgaaaaatgccaacaaaaggtacgtttcccaattatttgctaaaaaaatgattccgataaaataaaaactggctaataatttagctcggggatccaattgatggatcaaggaatctccaggcatataacgaccaaatatcaatttattcatcatgggcatttcctccagcataatggacgatagcgtctgctaattcttcagctgtcaaaggcaaggtagcaaagttcatccctttagccattaattcttctgcaaactcggtggcagtaggtacgcctagttgtttttcttttagccattcaatgttttgaaagacctcttgcggctccccgctattaacgattcgtcccttttccaacacatagacataatctgcaaaattggctacatcatccattaaatgcgtaactaatacaatagtgatctgctgttccttatgaagacgccaaaacatctccatcatttcttttctaccctggggatcaagtcctgccgttggttcatccaatacaagtacttccggcctcatggcaagcacaccagcgattgctactctacgcatttgccctcctgaaagttcaaatggcgaacgttccaaatagctttcatccagcccaacttgttctaatgtttcttttgctaggactagtgcttcttcttcgctgacaccaaagtttttaggaccgaaagcaatgtcttttgctaccgtttcttcgaatagctgtgcttctggaaactgaaagacgatgccaactttttttcggatgggctttaaattcttattatccgtatccggctgaatatctcgttctccaatatggactgtaccgcttgttggcttaacaagcgcattcaaatgctgaagtaaggttgatttcccgcttccggtatgccctactaatgcagtataactgttttctttgatcgtcatattgatgtcaaataaggctctttgttcaaatggtgtattcggctgataagtgaagtctacttgttcaaaacggatgtccataaccaatccaccatcctttcttctgtcatatattcactgggcacatcaaccccacattctttcagtgcgctcttcagtttttcaggaaatggtaggtccagacctaagtcgatcagttcaggaccagcagaaaaaatttcttttggtgtaccttcacggacaagttcgccttgtctcatcactagtatccgattggcattagctgcttcatcaatatcatgagtgatagatataacggtcaattgactttcttctttgatcttcttgatcgtagagatcacttcttcacgaccttctggatctagcatactggttgcttcatctaaaataatgatatcaggtcgtaaggcaaccacgccggcaatggcaacacgttgtttttgccctcctgataaacgagcaggctcgcgtgaagcaaaatcagccattctaactttctcaagtgcatctttcacacgcactagcatttcttctctgggaatcccttgattttcaagaccaaaagcaacgtcatcttctactgtcgaaccaacaaactgattgtctggattttgaaaaaccattccaaccatctgtcggatcgtccaaatattttcttcatccaatatttgatttcccactttcacgatccctgattctggcagaagcaatccattgatcgttttggcaagtgtcgattttcctgaaccattgtgtccaataatagcgatccactcacctttatcaattgtaaaggagacatctttcaatgcggggcgaagatcatctggctggtatttataatttatcttttctaattcaataattggctccatgattactccttcttcatcctaaagttcctactaacactatcaaaaaaagacaaaattttcaattatttctcgcttaaaatgtttttttatgccttcaaacatatctgtcatgacaggtaattgaaggtataaaaaaacactttatgatgagtgcttactccccaagcgatattcgcttgaggagcagcgctgagctagactcggaaaaatatcttccaacatcataacactctaaaagaatcatctataaagtgatgttattagtgtgattttagacaagttctaagacaaccattggtgcaccatcaccgcgtcttggttctgtcttcaaaatgcgtgtgtatccgccttgacgttctgcgtaacgaggtgcaatatcgttgaacagtttttgtaaagctgattcaatgacgatgtcctcattttcttcacgcacgctggcaacttcattacgtacgaaagccgcagcttgacgacgtgcatgcaaatctccgcgtttacctaaagtgatcattttttctgcagttgagcgaacttctttcgcacgagcttcagtagtcacaatacgttcgttgattaataaatcagttgttaaatcacgcaacatcgctttacgttggctagatgtgcgtcctagtttacgataactcacgttggtttccctccttcgtaaaaggttttaatcttctttacgtaaacctaaacctaagtcgtgcaattttgctttaacttcttctaatgatttacgtcctaagttacggactttgatcatttcaggctcagatttatttgtaagttcttgtacagtattgattcctgcacgtttcaaacaattgtaagagcgaacagacaagtctaactcttcgatcgtcatttccaacattttttctttttgtgtttcttctttttcgaccatgatttcagcattttttgcttcatcagttaagttcacaaaaatatccaaatgttcagtcatgattttcgcagacaaactcattgcttccaacggttcaattgaaccatctgtccaaatctccatcgtcaatttatcaaaatcttcacggtgtccaacacgtgtgttctcaacttgatagttcacacgacgaacaggtgtgtagattgaatcgactggaagaacgccaattggcatatcttcttttttattttcatctgcttgaacataaccacgtccaggtttcactgttaagcgagcatggaacgtagctccttcagagacactacagatgtacatatctttgttaagaatttctacatcactatcaacgataatatcgccagcagttactgtagcaggtccggtaatatcgatttcaagggttttttcttcttggccatacattttcagcgctaagcctttaatgttcaagatgatttgagtgacgtcttctctaacacctttgatggtagagaattcatgcagtacaccatcgatttgaatattagtgatggcagcacctggcaaagaagataataaaatacgacgtagggaattccctaaagtagtcccataccctctttcaagaggttcaacgatgaacttgccataatctttttcttcatcaatttttgcgattcttggtttttcgaactcaatcattcttatctttacccctttcaaaacgaaaagtgtcttgttcaatgacgttactgataaaactcaaaatgagcggcactcattaaacacgacggcgttttggagggcgggcaccattatgaggaactggagtcacgtcacgaattgcagtcacttctaaacctgtagcttgtaatgaacgaattgctgcttcacgtccagaaccaggtcctttaactgttacttcaacagtctttaatccgtgttccattgctgcttttgtagcagtttctgctgccatttgagcggcaaaaggagttgattttttgcttcctttgaaacctaatgaaccagctgatgaccacgctaatgcatttccgtgagtatcagtgatcatgatgatagtgttattgaatgtagaatggatatgtgcaatacctgcttctatattcttcttcacacggcgtttacgattcactttttttgctgccatgaagttttaacctccttcacttaagaattattttttcttgccagcgatagcgcgagctgggcctttacgagtacgtgcattgtttttcgtgttttgtccacgaacaggcaatccacggcgatgacggattccacggtaagaaccgatttccatcaaacgtttgatgttcaagttcacttcacgacgaagatccccttcaacttttaatttatctacttctgcacggatagcatctgtttgttcattcgttaattcacgaacgcgaacatcttcagatacaccagcatcagctaagatctttttagcagtagtgttaccaataccatagatataagtaagtgaaactactacacgtttatcacgaggaatatctactcctgcaatacgagccatatttatagcacctccaattatccttgacgttgtttatgttttggatttgctgggcaaatcaccataacgcgtcctttacgacgaattactttacaatgttcgcacattggttttactgatggtcttactttcatgataatacctcctgtagttttacggagtacaattatttaaagcgataagtaatacggccacggttaagatcgtatggagacaattcaaccgttactttgtcaccaggtaagatacggatgtaatgcatacgaattttacctgaaacagtagcaagaacttggtgtccgttttctagttcaactttaaacattgcattcggcaaagtttcgacgactgtaccttcgacttcaatcatatcttcttttgccacgcacagtacctccttgtacttgtttcgcattttcacacgataaaatggcggaaactgcagttcccacctcaaaattctcaaaatggatcatctagaggattctctagaagtcggactgacatattctatcataatttattgaacttgacaagagtaactgcataatgcaagtcggctacgggcaatcgtgctatttttcaatgattttttgtacatctgcaaatacagcatcgatttcacgagcaccatcaatagtgtttagcaaaccttgttctttataataagccaagattggttcactatttttgatgttgatagccagacgatttttaaccgtctcaggtttatcatcttctctttgatagaattcatgcccaccgcaacgatcacatgtgtcttcaacttttgtagggttgaaaattttatggtaagttgctccacaattgctgcagataaatcggccggctagacgttcgaccaagatttcttcaccaacatggatatcgatgacagcatcaatttttttattcaaatcttttagcattgcgtccagagcttttgcttgatctagcgtacgtggaaagccatctaataagaagcctttctctgtatctggttcagctagtcgctctttcacgattccatttgttacttcatcaggaactaatgcacctttatccatataagactttgcttccaggccaagagctgtttcgttttgcatcgctgcgcggaacatatctcctgttgagatgtgcggaataccataagcatcaatgattttttcagcttgtgttcctttacctgcgcctggcagccccattaaaatgaggttcattgttttccctcctaataaatgtgtgagaacgtgtgttgaggggaaacctcaacacgctttcttactcaatgaatccaacatatttacgtttcagcattaagccttctaactgtttcgcagtttctaaagctacaccgataacgatcagtaagcttgtaccgcctaatccgattgattgtggaagatcccaaaccatttgagcaatgattggaagcaatgccactaaaccaaggaagactgcaccaactgtacttaaacgcatcagtaatcttgagacatactcttcagtccccttaccagggcgtacgcttggtatataacttccttgcttttgcaagttttccgctaatttctcagggtttacttgaacaaaggcgtagaagaaagtgaaggcaacgatcagaatcgtataaatcgtagcaccaggtgctgtattatagttaaagatctccatcatcactttgtaccagttttcagaaccgaatctaccgctcaatgcttgtaaaacagcatttggcgtagcaataaacgaactagcaaagataactggaataactccagctgcatttactttcaacggcagatagctgcttgtaggcgcgccagctacgcgtttcgtatattggattgggatcttgcgttcagcttgttggaaaaatgttacgaatgtcacgatcaacaagaccgctactagtaaaatggccacaaaaatagcagatttccatatgtctgaaggatcaatatttataaagtaatcttcataaatttctctgatactttcaggcaatctagaaatgatacctgcaaaaatgatcattgatacgccatttccgatacctttttctgtgatctgttctcctagccaagtaacaaacatcgtaccggctgttagaatcaaaccgatcgttacgtaagttgctacgttaggattattcacgaaacctaattgagcgtattgattgaatccagcagtgataccgacagattggataaatgccaatactaatgtcagatatcgagtcgcttgattcagttttttacgaccaacttccccttgtttcgaccattcaacaaatcgaggcacgatgtccatttgaagaagctgaatgacgatagaagcagtaatgtatggtgaaacccccattgagaaaatggaaaagttttgcatcgcactaccacttaccaagttcaacatgttgaaaaatggcaaagaagaaaggttttgcaatgaagcagcatttacgcctggtacagtaatatgtgcacctaggcgaaatacaaacaacacaaatacagtaaataggattttcgatctaatgtcttttactttaaaagcatcttttaatagtctaaacattagatcacctcgattgatccaccagccgcttcaattgcttcttgagctgctttagagaattttgctgctttcacagttaatttcttgtttagttccccattagctaatactttgattccagctttttcgtttttcacgattccagcttcaactaaagcaacaggagttacttcagctccgtcttcaaagcggttcaatacatcaagattaatgactgcatagtctttacggttcacgtttgtgaatcctcgttttggtaaacgacggaacaatggtgtttgtcccccttcaaatcctaaacgcacaccgccgcctgaacgagctttttgtcctttttgtccgcgtccggcagtttttccgttaccagatgaagtaccacgaccaacacggttacgtacttggcgtgaaccttcagcaggttttaattcatgaagtttcataggtttggcacctccttaatgttctagttatgatttttctaaattaaatttcttcaacgtccactaggtgagaaacagtattgatcatgcctttaattgcttcattagaaggcttaaccactgaactgttaatctttgtaagacctaacgctttaactgtatcacgttggttttgaggacgtccgataatactgcgttttaaagtaacttttaattcagccattattgttgtcctccttatccgattaattcttcaactgatttgccgcgaagttctgcaacttcttctgcacgtttcaattgtttcaaaccttcaactgttgcgcgaacaacgttgattggtgtatttgagcctaaagatttagaagtgatatctgctaccccagctaattctaatacggcacgaactggtccaccagcagcaaccccagaaccttctacagcaggtttcattaggattctaccaccactaaaagcaccgattacttcgtgtgggattgttgaaccaaccataggtacttcaactaagtttttcttcgcatcttcaattgctttacggattgcttcaggaacttcttgagctttacctgtaccaaatcctacgtgtccgtttttgtcaccgacaacaactaaagcagcaaaacgtagacgacgtccacctttaacaacttttgttacacggttaattgcaacaacgcggtcttctaattccaaatgttttggatcgatataaaccatgaatggtattcctccttcttctaaaattctagtccattttcgcgagcagcttcagctaaagcttgcacacggccatggtaaaggtatccaccacggtcaaagactactactttaatgcctttttcagctgcacgttcagcaactagtttaccgacagcttgtgctgcttctgtttttgttccacctgaaatttctttatccaaggtagaggcacttgctagcgttacacccgctacgtcatcaataatttgagcgtagatgtttttgttagaacgaaaaacgttcaagcgtgggcgctcagcagtaccagagatattgttacgtacacgacgatgtctcttttgacgtgttttgttcttatctggttttgtaatcacaattgtcacctctttatttttattgtactactatttcaagcagtaaatacgtttcgaaaaatagaagctgcggcacaagtaaaaatgtatttttttgaaggtaaacttcagccaaatgcctttttcctgctgctggcttctatgcaatttttctaaacgattatttaccagttttaccttctttacggcgtacatattcgccaacataacgaatacctttacctttataaggttctggaggacgagttccacgaatgtttgcagctaattcgccaacttcttctttgttcgcacctttaacaattacttgtgtgttagctggtacttcaacagttactccagctggtggtgtgatttctactggatgtgagtaaccaacgttcaatacaagttttgatccttgtaattgtgcacggtacccaaccccgattagttctaacgctttttggaaaccttcgctgacacctacaaccatgttgttgaagttcgcacgagttgttccatgaattgttttcatttctttactgtcgtttggacgagtgaaagttacttcgtttccttcgatattcattttgatatctgctgaaaaagtacgagtcaattcaccttttggtcctttaactgtaacgttgtttccgtcttgagtaactgttactccttcagggataacaacgactttatttccgatacggctcacttaaagacacctccttgtagattctacttgattaccatacgtaagcgataacttcgccgccgatatttttttcacgagcttctttatcagtgacaacaccttcagaagtcgaaatgattgcgatacctaaaccgttcaatacttttggtacttcgtcagctttgacataagcacgcaaacctggtttagagatacgttttaagtttgtgataacacgttcgccgtttttaccaaattttaggaaaacacggatcacgccttgtttgtcatcttcgatgtattcaacatcacgaacgaaaccttcacgtttcaagatttcagcgatgtcacgtttaatttttgatgcaggtacttctaaagactcatgtttaaccatgtttgcgttacggatacgagttagaaaatctgcaattggatctgtcatgaccattgatcttttacctccttcttatgcgaatttactttttaccagctagctttcttcacgccgggaatttgacctttataggcaagttcgcggaagcaaatacggcaaagatggaacttacgataaactgaatgtggacgtccgcaacgttcgcaacgagtataagcttgtgttgaaaattttgcaggacgtttgtttttagcaatcattgattttttagccacgtagttcgcctcctttaattatttttggaatggcatgcctaattgtgtcaacaactcacgagattcttcatcagagtttgctgttgttacaataacgatgtccataccacgtactttatctactaaatcataatctacttctgggaagatcaattgttctttaatacctaaagtatagtttccacgaccgtcaaaggcttttttacttacaccatggaagtcacgtacacgtggtagtgaaacagaaaccaatttgtctaagaattcgtacattctttctccgcgcaatgtaacttttgcaccaattggcattccttcacgtaaacggaatccagcgattgattttttagcttttgtaatcattggtttttgaccagtgatcaaagttaattcttcaactgctttatctaagtttttagcgtttgataccgcatcaccaacacccatgttgatgacgattttttcaactttaggtgtttgcataacagagctatagttaaatttttccatcaatgatggagttacttctttaagatatttttcttttaggcggttcattcagtaagaccctccttccttaaacttttatttatctaaaacttcaccggtttttttagaaacacggacttttttgccgtctacttctttgtagccaactcggccagctacaccagtagagtcaaccaccatcacgttagaaacatgaattggcgcttccatctcaacaattccaccttgaggagcagcttgagaaggtttttggtgttttttaacgacatttacaccttcgacaataactttatcttttttcgggaacgctgctagtacaacgccttctttgtttttgtcttttccagtgataactttaactttatcgccttttttaacaaacataactgtttcgcacctcctttgataagtgtctcaagattataaaacttctggtgctagtgaaacgatcttcatgaagttgttttcacgtagttcacgtgcaactggcccaaagatacgtgttccacgagggcttttatcatcacgaataatcactgcagcattttcatcaaatttaatatatgaaccgtctgtacgacgagctcctgattttgttcgaacgataacggctttaacgacgtcaccttttttgacaaccccacctggcgttgcttgtttaaccgtagcaacgatcacatcaccgatgttagcagttttacgaccagatccaccaaggactttgatcgtcaaaatttcacgtgcgcctgagttatcagcgacttttaaacgactttctgcttggatcacgttgtgtatcctcctttcagattttgcattcaatctatataggaaaatctcgtgttattagataataactgcttcttcgactacttccaacaaacggaaacgttttgtagctgataatggacgagtttccataattctcacgatgtcgccaacttttgctgtgttgttttcatcatgcactttgtatttcttagaatagttcatgcgtttgccatagatagggtggtttttctttgtttcgacagcaacggtaattgttttatccattttgtctgaaaccacgcgaccttgataaactttgcgttgatttcttccttcagtcatacgcttaatggcctccttccataattacttagcttgttcacgcaacacagttttgatgcgtgcaatcgatttacgtacttctttaatacgtgcagtgttttctaattgacctgttgctaattggaatctaagattaaacaattcttcttttaattgtttttcttgatcaagcatttcggcagtggttaattctctgatttctttaaccttcattcgattcaccacccatttcctcacgttttacgatcttagttttcattggtaatttgtgagaagctagacgtaacgcttcacgagctacttcttcaggaacgcctgcgatttcaaacatgattttaccacgttttactggtgcaacccatccttcaggtgcccctttaccagaacccatacgtaccccaattgctttggcagtataagatttgtgagggaaaattttaatccatactttcccaccacgtttcatgtaacgagtcattgcgatacgagcagcttcgatttggcggtttgtgatccaatgtgaatcaacagcttgcaaaccgtattcaccgaatgctacttcttttccgcctttagcttccccgcgcatttttccgcggaattcacgacggtgttttacacgtttaggtactaacatgattatttccctcctttctcagtgttttttttagttggaagaatttctccacgatagatccacactttaactcctagttttccgtatgttgtatctgcttcttcccatgcgtaatcaatgtccgcacgtaaagtatgaagaggaacagttccttctgagtatccttctgaacgagcgatatctgctccgtttagacgaccagatacttgagttttgatcccttgagcgccagcacgcattgagcgttggatggcttgtttttgagcgcgacggaaagcaacacggttttctaattgacgtgcgattccttcacctactaattttgcatctagatctggttttttgatttccacgatattgatatggattcttttaccagttaatttgtttaattcttttcttaggctttcgacttcagaaccgcctttaccaataaccatacctggtttagctgtgtgaattgaaatgtttacgcgacctgttgcgcgttcgatttcaactgttgatacagcagcatcagcaagtttagttgaaataaatttacggattcttaaatcttcgtgtaagaactcagcatactctttttcagcataccatttagcatcccagtcgcggatgatgcctacacgcattccaattggatgtactttttgacccactgattatccctccttatttttctgatacgactaccgtgatatgacttgtacgtttgttgattggagaagctgatccttttgcacgaggacggaaacgtttcattgtaggtccttcgttaacaaaagcttcgcttactaccaagttttcaacatctaagtcaaagttattttctgcattcgcaactgctgacatcaatactttttcaatgattccagcagatttgtttggtgtgaatttcaagattgaaattgcatctgcgacacttttacctctgataaggtcaattactaaacgggcttttcgaggtgaagtgcgaactgtttttgcagttgctttagctgatgtgatttgttctgccatttggatttatcctcccctcaaattagcgtttcgttttcttatcgtcagcagcatgtccacgataagttcttgtaggtgcaaattcacctaatttgtgtcctaccatgtcttcttggatgtaaactggtacatgtttacgtccatcataaactgcgatggtatatccaacaaaacttgggaaaactgttgaacggcgtgaccaagttttgataacttttttcttttcaacccctgcttgagcttcaacttttttcattaaatgctcatcgacaaaaggtcctttctttaaactacgacccatggtgaacctcctctcaaaatgtgcgacacatggtcaaagtaattatttatttttgcgacgacgaacaataagtttgtctgatttagcttttttgttacgagttttgtaaccaagagctggttgaccccaaggagaaactggtgctttacgtccgataggagctttaccttcaccaccaccgtgtgggtgatcattagggttcattacgctaccacgtacagttgggcgtttacgcatccaacgagagcgtccagctttaccgatgttgattaattcgtgttgttcgttacctacagaaccgattgtagcacggcatgcagctaagatcatacgaacttcaccagagttcaagcggatcaatacgtatttgccttctttaccaagtacttgagcacttgtaccagcagaacggatcaattgtccacctttaccaggtttcatttcaatgttgtggataacagtaccaactggaatgttttctaatggaagagcatttccgactttgatatctgcttctggacctgaaacaagtttcatacccacttctagtcctttaggtgctaagatgtaagctttcactccatcttcatagtgtactaacgcgatgttagctgaacggtttggatcatattcgatcgtttgaacagttgcaacaacgttatctttgttacgtttgaagtcgatcacgcgatattggcgtttgtgtccgccaccttgatgacgtacagtgatgcggccgttgttgttacgtccagcatggtttttcaatggttgtaacaatgatttttcaggtgttgatgttgtgatttcagcaaaatcagaacctgtcatgttacgacgaccatttgaggtaggtttgtactttttaatcgccacgtttttccctcctaatttaatgagttatctattagtgcttattcagcagcttcgaataattggatttcttttgaatcttcagtcaatgtaacgatcgctttgcgacgtttttttgtatatcctgcatatttgcccatacgtttgaatttcgcacgtacgttcacgatgttcacgtttttgactttaacgtcaaaagcagcttctaccgcttgttttactaaagttttgtttgcgcgagtgtccacttcaaaagtgtatttcttgtcatccatggcaagcattgatttttcagtgatcactgggcgtttgattacgtctagtaagttcattatgcaagcacctcctcaatttgagtaagagcagtttgtgttgctaacacttttgtatttgatacaacgtctagcacactcacattatcagaagttactacagaaacgtttggtaagttacgtgctgataaagcagcaaagtcgttacctttttctagaacaaccaatactttagagtcgatagataagttagcaagaacttgtttgaattcttttgtttttggtgcgtcgaagttcaagccttcgattgctaccaagttgttttcagcaactttttctgacaatacagatttcattgctaaacgacgaacttttttaggaagtttgtagctgtaagaacgtggtgttggtccaaagactacgccacctccacgccattgtggtgagcggatagatccttgacgtgcacgacctgttcctttttgacgccatggtttacgtccgccgccgcgaacagcgctacggtttttaaccgcgtgtgttccttgtcttaatgacgcacgttgcattacgattgcatcgtaaacaacactttcattaggttcaattccgaagatttcttcgttaagtgtgatttcaccgttttggcttccatcttgtttgaataatgctacattcggcattccttagttcctcctttcttcctacaattatttagctttcacagctgatttgatagtgattaaagattttttagctccaggaacattacctttgatcaagataacatttctttctgcatcgacacgtacaacttccaagttttggatagttacgcggttgccacccatacggccagcaagacgtttgtttttaaatacacggttaggtgcaactggacccattgacccaggacgacgatggtaacgagaaccgtgagccattggtccgcggctttgtccgtggcgtttgataaccccttggaatcctttacctttcgtagtacctgttacatcaataatgtctcctgcttggaaaacatctactgtaatttcttttcctacttcatattctcctagctcaacatttttgaattcacgaatgaagcgcttaggagccgtgtttgcttttgcaacatgacctttcgcaggtttgtttgataaaacttcacgcatatcttggtaaccaacttgaatagcttcgtagccatccgtttccattgttttcacttgtagtactacgtttggagtagcttctacaacagttactggaattaattcaccagattcagtgaagatttgtgtcattcccacttttttccctaagattcctttggtcatgagtacacctccattatttttgttttagttttataatttgatttcgatgtttacaccagatggtaagtctagcttcatcaaagcatcaacagtttttggtgttgggttcacaatgtcgataagacgtttgtgtgtacgcatttcgaattgttcgcgtgaatctttgtatttatgagtcgcacggatgattgtgtaaagactgcgttcagttggtaatggaattggaccagacacgctagctccagttctttttgcagtttccacgattttatccgctgattgatctaaaatacggtgttcatacgcttttaaacggatacgaattttttgttttgccatcttgttccctccttcgcctattttgaaaagtagacatagctccacgaaaatttccgtcacgctcgttcgtggcaaagcgtccgggcgtgtcgcaacctctcgtttcttagccgacgaaatcattctgattacgtctgtgcaattcactaaagtaaacgcacctttgtcattataatatatataaactcacaaagcaaggctttttcttgtaaaaaacattttgttttcataaagtttcatttagaaaatactgactcttttatttcgtgtttcttctattataatgctcctgtctttttccctgatcctgcaataaataaaaaagctcggaacaaagatcctgagaccttcgttccgagcgattacgtccgaataaatgttgctttactttaaaacttaagtgaattaagctttgatttctgtaacgacaccggcaccaactgtacgtccgccttcacggattgagaatttagtaccgttttcgatagcgattgggtggattaattcaacttccattgttacgttgtcgccaggcataaccatttcagttccttctggtaattcaacaacacctgttacgtcagttgtacggaagtagaattgtggacggtagttagtgaagaatggagtatgacgtccaccttcttcttttgtcaacacgtatacttctgcagagaattttgtatgaggtgtgattgtacctggtttagctaaaacttgtccacgttggatgtcttcacgtgcaacaccacgtagtaaagcaccaatgttgtctccagcttcagcgtagtctaacaatttacggaacatttcaacaccagtaactgttgtttttgaagtttcttcagcaataccaacaacttcaacttcgtcaccaacgcgaacttgtccacgttcaacacgacctgtagcaacagtaccacgtccagtaattgagaacacgtcttcaactggcatcatgaatggtttgtcgttgtcacgttctggagttgggatgtattcgtcaactgcagccattaattcaagaattttttcttcgtatgaagcgtcgccttctagagctttcaaagctgatccagcaactacaggaacatcgtcaccagggaattcgtattctgttaataggtcacgaacttccatttcaactaattctagtaattcttcgtcatcaaccatgtctactttgttcaagaatacaacgatgtaaggaacaccaacttgacgagacaataggatgtgttcacgagtttgaggcattgggccgtcagcagcagaaactaccaagatagctccgtccatttgagcagcaccagtgatcatgtttttaacgtagtccgcgtgtcctgggcagtcaacgtgagcgtagtggcgtgtatctgtttcatactcaacgtgagctgttgagattgtgattccgcgttcgcgttcttctggagcaccatcgatttgatcgtaagccatagcttggccgccgtttttcttagatagtacagttgtgattgcagctgttaatgtagttttaccatggtcaacgtgtccgatagtaccaatgttaacgtgtggtttagaacggtcaaatttttcttttgccattttaaaatgtcctcctaaaaatacaatatattttttatttgtctgataggtatatgatgtacacaaggtacaccacatgcccatatcatcgataattattttacacgaaactatattaaaaatatagtctctttggataatctctttgcaggactatccggttttaagaaattattcagcttttccgccgtttttcttaatgatttcttcttgtactgattttggtacatcttcgtagtggtcaaatgtcattgtaaatgtaccacgaccttgagtagcagaacgaagagttgtagcatacccaaacatttcagcaagtggaaccatcgcacgaacaacttgttggccgccagcgcgagcttccataccttcaacacgtccacgacgagcagttacgtgacccataacatcacctaagtaatcttcagggataacaacttctacagccatgattggttcaaggattactggattagctttcttagctgctgcacgtaatgccatagaagcagcaacacggaaggcagtttcatttgaatcgacatcatggtatgaaccatcgtaaagtttagctttgatatctactaatggatagccagctaagacaccattttccatagcatctttcaaaccagtttcaacagctggaatgtattcacgaggaacaaccccaccgacgatcgcattttcaaattcgaaaccagcaccttcttcatttggtgtaaattcaatccatacgtgaccgtattgacctttaccaccagactgacgtacaaacttaccttcggcttgagtgccagcacggaaagtttcacggtaagatacttgaggcgcacctacgttagcttcaactttgaattcacgacgcatacggtcaacgatgatatctaagtgaagttcacccataccagcgatgattgtttcgcctgtttccacgtttgtttcagcacggaaagtaggatcttcttcagatagtttttgtaaagccacacccattttatcttggtcagcttttgatttaggttcaatagcgacttggataactggttctgggaattccatggattcaagaataactagactcttttcatcacatagtgtgtccccagtagttgtgtctttcaaaccaacagcagcagcgatatctccagcgtaaacttcagagatttctgaacgagagttggcatgcatctgtaggatacgaccaacacgttcacgtttgccttttgttgcgttttgtacgtatgaacctgattgtaaaacaccagagtacacacggaagaaagttaaacgacctacgaatgggtcagtcataactttaaatgctaaagctgagaaaggagcgctgtcgtctgcaggacgttctacttcttcatcagttttagggtcaatccctttgatagctgggatatctaacggtgatggcaagtaatcaagaacagcgtccaatagtaattgaacccctttgttcttaaatgctgaaccacatagtactgggtagaattctacgttaactgttgcgcggcggataccttcttttaactcagcttcagtgatttcttcaccttctaagtatttcaaagtaagttcttcatcagtttcagctacagcttcaaccaatttttcgcgccattcttcagctaattcgcggtattcttcaggaatttctgtttcttcgatctctgttccaagatcgtttgtatacatttcagccttcattgttacaaggtcgataattcctgtgaagtcgtcttccgcaccaattggtaattggattgggtgagcgtttgcttgcaaacggtcatgtaaagttgatactgaatataagaagtcagcaccgatcttgtccattttgtttgcaaatacgatacgaggtacaccataagttgttgcttgacgccaaactgtttcagtttgaggttcaacacctgattgtgcatcaagaacagttacagcaccatcaagtacacgcaatgaacgttcaacttcaactgtgaagtctacgtgtcctggtgtgtcgatgatgttgattcggtgacccttccattgtgctgtagtagcagcagaagtgatcgtaataccacgttcttgttcttgttccatccagtccatttgtgaagctccttcatgagtttcaccaattttatggattttaccagtatagtacaagatacgttcagtagcagtcgttttaccagcatcgatgtgggccatgataccgatattacgagtgttttgtaaagaaaattctctggtcattctccttgtttctcctctctttactatctagttgctaaaaataaggacactatctgaggtcgacttataaaagccgaccaaacagagagaatcttaccagcgatagtgagcaaacgcacggttggcatcagccattttatgagtgtcttcacgttttttaacagaagcacctgtgttgtttgcagcatccatgatttcttttgctaagcgttcttccattgtgtgttcaccgcgcaagcgagcgtagtttactacccaacgaagacctagagtaacgcggcgttcagggcgaacttcaactggtacttggtagtttgaacccccaacacgacgtgctttaacttcaagaacaggttgaacgtttttcattgcttgttcaaacacttctaatggatcgttacctgtagattctttgatcaagtcaaaggcattatagataatgttagctgcaatcccgcgttttccgtcaaccattacacggttgatcaagcgagttactaattttgagttataaataggatctggtaaaacatcacgttttgcaacaggacctttacgtggcatccgtaactcctccttccgaaatattgttcatagtaattacttctatatagtagaagcaagtttcatttgtttaataattaaaattaagctttaggttttttagttccgtatttagaacggctttgtttacggtcgttaacaccagcagtatctaaagcaccgcgaacgatatggtaacgtacccctggtaagtcttttacacgaccaccgcgtaataatacaacactgtgttcttgtaagttatgaccaatccctgggatataagcagtaacttcaattaagtttgacaaacgaacacgtgcatatttacgtaaagctgagttcggttttttaggtgtcattgtacccacacgagttgctaccccacgtttttgaggtgagtttacgttagtttgagttttcttaaagctgttatatcctttgttcaaagcaggtgaattagatttttccacctttgatttacgaggtttacgtactaattggttaattgtaggcattccttgtttcctccttcccacgatttgcgtctagttccacacatccaggtggttctttttttgtgataaaaaataaatgcaatgtctgcatccttatcaaatatgctttgataaacagtcagcacgtttcttcacagaaacctgtagataaagcacctttgttagaatatcacgaatgaaaaaacatgtcaacaagagatgcaattttttttgaaaaagctttattggaataaaaaagaatggtatctttttaccgtaaatcacgctaaaatagtgaggaaagcacgatgctcaaactaaaaaaaggtggacgcaaagatgaatttaaaacaattagctggcattgaagccgcgaaattcgtaaaggacgggatgatcgtaggtctcgggaccggttcaaccgcctattatatggtagaagagattggtcgccgtatgcgtgaagaaggtttacgtatcacaggagttactacttcaaatgcgacaaaagaacaagcggaaaaattaggaataccgttaaagagtattgatgaagtccccgtagtcgatttgacaatagacggtgctgatgaaatcagtgctgattttcaagggatcaaaggcggcggcgctgctttgcttttcgagaaaatagtcgctacgtactcaaaagaaacgatttggatcgttgattcttctaaattagtcgataaacttgggaagttcccactcccagttgaagtgatcccttatggctcccaacagctacttcatatttttgaagaaaaaggattccaacctgtcttgcgtacagacgaaaacggagaagtcctaaccacagatggtggtcattacatcattgatctgcatctagaagtcatcgaacagccagaaagcttagctacctatttagatgaacttgttggggtagtagaacatgggcttttcctaaacatggtttctaaagtagttgtcggctcagaaaaaggcgttgagattcttgacgcaatccgtcgtaaataaagaaaaactgcttgatcatccaataaaaaaagacagcggaaaatttgcgaaaaaactatctttttgacgtactttatgctacatttttactgttatatccagttagaaaatcactgctagaaaggaatcaccatgaaaattattggttatgcacgcacaaccataaatgacgttgatttaacaactcaggttgatcaattatctgactttggttgtcaagaaattttccatgagacatatgaagtggaacaaaatgattctactgctgttcatttggagtcagtgatcgctgacatgcaacaaggcgatgcactagtcatttgccaacttcatcgattaggcaaatctacgcggcaattaacagaactcacgcaattattcaaagatcgcgggctgcacttgattagtcttgatgaaggaatcgatacgcgcgaaatgggaaaaatctatttccaattaatggaaaacctagcaaacatggagtgcgcattgatcaaagaacgtacattagttggattagatgaagctcgtaaaaaaggaaaaatcggcggaagaccaaaaatcgatgcaaaaacgatcaaaaaaatccgacgtctctattatgaaaaaaaagaaacgatccaatttatttcttcaaaatgcggtgtttcagttggaacatgttataaatatatcaatttacctgaaaaagaaatcgagcaattatgcatctaatacctaaaaacgaacagttgcgtgggcactgttcgtttttttatattctctacttgttttctcatagaatcttatctaatttttcgatggaaatctcttccaaaaaattgtacaataaaacagaactgaaaatttcagaaatataaacctatcttaaaaggagagctaaacatgccaaaattagttttttctcgtcacggtcttagtgaatggaatgcattgaaccaatttactggttgggctgatgtaaatctagcaccagaaggaatcgaagaagcaaaagaaggcggacgcaaaatcaaagaagctggaatcgaatttgatgttgcttacacttctgttttaactcgtgcaatcaaaacatgtaacttgatcttagaatattcagatcaactttgggtaccacaaatcaaatcatggcgcttaaacgaacgtcactatggtaaattacaaggtttgaacaaaaaagaaacagctgaaaaatacggcgacgaacaagtacacatctggcgtcgttcttacgatactcttcctccattaatggaagaaactgacgaaggttctgcagcaaatgaccgtcgttacgcaatgttagacaaacgcgatattcctggtggagaaaacttgaaagtgacattagaacgcgctttgccattctggcaagatgaaattgctccagcattactagacaacaaaactgttttagtagctgcacatggtaactcattacgcgccctagctaaacatatcgaaggtatctctgacgaagacatcatggatcttgaaattccaacaggtcaaccacttgtttatgaattaaatgatgacttaacagttgctaaaaaatactacctataaaaaacactataaaaaagggactgtgacacgatttgtcacagtcccttttttcgtataaacggttttctcctgccaacttctcggtcacaagtcacaatattcatcaaacatgaaaagctgttttttgaaattgttccttgtgactcagagttaaacggcagattcacaacctcttggtaaacggtgttcaaaagcttatatttgcaataataagtccagccaagtcaaaaacatgaggagctatttttgcttggatgttcttattacttaatgcagggcagctttttcatttccttcttattctgctatcgctgtttccaatcctacttcgatcatttcattgaacgtagattgacgttctgcagctgttgtttcttcaccggtgatcaaatggtcgctaacggtcatcaaacttaatgtctgcacatggtatttcgcgcctaagtaataaagagccgctgcttccatttccactcctaaaacgccaagttcagctaattggaatgtctctgtcaaatcatctttgtagaaagaatcttccgaaagaacatttcctacatgaaccgtatagcccttttctttagctatctcatatgctttcagtaatagattgaaatcactgatcggaggaaaatgaaaggcttggaaatttttttcgatcatcgaagaactggtcgctgcaccttgtgctagtactaaatcacgaacatggacgtcttttgacaatgcaccgcatgtacctactcgaatcaatttctttacaccatacgactggatcaattcatgggcatagatggtggctgatggcattcccattcctgttccttgaacagaaatacgttctcctttatatttgccggtaaagcctaacataccgcgtacctgattgtaacaaactggatcttccaaaaaagtctccgcaatatatttagctcgcaaaggatctcccggaagtaaaatcttatcggcgatctcgccttctttcgcttcaatatgcacactcattttattgttcctcctattacaataatgtcaatgtttctttaaccaatgctttaaaagattgtttgactctctgagttgtttctacaacttcttcatggctcagattcgcttgcatacctgctgctaagttggtaatacaagagattcctaacacttttaatccgctgtgagctgctacgatgacttctggaacagtcgacatccctactgcatcggctcctattgtccgagacattcggatctccgcaggcgtttcataagttggtccagaatagcccatatatacgccttctttaagatccaaacctagtttttctgctgctgcttttgctgttgcttgatagtcaggcgtataagcttgactcatatctggaaatctagggcccattgcatcttcattcggaccgatcaaaggattttcaccagtaaaattgatatgatcggtaatcagcatcaaatctcctggtacaaatgattcgttgacaccaccacatgcattagtcacaatgactgaatgggcccctagcccggccatcacacgtactggataggtcactgtttgcatggaatgaccttcatagtagtggaatctcccttgcatggctaacactttcttgcctgccagagacccataaactagctttcctgcatgcccaactactgtcgaaacaggaaagaacgggatctcatcataagaaatcattacagcatcttcgatttcatctgctaattcacctaatcctgaacctagaatcaaaccaaaatcaatttcttttactcctttgtcaagaataaactgggtcgtttcttgtaacatctcgcttaacttggtcatttgctttctcctatttaaaaagattattttaataatttcaagaagctttcgccattttcagtcgaagaaacactaaagttctcagcaatcgttgctgaaatatctgaataatatccttgaggcaatgccccttgttctttcatttttttactgtaaaccaataacgggacatattctcgcgtatgatcggtaccagtaaacgtcggatcgtttccgtgatcggctgtaatcattagcaagtcgtcttcttccatcgcttcaagcaattctggaattcgtaagtcaaattcttcaatcgcatgcgcatagccgactacatcccgacgatgaccgtataatgcatcaaaatctactaaattggtaaagctgattcctgaaaaatcgtttttcataactttcagcagctggtcaacgccatccatattgcttttcgtgcggacagattcagtgattccttgtccgttgaaaatatcgttgatctttccaacagcaatcacgtcctttcctgcttctttcaaagaatcaaggactgtgtgtccgaatggattcaacgcataatcatggcgattgcttgttcgggtgaagtctcctggttcacccacgtacggacgtgcaatgattcggccaatcatatacggatcatcttttgttatatcacgaacgaattggcaaatccgatataattcttctaaaggaatgatttcttcatgtgccgcgatctgaaggacaggatcggcagaagtatatacaattaaatcgcctgttttcatttggtgttcaccgtaatcgtcaataacagctgttccgctataaggtttgttacatacgactttacggccagaaaattcttcgatttgtttgatcagatcgtcagggaatccgttcggaaacacacgaaatggagttttgatattcaatcccatgatttcccagtggcctgtcatcgtatctttccctacagaaacttcttctaatttcgtcgcatagccttgatgatctttcactgattccacaccttcaagaggacggatcgttcctaaaccaagctgctctaaatgtggaacgttcaatcctgcttctttcgcaatgtgtcctaatgtatcagaaccaatatcaccgaacttatcggcatctggtgcttctccaattcctactgaatccatgacgatcagatgtacgcgtttaaacatgattattccttctttctttttatttttattgcctttaaaacaaaaagggcgagacgaaaaacacttcccgtaacccaccctttttattcgctaaaagattattttgatttgatatagttcttcccgtttgcttttggaccagaagctttccctaagaaaacaaccagcacaatgattgtcagcaaatatggagcaatttgcagcaatactggcggaatcgaagaaataactggtaattgtgcgccaatgatactcaagctttgagcaaaaccaaagaacaatgaggcacccattgcccctaaaggattccacttaccaaagatcatagcagccatggagatgaacccttgtccaacgatcgtaccagctgaaaagttaccggaaatcgactgagcaaaaacagcaccgcccataccgcctaacaagccagaaatcagtacgcctgaataacgcatagcatatacattgatacctaatgtgtcggcagcttgaggattttcaccaactgaacggaggcgcaagccgaatttcgtcttgaagatgatcacccaagctaggacagcaatcaaaatagcacaataagcaggtaagaatgtatttttaaagaaaattggtccaatgaccggaatatctgctaatcctgggaaagaaaaataccccagattctgcgtgatgttatcagtttgacctttaccataccatgctttgatcaagaaaacacctaaagcaggtgccatcagattaattactgtcccgctgataatatggtcagcacgcaaactgactgttgctactgcgtgaatcagagaaaataggatacctacgacgccacccactaaaatagcgatccatggtgtcatagaaccaagtgatggactcatcgtcaagttgaaaacgatggaactaaaagcacccatgaccatgattccctctagccctacgtttacgatcccgcttcgttcagaaaaagttccgcctagtgacgttagaattagcggtgttgaataaaccagtgtagaagtaaggatcaaggcaattaattcgatagtcgacattatagttcgcccccttcatggttttgattcgttggtttcgattctattgtcgcaacgatctcttcttgttttttcccttggaagactttagccatgacgaaacgaatcaggaagttgatcccgacaaagaagataatcaaagcaatcgatacattgacgatctcaaacggaacacctgctcctgtctgcatgccaagtccaccgatcttcaaaatactgaacaagatcgctgataaaagaataccgattgctgatccagaaccaagcaaggagacagccattccgtcaaatccaatagatagcgaagtcgtttgaacaaagaagttttgatacgttcctaatccttcaaccacaccgccaagccctgccaaagcgccagaaatgaccatcgacaaaacgatcgtacgtttactactcattcctgcatactcagaagcaaaaggattcaatccaacagaacggatttcaaatcctaaagtcgttttcttcatcagcagccaaacgaaaataagcgcgatgatcgctaaaaacaaacctgagtttacgcgagagccgccaaaagcttgtgttaaccatggtaaccgcagtgaggcattttgactgatcatattggaagaatccaaacttgagcgatagctttcaggcatcacttcatgtaaagcaaatgtgcttacgtataataagatatagttcatcatgattgttacgatcacttcacttgttccaaaaaatgctcgaagtaaacctggaacagccgctgccatcgcaccagctaaggcacctaagatcacgcataacggaagcaaaacaacttttggcagatctggaaacgcaagtgccacccagacactgacgatccacccgcaaagtgcttgtccagaaagcccaatattgaaaaacccagctgagttagctacagaaaaacctaatgctgtaaaaatcaacggcgttgcttgccttaacgtttcacctatccctctttgcgaaccaagggctgcatctagcatagaagaataaccttggatgggctgaaaaccaaaagcagccatcaatatcgcgcctaagatcaatcctaaaacaactgaaagtacaggcactaataaattacggaatttctcgctgcgatcattcatgtgcgccagcccccttttctaactcttttcgtgcttcttctaaggtatagcccgccatcaatagacctaattcattttcagatgtttctttcggatcaacgataccgacaatttctccttcatggataacagcaatacgatccgaaacatttaaaatttcttctaattcgaaactgatcagtaacactgctttgtatttgtccctttgttcgatcagacgtttatgaataaattcgatcgcacctacatccagtccacgagttggatttgcaacaatcaacagatcaggatctcggtcgacttcacgagcgataattgctttttgctgatttccgcctgataaagcttttgcgggaacaagttcattcgttgttcgaacatcatattcttcgatcaattctctggcatgttcattcattactgaataattcagcatgccgtttttactgtaaggtttttgatgataggtttgtagtgcgatattttcagataatgtcatatctaggactaacccgtatttatgacggtcttctggcacgtgtcctacaccatgttcagtgatttttcggggttttttattagtgatgtcttccccttttagcttgatatgtccgctttctgcctttcgcaaaccagtcaaagcttggatcaactccgactgcccgtttccatcgattccagcgataccaagtacttcgccagcacgaacctctaagttcaagtttttcacggcttctaatccacgattttctttcaccactagattttcaatagacaaaacgacttcttgaggcttcgcttcttttttcatcgttttgaatgataccgttcttccaaccatcatatcggctaattgttgtgaggttacgtctttaacgttgactgtaccgattccttttccacggcggataactgtacagcggtcagctactgctttgatttcatctaacttatgcgtaatcaaaatgatcgacttgccttctttgactaattccttcatgatcacgattaattcatcaatttcttgaggggtcaatacagctgtcggctcatcaaaaatcagtacatctgctcctcggtaaagtgtttttaaaatttctacccgttgttccatcccaactgaaatatcacgaacgtaagcatctgggttgactgacaatccatactgttcagaaactttttggatctcttttcgtgcttttttatggtcaagcatccctgcgcgactaggctcgcttcccaacacgatgttttctgttacagtaaaggcatcaacaagcataaagtgctgatggaccatcccaatccctaattggttggctttggtcggacttgtgatctttacttctttcccacgcatcaaaattttccctgatgtcggctctaataatccggaaagcacgttcatcaatgtagatttgccagcaccgttttctccaagcaacgcatgaatttctcctgcctttacttgtaaattgatgttgtcatttgccttgaatgttccaaattctttggtaatattctgcatttctatgacaatattttcttgaaccacctttttttcacatcctaacgatttctatctagggcaacgattgactaagattcacgcttagtgagcgttcttcttttgaaacaaacattacttcagggagttgttcccttatccaaactgtcacaaggcagcttggataaatgaacaattcttgttctaatcaaaccatagccttgtcaaacatgtgtctaacaaggctatagaaatggttttagttttcttcaggagtttctggaacttttacgtcacctgaaatgattttttcttttgcttcatcaactgcttttttcgcttcgtcagaaagttgtccttctgttagaccaacaccgtcttctttcaatccataaacagtgtgttcgccgccagggaatttaccgtccgctgatttttgtgccaaatcttctactactgttccaactgctttcagtgtagatgtcaatgtgaagtttttcttttcgccgtttaatgtgtattcgccttcgtctgattggtcgcggtcaacaccgataacccaaacttttttgtcgcctgattcgttcaatgattttgcttcttggaatacaccgttacctgtaccgcctgaagcatggaagatgatatctgcgttttgtgcatacataccttgagcaattgaacgtcctttatctggagcagagaagtcaccagcatattgattcaatactttgatttcttttcctaattctttcgcacctgcatcaacaccggctttgaatccagcatcaaaacgatcgattacttcaccttttacaccgccgataaagccgactacgtttgtttcagtcgtataagctgctgcaacacctgcaagataagaagcttcgttgtctttgaaagttgcagatacaacgttatctaatccatcgatgacatcatcgataataacaaagttcgtacctgtattgtttgttgcttgttcttggatcgctggttttagtttataaccaataccaaaaatcgttttgaatccagcattcaatgcttggtcaatatttgggatgtaatctgattcatttgaagattggaaatattggaagccatcatttcctcgtgaaagtccttgatctttcccccatttttctagtccttcccaagctgactggttgaatgaacggtcgtctacaccacctgtgtctgtgatcaatgctgcagttgttgtgtctgatgagcttttgccaccggatgaatcagtagagccgttgttgccgcatgcacctaaaaataaccctgctgctagtgcgacagcacctaaaccaaataattttgcttttttcatttctgtaaagcctcctaaaataattgttttatttttcaacagtcagctgactgaatgaacatgagttatagatctttttcagtaaatgcataaggcagcagttcacgaacggtcgttgccttcgtcacaccattgtctcctactagcgtaaccggcatatcaggggaacagaattctgccattacttgtcgacatgcaccacaaggagagataggatcgggggtgtgccccgctacgactagatgcgtaaatgttttttctccttcagatactgctttgaaaaaagctgtgcgctcggcacaattcgttaatccaaatgatgcattctcaatgttgatgccttgataaatcttgcctgattccgttacgagacaagcgcctaccggaaaatgggaataaggaacataggctttatctaacgcttcaatagctgtgttgatccattcttgtttgagttctgccatgagcttctcctttgaaaaaattaatagccttcaccagttgaaccagatacgattgctactcctgcgcttgttccgattcttgtagcaccagcttcgatcattgccattgcttcttcttcgttatggataccgccggaagctttgacacccatttctggtcctacagtttcacgcatcaaacggacatcctctacctttgctccgcctgttgagaaaccagttgatgttttgacaaaatcagcgcctgtagcttttgctatttcgcaagctcggatgatttcttctctatctaataacgatgtttcaataataactttgacaagcgcacgatcttttgctgcttcaacaactgcttcgatatctttttggacttgttgatcatcctttgatttcaaagcaccgatattgatgaccatatcgacttcatctgcaccgttattgatggcatctgttgtttcaaatgcttttgtctcgggtgtgtttgctcctagaggaaacccgattactgtacatacggctactggctcaccttgtaattgttctttcgctagcgcaacccatgctggattgatgcagacagaataaaaatggtatttttttgcttcttcgataatttgcatcacagcttctttagatgcgtctgctttcaaaatagtatggtcgatcattcggtttagttccatttcttttccccttttctttaaaacggtaaagtccgcttttttcctttattctgtgatgatgtcatgaatcaatgttggcttcattgccgattcaccaatttcaatatttttatataataattcaatgacagaagtgatttcttcgtcgttactatagatcgtcaatagtgactcaccttttgtcacagtgtcaccaatttttttatgcagtttcaatccaacagcgtgatcaatatcttcttctttggttttacgcccagcacctagcatcattgcagcaattcctaattcatttgccacgatttttgacacaactccgctttgtttagcaggaagctccattgtgtagcgtgcagtcaaaattcgttctggatgttccacgatcgctgggtctcccccttgattttggatcatttctttgaattttgctaacgctttacctgattccagagcttcttgaagcaacgttcttgcttcatcggttgtcttagctttgccagcaagaacaaccatttggcttcctaaggcgtagcacatttctactagatcttctggaccatttccttgtaatgtttcgattgcctcgacaacttctagactatttccgatagcttcgccaagaggttctgacatatctgagataaccgccactgtttctcggttagccagtttcccaatgctcgtcatggtctttgccagacgtcttgcatcttcgatgttcttcatgaaagcaccgtctccagtggtcacatccaaaacgattgcatctgctcctgccgcgatttttttactcataatcgaactggcaatcagcggaagagaatcaacggtcgctgtgacgtcacgcaaggcatacaattttttgtccgccggtgccaagtttcctgattgaccaattaccgctactttactttcattaacaatgcgtacaaattcttcatccgaaagctcgatctgaaatccgggaattgcttctagcttgtctagtgtaccacctgtgtaacctagaccgcgtccagacattttagccactgtcactccgacactagctactaggggggctaaaatcaatgtggtcgtgtcaccaacaccacctgtcgaatgcttatctacctttattccttcaagagaactcaaatcgatgacatcaccagaattagcaatcgccaatgttaagttcgtgatttcttcatttgtcatgtcttgataaaaaattgccatcaataatgcactgacttgataatctggaatctttccattcgtatagtttgtgacgatgtactcgatttcctctttcgacagctcgtttccatccctctttttttcaatcagatccaccattcgcattgcctgatcctccttgtcttcattcggtattatacattatttttaggaaaggtaaaccactttagtaaactggtttactaaaaataaaaaaagcactaactcgcctttgtaaatgcttacataagcaatataccgccgagttagccctttgtcaatacttttacgctctcacgaataattaattttgtttcgaacactttgttcggaacttttctttgaggaaattcgatcgtatcgatcaggaaacgtgcagcataaaatccaatatcaaaacttggctgctgcactgtcgtcaattgcggaatcatgtattctgacagctttaatccatcgaatcctatgactgagatatcttctgggatttttttgcccaattcatcgatcgcctgatagcatccgatcgccatggcatcattcccgcaaaaaatagccgtgatatctttatgtttgagtaatttttttgatgcagtatatccaccttgaacagtcaactctccatgttcaacaaatttcccattaaaaggcaggccatgatctttcagcgcatgacgatatccgttgaaacgttcttctaattgatagtatccagtggtttccttcagcatgccgatcttcgtatggccactttcaataaacagcgaaacagcttgataggcgccctcatattcctttacgataagccgtccgttatcccgacgattcaatccgcgatcgattaaaatgattggcattttttgataaaatccgctgtctaatgcgtatttctcaggtaaaatatttggtgtggccagcaagattccgtccactgagcggtgggaaagctcttgtaaatacttgatctcattttcttggctatgacgagaattgcataacatgatcacatagcccaaaggattcaaatagctctctacaccttcgatcagtttggagaagaagaaatcagtgacatcagggacgatcattccgatggtctttgaatgtcgattgatcacatttgaagcgaaataatcgggcttataatgatgttcattcacgatcgacaacacttttttccttgtcttatcactaaatctgcttcctttgttattcaaaatctgtgagacagttgttactgatacgcctgccatttctgcgatatctctgatggtcagcttcatcctattggctcccttctatctaaattccctatcagtgtaccaaaacccccaagaaaagaatagagaaaaaaggaaagtatgttttttgataaaaatctcctttatctaccgacttggcagccttctatacaagttctgtatcttatttattttatcgtaaaaaaacatgattctgattctgctacttcttttttaagaaaagatagttccttgattaaaaaagtcatcaataaaaaaagaactgatgcgtaccatatatgtaatatgtacgcccagttccactctttcgtcgctccactatttttcagctagttattctttcacacttttgatgatataatatcctttatcttttgtgacgatttctgcattgccaaatgtttcttccattttcttttgcgcactcggcgctccttgtttcttctggatcacaattgtcagtgtaccgcccttcttcaaccgatgatatgcgcctgtcaaaatttcatgtacaactttttttccagcacggatcggcggattgcttacgatagctgcataggtttcttcatgaactgcttcatagatattcgattgatggatatcaacatgttcgatttggttacgctttgcgtttccttgcgctagacttaccgctcgttcattaatgtcgaccatttcaacaaaccgctgtgtcgcaaatgccaaagctaacccaatcggtccatacccgcatcccacatctaagatctttccttcatcaggtaactcttcccaatcgaaagcatcaatcaggacacgtgaaccataatccactgtttcacgtgaaaatacaccagaatctgttacaaattgaaaggttctgccttttaactcaaaagcccattgttcaaaatcgtgcgccgtatctgggcgttcagaatagtaatgatttgtcatgtcttccatccttctcatttctttcatgacaacagtctatccttttatgtatccgtgcgcaagtcaagaataagactccgtttctttctattataaagattatacaaaaagatcggcaatctctcttaagtggtggggtttgcgtttattttgtgttaaaatagttccattgatgggagaacgcaggaggctaatatgaatgatccaatgaactactaccgtgtggcaagagaagaatggcgagaattttatcgtaatgggcaagcacctttgacacaagatgaactagataatatcaaaagtttgaatgaccgcatttccatgcaggatgttcgagatatctatgtacctcttgctcatctgatttatctttatatgaaagaatttgaatctttgttcttgagtaaaggtttatttcttcataaatacgtagaagtaccgccttttattatcgggatcgccggaagtgtagccgttggaaaaagtacaacagccagactgctgcagacaattttgtctcgtaccttcaaacgaagaaacgttcagctgatcacgactgacggatttctttatccaaatcgtatattaaaagagcgtggaatcatggaccgtaaaggatttcctgaaagttatgatatggagatgctgatcgatttcttgaaccgtgtaaaatctggtcaggaagagataaaagtacctgtttactcacatgatgtgtatgatatcattccagacaagtacgaattgatccagcaacctgatatcttgatcgttgaggggatcaatacgcttcaattacctgcgaatcagcaaatctacgtcagcgacttttttgatttttctgtctatgtcgatgctgatcccttgctgatcgaaaaatggtatttggatcgttttggtgcgttactggatacagctttccaaaatccagagaattattattatcgttttgctatcggagatcgtgaagaagcctttaaaatggcaaaagatgtatggaaaaatgtgaatttgaaaaatttacaggaatatatcttgcctacacgaggaagagccgatataattctccataaaactgaaaatcatatcatcgattcgattttcatgcgaaaatattagcattttaaaatagtttgactattttgagataaaatttaaagggataggggtaataaatttgacaaacgttgccgatatgacgaacgttgaaaagattatcgtattagactacggtagtcagtataaccaattgatcacaagacgtattcgtgatcttggagtcttttccgaattattgagccaccgcattactgcagaagaagtaaaagcgatgaatccaaagggaatcattctttctggcggaccaaacagtgtatatgatgagaatgcatttgggatcgatcctgagatcttcaatttaggtattcctgtattagggatttgctatggtatgcaattgatcacgtacaaacttggcggttccgtagagcctgctaaaaaccgcgaatatgggaaagccctgttagaagtaacaagcgatcaagctgtcttgtttaaagaaacaccaaaacaacaaacagtatggatgagccatggtgacttggtaactaaagttcctgaaggctttgaaacagtcggaacaagcaaagattgtccgattgcttctatccaagacacaacacgtaatttttatggtatccaattccatgcagaagtacgtcattccgaatacggaatcgaattgctgcgccactttgcctttgatgtttgtcactgtgaaggtaactggacaatggataactttatcgatatgcaagtagaaaaaatccgtgaacaagttggtgacaaaaaagtcttgcttggtctttcaggtggcgttgattctagtgtcgttggggttcttttacaaaaagcaattggtgaccaattgacatctatcttcgttgaccatggtctgctacgcaaaggcgaagcggaacaagtaatggaaagtctaggcggaaaattcggcttgaacatcatcaaagtcgatgcaagagatcgcttcttagacaagttgaaaggtgtatctgacccagaacaaaaacgtaaaatcattgggaatgaattcgtatatgtttttgatgacgaagcaacaaaacttgctggtgaagaaggcgtctctttcttagcacaaggaacgttgtatactgacgttatcgaatctggtacagaaacagcacagacgatcaaatctcaccataatgtaggcggactgccagaagatatgcaatttgaattgatcgaaccattaaacacattattcaaagacgaagtccgtgaattagggactcagttaggcatgcctgattcaatcgtttggcgtcagccattccctggtcctggtcttggtattcgtgttcttggcgaaatcactgaagacaagctagaaatcgtacgcgaatctgatgctatcttgcgtgaagaaatcgcagctgctggacttgaccgtgatatctggcaatatttcactgttcttccagggatccgctctgtcggtgttatgggtgacggacgtacttacgactacacagtcggtatccgtgctgtaacttcaatcgacggaatgaccgctgactttgcccgtatcccatgggaagtcttgcaaaaaatctctgtacgtatcgtaaacgaagtagcccacgtcaaccgtatcgtgtatgacatcacttctaaaccaccagcaacagtggagtgggaataaagtagtaacctcacttggttgcaaaatgttgatttaacagctttttagttcacttagaatggataaaaaagatctattttgattaggttccccgccaaaatcccgccagagaactctgacgggatttttaatttaggctttctttggtggaggttcctgtcaaaaaaatcaagctaaaaaacatattttagcctttgacacattttttattacacaaaaacattcacataaccacttgaatattaattaggatgtggctgaaaactctatcaaaatattatatcctctaaaaaacaaatggagtgaaagtctcgataacaccaactcgataatacgaacttaccgatgaacaatgggaccagatgcacaggctctttctaagttaccgaacagggtaacctcctaagttagataaccacacagccttaaatgtacttctttgaatcgctctgagtggtacagtgccgaaggagcgctagggttcttgaaaaacgatctatactcacttttgtaattggcgtgacagcggagtactattgactatctttcaagttcttcagatcgagctaggattttaaaacattagtatcgattcatcttaaataaaagcgcatcaacatagtgccggtgctaaaaaacgccgtactaagcggagtaaaccaacgcatagatattaccacggtggcaaaacaaccaaaatccataatttggtggatggactagaaaaccctcttgtctttcttttaactgaaggacaaactcatgatgcagtttcagcaatcaagctattgaaaaactttgatctttcgaggatcaacattctagtcgacaaagcatacgccacgaagggtattcacctaaagagaaccctaaggaaccttgggatatcgattggaatctttaaaaggaacgtcaccttgtagaatgtttttacaacaagatcaaacattttcgtcgtatcgctacacgatatgataagttggcaaaatcacttttgtcttttgtttatgcggaagctatttttaaattgactcaacaataagtttctagacacaccctaaatagcctcaaaagttgaactgtaaatttaacttttgaggctatttaaatttatataactttttttgaaacattgtgtgtagaacaatctaatcagcagttattttaaactatatttttttcgtaaaatggttactgaaccaaaacctaataaaataatccctccaataacactaaaaatagttgacttactttctcctgtcttaggaagagtatcaccattatgagatttagtagcttttacagtatttttttctattaaattattgttcactttattacttaatgaggttattctagtttgattttctgctacgttcattttacttggtgtttccggtgtttccggtgtttccggtgtttccggtatttccggtgtttccggtgtttccggtgtttccggtgtttccggtatttccggtgtttccggtgtttccggtgtttccggtgtttccggatcaattggaataggacatacttcgttttgccaaattattgaaggttctgttttagaagattttatatattttgaatcagcattcaattcatctgacttccaagttcctattactcttgccgatgttacttttaagtctttactaaaatcctgcggaacatcaaatgttttactaaaaatcataccaaaagcactgtaacctactatatttccaaaattaattgtagcaacattaccattaaaagaaatgtctagtggaactaagtaattagtatatatattgttattatttgttacagccggatagtatcgattaataacccagtccgttacatttgtcactgagacattatcatatggcaaagttacagttaatacagcattattaattgcatagtctgttgcaaatacaactctccaattttgagttttagtagcgtcgttaggaccgttttgccaatgctgaacttctaaattacctggtccatacaaatcttcatcagtattagagctatcagtactagagtggttgttaggatttttgactttttcaagatatccattgttagaataatcatctaagttagtatccataacactttttgcatttaaatcaacttcatcagtataagacttcgttattttatcacctatacattcaccattacctcttggaacatttttttcgataatctcatcaattttaggaacatatccattaacctctttgaagtatgttaatttcccatcattatccgtatctttattgatattgctatcattagtaggttctgaattcatctgaacattctcatattttttttcagcatacgacttctgacttatttcattagaagttgctgcttctgaagttgccgtttctaaagttgccgtttctgaagttgccgtttctgaagttgccgtttctgaagttgccgtttctgaagttgccgtttctgaagttgccgtttctgaagttgccgtttctgaagttgccgtttctgaagttgccgtttctgaagcaaaaacttgtgaagaaaataaattacctgacataagtgatattaaaagaaccgcactgaaacactgaactcttttaactttcattttatccatcctttcaaattttcttcattatatcataaacctgtacatcaattctagcttccttctagttctaaataaaacgcatttagttaaccctctttttctcttgaaacatttctaatgattttttagttatgaattatattttgcttgtatagacgtaatctattcatttcaacctgtaagaaagccttttataaatattaataaaatactcattatttttcactaatgtttgacttgcttcttttgccgtaatcaattgtgataagttattgttgaaattatcaggaaagataagcgtaccaccaaatttcgatagttaaatttattcagaatttcatacttattatttccataatcctaggataggtgtttctttcgatactattttttcttttaaattttgcatgattttctttaggatacgactgaaaactctatcaaaatatgatattctctgaaaaaaatggaatgaaagtttcgataacaccaactcgacgataagaacttaccgatgaacaatggggccagatgcacgggctctttctaagctaccgaacagagtaacctcctaatgcaatctgtaactcttccctatcgttttttgtagattagctagtgtcatctgatgctttgtaaaaacatcacaattatttttaatctgaaggtgacgaatgaaaatcgttccttcagtatcaattgcaaccaatctgtgtgtatactttgtgacatcaattccaaaatatatcatcgatctgcactcctctttgcttaaaattacactatgtttcacttactcttttcctgtgtaaccttgtgatcactcaagcgtcatgaacgtatatcatacactaacaaacttattacccattagacggccagagtctaaacaaaacagtaatccagtaaattctggtggatatcatactagtccacagtgcttaactcaattatagttaaaataacttcagattagaatagaacaactgaacaattgagtaccttaaatatacaaaaattgttatcatttagtcacttctttagacaaaatactatcgcgttagtaacacgggggtaccaaactcattgaaaatccctttgagggttgctacgaaaggcttcacgagcactctttaaagatttgttttttgtcaaaattaactaaatagtaaaccaaaagacgtgtgaacgaaccggctttcagcggaagagccgagttcgtttacacgtcttttttgtgttttctcaaaaatgaaacttttccgaaatgagttgattgagattcaaatagtttaagaatctcttacaagttaaattaattacctgtggtttcgaaaaattcctctactcagattgtagtagtaatggaagggtaatcacccacaaagaaaattatgagaatttccacattttagggacattgtgacaattcaaattgttcttattagtgaaaggatggaaaaaacgtgtgcttaattcgcgcccctactctattttgtttcaaccaactgaaataaaaaactaaattaaaaccaaaggagaaatacacatgtcaaaaaaattaatgattcaaaaagaaactagtatctcactcaatgattcagaaacaatcaatctggctagtctacgtttcgacctcaaacaattcaaactccctcaacgttttgttgtagccaaaagcgatattcaaatgcggatggaacgtgaacaaaaccacgttggcgaacgtgtggaaaccgggttaatgacactcaccttcaaagtctatgatcgggcttttgtcgaactggttctaaataacggcggaacagaactgggctccccgataacgattgtggttgagcatcaagaagaattaccaattttagataactatgaggacggcgaattaattcccattcgctttaatggcttaaatatctatccccgaaaaattcagaaaaagtcatttgtgggagaaggtcagccgatgattgatacgtggcaatttgcagcgttgaaaatcagcgccgattcctatcaactaggagaagtgaatgaaccaaatactccggcaaagtaatgaatgtctgattgattttctacgcttttcattaccggatgcttcaatggaaaaagttgcggacctattgggaatttccctttcagacttcacttcggaaaagaaagggagtccttttcccacttatgattctcactattcctttgcagatattatcattcaccaaagtgaccaccacaacaatctgttagtaaacttatctggtcaaggttgtcgccaatatgaagaatatatgtctagtgtggaaggttggcattggcagaagttcttagtcaccattctaaaagccaaaggaaccgttactcgtgtcgacttggcaatggatttatttgatggctcctctcctcctgtggctatgcttcaaaaatacgtgaagaatggccaacttagctctcaaattcgctactttcgagaagtgaacagcgggcaattacagaaaggtgttctgactggtcataccctctatattggcgctcaacctcaactactgcggatttatgataaaaagcaagaaatccgcgataaaacgggtgaaatcgcccaagtcaacgaatgggtccgctgggaattggaattaaccgatcataaggctcggcaagccgtagaaaagcttgcgaaaggaataccactcaacacggtaatccgtggcatttttgcttcccattacagcttcaagaccaaacccaaaggacccgtcaattatcacaacaaagctcgttggtcgaacatgaaatggtgggataaatttgtggggggtattcccaaaatccccttacgtgtaattcgtgaaaagccaaccttttccaagaagaaagcatggttagaaaatgccacttcgaaatcgctcgccatgatttatgaagcttttctgcaagcctatggcccagaacaagcagaggtctatttgagagaactactagccacaggaaaagaaaaattcacggaaacagatcagacctttatcgaacaaaaaatattggaattggaaaatgaggattcttactaagtgaggtgaaattgatggcagcgttcattgataaaaatgaactaatggaacagggatatccaaaacatacggcacaaaatatcattagacaatcaaaagaaatcatggtacaacgaggatatccattctatatgaacaagcgcgttggtcgcgtgccaaaagaagttgttgaatccattctaggttgtgaactagagtcggaggaaaacagcaatggctaaaacgaaatatgcaggagtttatgtagataaagaaaatcagttttactatgaaacagagctaggcaccgatcgtataacaggaaaaagactgcgcaaaaaaggcagaacggaccaatctggaaaaaagttcacgtctgctcacgcagcctacaaagaattgattagaataaagagagaatatcatcaagtccaaaaatatgcaaactaccatctaacctatggtgaattcatggataaggtctatatcccggcatacaaaacagatgtagaagaaagtactttttcagtccgaaaaaagaccttagaaaatatccgtgaccgcttttcagacaaacctttacgcgaaatcaatgtagaagatgtacaatcctatcgaacctggctactaaccgaaaagaattctggtggtgcgggttattctcaaagttatgctagtctgattttcggtatgttcagaaaaagcttagatatggctgtgactatgcaatatcttgagagtaatatttcaaaacgtgtgaaggctatccccaaaggaaaatgcaatgttgcttattggacaaaagatgaattcgaaaaagtgattgcaactatttgcatcgatgatttttacgaacatttgtgttttgtcatgctgtgggtgtattacatgacaggagtacgtgtaaatgaaggcacggctttgtggtgggatgacattgattttaggaacaaacgtcttagagtccaccatatgctagttacacgaagtcgcacagactgggatcgtaatgattacacgaagacagatgatggtaagcgcacaattgtcttagatgatgatactcttgcaattctagcagcttggaaaaagcgtcaaagccaagtaggaatccatgattttgtcttctcgtatgatggacttccaatgattaaatccactattggtagaatcattgagcgttatgcaaactttgccggtgttcacaaaatccaagcaaagggattacggcattctcatgcttcatttctaatcaatgagttcaatgtttcagtactagtcctttccaaacgaatgggtcattcaagcccagaaatcacactaaagcattattcacatatgtggtcgggtgcagatgaaagtatcgcaaaggaaatggccggtagtatcaagattcaaactgctaaaaagacaaagattgcttttaacgggaatcaaaccataaaaaaataagaataatctagttttccgccagaatccccgccaagaaatattcaaagtgctataaacactgatttaacagtgttttaagctcacctgtgacattggagtgggaataaagagccaacataatatggagagggaatccctataaatcaacattcttcaatagctaaaatgcttgattttcattaaaaataagatggttccctaccaaaagagactgtaatataagttaatttgtttcattcttatcataaaaagaagttctcgaaaaacgaactgttttccgagaacttttttctatccatctaagtgctcaaatcatattcacgacggaattctaaggttacccttttttaaacaaactttatgttatctgcacaactttttgcaattttttcattgcttcttacgaaatcgttgaactctctttagcataatacaaagtgtagatgaagtctggtgctttactcgttttggtaaaaatgattggaaatcgtttctggttatttttggcaaaggcgaggtgcaggttcgattcctgccttctacgctaacgatgtggctgaagggaacctccgatcttgaatcgaaacgatccgcagtctattgtttcaccaatgaaacaaaatcaacgttcgtccaagcatttcctgaagccttgctataaaccccaatttcacaaacacctgttgtaattggaatgtctttgattgtaatttttgtccattcacttgttttaacaaccgcagtatttagttccgctccaccataatttttgatatataactgattagtatcaaactctcccccagacattacataggcactcaatgtgtaagttcctttgcttatgccactaacattttgataagctgatgcctcgtatgcttgatcctgccaaaaagttagtttgtagtccccaaaaaaagtgcccgcttccgttttgatcgtacccttagcggttccttgttgaaaccaggtttgccaattggaaggactggtcgttggtccatcgctttcgaaacttgcatttttaactagatttatttgcgcccctgcttgtttaaacgcacgcaagcttggcaaggcgtttccagcaaaatcaaacatcgcctggttgtcccattcgtttcccatagtggattgaacactgagataattcatacctgcttgtgttgcccaactcacatttccgttgtaccaaagaggttcccaatagaagaagcccgccccgcgattattcggtactgcctgaatccgatcggcaagatccagcaaatactctgcttgtcctgtcggtgttggttcatatccccccgcagctgcttcggcttcgccaaaagcatttggcatagtatcggcattcgctgttgtatgcccataagctgtttcaactacgatcacttctttaccataccgttggctgatcgcattcatattggtttgaagttcattcattgaaccgtgccaatacggataatacgacactccaattaaatcaaatgacacacctcgactcgtgatttcatcaaaccaccaagtaaatgctcctgtatcgccaccatcagctaagtggagcattactggagttgttttaggttgagtgtctcgaacagcttggataccagacttcaaaaaagcagccaatcgatcaaattctcccccgccttctccccaagacttgccataaggccagagcattccgctattcagttcattgccgatctgaaccatatcaggataaacgtccagctgcttcatttccgacagaacgttctttgtatagtcgtacaatgccgtattcatttcttcaaaggtcagaccttgccatgctttaggaagattctgtttcccaggatcaacccaaaaatcactgtagtgaaaatccagcagcaccttaagtcccagattttttgctcgttttgcaaggtcaatcgtcgtttccagatcatttgtccctgctccataactttctccattactattataaggatcctgccacaaacgcagtcgaacatagttgacaccattattttttaaaatctctaaggcatcttttgaaatatcgtcttcataatattttgcaccagatttttccatatctgacaggatcgaaatatctgctccgcgaataaattcgctggcagatgcttcaacagtttttgaaacagcccccaaagcccctaacacagctgcaaataaaacagctttacgcaaccaaattcccattttcattatggctcctcctttattgaaattggttcagaataaactgaacagctttttcaggatctctcgttaatccgatatattctgctccttttgtcgcaaccagcttgattcctaagcgatcggtgtcttctttgatatcatcatagtaagaattgacttgcggtgctaagaccaccatatcaaaatcctgcagcatttcgtaatgagaaccataagcacccgccattgcactgatcggtgctttcgattcagatgcacctttttttaaagcattagctaacatcgcacttgtccctgcgccagcacaaagtaccaacacattgatttctttatttgcatcgctgataacttgactcgctgccacaggtacttcctcacgtacatcggcagaagcaccttcctcggttgcgatcacctctgctttttgtgcttctttctctactaagacagcatcgtatgctttgcaaaatggtagatagatcaggaagtcaacgacgattagaaccgctgctagaacaaaagctaagatacccatgcccgttcctagaaccaaaccgatcggtgctggagttgcccaaggcaaaacgtacataaagctgttcatgcccaatacatcgacaaaaaacttgaacaggcaaacgtttacaacaggtgttaacaaaaatggaataaaaaaataagggttcaaaatcatgggtgccgcaaatagcaatggttcgttgacagcgaaacttactggaataaaggaagctttcccaactgccttcaactgcttagacttagcaaagagtaggaagataaaaggaacaaccaatgttgccccagttcctcccatagttcctacaaaattccctaaacccaccgtcagtactttagaagcttgttcaccggaattgaacaattgcagattggtttccacattggcatagataattgccgcaattgccggctccacgatcgacggtccatgaacaccgacaaaccaaaacagcgccatcgctccccagataatagcgattcctaagtacccgtcagctgctgtaaatagcggctgcagcaccgtaatgattgcttctgcaaatgagatttggaagatttgtcgaatgcctaaatcaattaaaacggccgcaaatactgaaaaagagaaaggaaaaatatctcggaaggtttgcgaaatcgttccaggaacttctttaggcattttaatggtaatatctttcagcacacaaaacttatataaattaactgttaaaaatgcagcgacaaaggaagccagtagtccctttgtccccatatattccgttgaaaatccaccttcaatcggagagacgcttaacaacaggaaacttaccacagaggccagcatcacagaggtggtgttgattactttgtttttcggtaagcgacgattcatcgaatcagccaagcagcgagcagtggttgctgaaacgagtaaccctacaacacccatcgaataattatagactttccatagccatgtggagacagattcaggccattggtaaccaaaaatctcaggaaccgcagcaatcaaaatgaaaatgcttgaaaataaaatagccggcatcgctgttaaaaatccgtcacgaacggctcctaaataactattacgtgagattttttcaaaaaatggtttccctttttcgatttgtttaatgattccatccatagcgttcttctcctatccttgattctgtctgtacagtacaataaagtcttgaatcagatctctcagcaataaagtggtcattaaatgatcctgcccatggataaaaatgaatcccatctccatctctttcccagatgcttcttccgctaaaatttttgtttgcgaattatgtgcaagggttaaattttcgtcggcttctttcaacgccgaatcaacatgttcaaagtttccttgtcttacttctttcaataatttcaataatgtactgcgagcgtcgcctgaatatgcaacgatctcaaaaccaagcatttgtaattcctctttattcatcttttcttcctccattatcacttattaaataatcgttttggtttcactgaccaacttgtaccagtaagctgattcttttgggtaacgcttctgggtttcaaaatcaacataaaacaagccataccttttgttatacccatttgtccatgagaaaagatccataagcgaccacaaaaaataccccttcacatttaccccggctgttatcgccttgcttaaggattccaaatagactctcaaatagtcgattctcggctgatccataataatgccatcttcaaactgatctttataccccatcccgttctcagtgatatagattttgttgtaatgtgggtaatcgcttttaattcgcagcaacaagtcatatagaccttctggataaatcagccagtcccaatcagttcgaggaattccttctttataaatgcgttctccgattcccttcactttataaacagaggtccctttttcacccgtaccgttatgatggattgcattttctccatcgtaagctttgacaaaatggcattggtagtgattgatccctaagtagtcattacgcgtggatgcttttttcaattcaacgaaatcttcttcaggaaaatgatagctggcctgatttgcttcacatatctcatcaagagcagtcaaggtttcagttgaataatagcctaaataggtagcatctaataagaaacggatcgacaatgcatcgtctaaaaaggcagcatgcttatcttccggcgcgtctgttgccgcatatttcgtctctaatgagtgaactacaccaatttcacccggaagttcgttttctttgaaatagttcactacacgggcatgagcaaccatcatattatgaagacaggcgacgatctttgtaaaatcatatttgattcctggtgggaaaacacctaacaaatattgattggttgcaactggatagatttcattaaaggtactccacaccttgacttctttgaattcatgaaaacaaaaaatggcataggaaacaaatgcttctattgtttctcgattcaaaaaatctccatggtcaaacaaacgtttaggggtatcaaaatgatgcaacgtcacaaacggcgttacgtttcttttcttacattcttcgaacacacgatgataaaaagcgattccttctggatttggtttcccagctccatcaggaaaaatgcggctccaagcaatggataatcttagaccatttacaccaaaacgttcacacaattcaatgtcctttgcatattgatgataaaaatcacttgccggatcgggactgaatcgcccttgttcctctaaaaagtcatcccaagcaacagcgcctttgccaccttccttagtggctccttcaacctgataggctgctgtggctccgccaaaaataaaatcttctggtaatttaagcatgtacatctctcctcaaatctataatcagttttcgctctttctaactgattgcattgtaaacgcatccaaaacatttgcaaacaaaaacaaacacaaataatcataaaaaccagaaaatagcaataaaatctattgtaacaaacataaaaaccaccctaaatgtttacttttgttcgaattggattgactgttgtccgtttatatgatagattatccttaaattagaggtgaagacgatgttgaaaaaagaaagattgcttactatcgtagaaatggtcaataaaaaaggaatccttaccgttaatgaaatcatcaatcaattagatgtttctgatatgaccgttcgcagagatttagatgaattagaaaaatcgggcaagctgctgcgtgtccatggaggggctcaaagtctttcctacactttagatcaagaactttctcacactgaaaaagccactctgcagattcaagaaaaaaaagaaattgctgccacagcagcctccttgattcacgagggagaaacgattttcttaggaccaggtacaacaatcgaactattggcgacgcatttactgaacaagaaaattcggatcattacaaataattatccagtttttgatattcttgctcaagcagatggaccagaaattctactgattggcggtgatttccggaaaaataccggcgcatttgtcggaccgatcaccaacgacaatttaagaagactaaagtttacaaaagcatttatcagttcaaatggcgttcacaacgaagcgatctctacttacagtaccgaagaaggagaagcacagcagatcgctctaaataattcccgtaagaaatatctactcgttgataataaaaaattcaatcgagatgatttttatgtgttttataatttgcatgatttcgatctgctcattacggatcgccagatctcgcgggaggttcaagagcactatgcacaatatgtcgatctgcaaattgctgattcaaccgaaaataccactataggagcgtaactatgaaagggattatatttgatttcaacggaacaatgtttttggactctcatctgcatgaagctgcttggctgcatatgatacatgatcatacaaaagatggtttatcagacgaggatattttaaaaaatattcatggtcggacgaatacggagattttgaaacatttcatttcagagcatttgaccgcctctgagatcgccgtattgtcagaagaaaaagaaagctattatcgtatgctttgcttgcaaaatgaaaacgatcttcagttgacaaaagggcttgaagcgactcttgaccagctgactgaccaacagattccattaacgattgccacggctactgtcaaagagaatgttgctttttattttgatattttcgatttagcccgctggtttgactgggacaagatcgtctatgacgacggctctttccctgggaaaccgcaaccggatatttttcttaaagcggcagacaaactgagcttagctccggctgattgtcttgttatcgaagatgcttactcaggattacttgctgccaaacgtgcggggatcggaacaattattgcaattgatccattcggtaaaaacaaaacagtatttgaacaggcacagctaaataaagatggaaccatcaaagattttactggtttttggacagagcacctgtctgccacatccgttaattcttaaacgattcaactaactaccaaagaaaagcaactgaaatgcacacctccttttataaaaaactgccagtgaaacgacatgaaagatacactgctatatccttagtgaaatatagcagtgtatctttgactttttcattcttttaaccatatgacgcgttcatctctatctataattaacattaaaaatagtgttttcacattatttctcaaaccaatcataaaaatcatcaggagtacttttttgatatacttttattaatgttgggcgtaatggttgaaagatttccactagttcctctccaccaagctgagttgaaaaatgcttatctgtaaacaacatagacaaagaggaaataaacgtttccgtatctttctctgtcccaaggatattaattaattttcctactaggtaagtatcattaaacttaagatctgccttcacatcaaaagttttgataaaagcttttaccatgcgtacaattttgtctttatcgccataattgatttcaccactcatatcaatatagtcactaatccctgaagaaataatggcaactgcttcttctttcgccttatcagataattcatttaatgactgggattgattgatgacttcttgagttttatatgttacgtaatctctcattatcctatcggcatactccgcaaagtaatcttgaataaattcttctacagggtaaccaacttcgttttcccaaccaggagaaatttcattatcagtacttattaaatctattaaaaaccaacccgttctctgagtgttgattctataatatttttaatttcctatataaatcaaaaatattatagaatcaataagctaattaagaaacaaactttagaaactctagaagaacttctgaatttatatagaagtgtgtagctacttactaaatatacaaaagttaaaataaaatactctggatactctttatactgcattaaagttagtaatattaacagcaaagatatcgaaaaaacaataacataatatgtgtcaaaatttttcataataagaactcccttactgttgcatactaacataatccaaaaactcttctacttcagctaaagacattccactttctttagtccaaaaaacagttttttctatcgatccttctctgtaaactgtaaatgtcggagtcgagttaattgagtagcgactcttgaattctttccactcattttcatcttatctaacttttgctacattcacgtaataaatattttcttttcccttttctaccagcatatcgaatagcttcctgcttttgatgatcgatttcttgtgctacatctagtaaattttcatcaatttctatatcataaagtatttcactagtgtctacatccacaatatatacttttttatcagtagcaatttttgagtaatccgttaaaatgatctcagtctcgtcactttcatcagtataaatatacgttaacaatgaactcaccttttcaatcggtgttagctctaagcctactgtattttttactattgagtcattatttaccaccataacttcgtactgtatataccatcctatttggtttccatcaatatcagtaattggctcactagctaatggagtctccggaacaatattttcctgatatttcttaaattcttctgtagcacgaaaaaggttatcatgttcctcacttgaaactggttgagtcatagaaaatgttacttggctaaacagagggaaaataaacactacaatcaacaaagtataaaaaaaagcccttctttttcattttttatcttccaatcacaaattgaaaaacttattcctgcaactttgagtctagtatcacaatcgactgactacaactattcatttacattctactttaagttcctccttaaccattaattttattaaagatacttgtaatagtgattctcacaaaatttcatgaaaaatactttattactgtatctaaaattccaatacacaacttatcgactattatctgaaaaccaaaacttattattccttgatgttattctagcaatagtaactgcttttttatttttttgcatattttttcggcgttactttttaaagttaactttttcgacaaatagaaagagatacgaatcactgatttttttgaagaaaagaaatggagtgagctgaacgttagagatactgggagctttcgcaactgcttattaaacgataatggttattcgcaaccgtattgctcgcttctacatgatttcatgaaatatttcgcaaaacctttgattatgtagttacgtttccattcttgactaaaaatgtttcaaaaacgaacaaaggtgttaaaaggtaaagtgatcaatactactggtcaaaataagaggttgaaagggaattgaaaaataactacagataatacttttataaacgtacgtgctttgtggttctgtagttaactatataactggaattagggaatggtatcaaattgaaaagaaagattctaccaatttatcatatgttaaaaatggaaaatcaacagcagttctttcggaaaccttacacaaaaaccgattattgaaaatagccgaaaaacgtttttcggctatttttttaattaagtttccttcttcttaccttttcccactattccgtttcacatctttgatgatcttcagcgcacgttttcgtgttttgatatttggacttttcaagcggcggtatgcacttgagatatctgttttttccatatggacgacccactttcttctttgattgtagtcatgctaaaaaacacaaatcgaaacaattacgatttgcgttttaaatggtatcaaaagttaaaaagaaagtcaacttgttaaaacagtcgatcagactagctgattgactcctatctctagaaataaattttcattattacgttttagctacctaaaaaaggccctcttgtccgttaactttaatatctattgttatagctagtttacctattgaacgtactgtttgttcgatagaacactaaaaaagaggctgggacagaagcgtttaactccaagaaataagaagaaattcacgaaaattgcttttcaaatttttgtgaatttcttcttatttccgaaggagttgcttctgcttccgccgtttatacgtgtttagagcgtgagacaaaagtgttctttacttttgtcccacgctcttttaaactatttcgaagtactaaactactaaacttatgaagtaagaatacctaagccagagccaatgtgctcgcctgcaagcaattgcttttttgcttgtcgctgtaaactcgtactttctggataatcatgtatttgggcatctactcgtccaaagatccaagggactccactatcgtcctgtttatcaactgataataatcgataatcggctgcaaaaagacagatttttgactcttttttcaaccatttagtaagattgggtgatagtaaccaagtatctgtgtacatcacttggtaatggtaatcaggaaaataaagttcaaaaaaacgaatggcactttcgtaactatctcttatcttattctgagataaatctgcatcggaaggaatatgaagagaaaggcactgctttccttctaatcttagatccgtgtaccctttcggaaaatatgtcatttcgtactccaattcaccaatccgaaagatcaagccactagtgtaatgccaaatccaaaaaccacggtcaaagcgatagcttcctgttacttggaaatgttcatgaataaatctagtaaaagcattcattgttgccaaatagatagttcttggaatcttcaatggttgataaatttttttccaactttgagaagctgcatatagataaatagctaatgctgcaaaaggttcctcttcatagactttgtctattttctttgcagtcgcctttgctttattaggatccattagttcatgactatattgctcaaacacctcatcaaggatgttttttgcttgtacaatcatttgctctataacgactttgggaagagttaaagtttctgccagaatttggatttcattgcttattttcttcatcaaatttccccttttcatatctttgaacctcattgtttaaatgactgattatccggacaccatatggtataaacatacttttattgtacactaactataaaacttaaactttctatgaagaaagaatatctgtaagactttcaaggaaagcattgaccatctcaggaaagtttattcagttaccatcataaacaaaattttttgatagaataaatataaaatttttttgaaagttcctttccacatttttctgtgaatttgacttaatgctgagaatctggcttttgaacaccttgaattagaggttgtgacaaaaatcttgtcataacctcttttggcacatatatttgtccttctattctaatttttgacgaacaaccgttaaataatgttgcaaaccaaccgtcattacccacgcaacacctaaaccgatgaaacttcctatgacgatccctaaaaaacgatattcgatcaaagaaatcaagtatgctccacgaataagtgtagatagcatcaacgccatcggattaagaaaaatattagcaactgcataatttctagcgactagaaattgtgcgattccatatagaaaagtgatcagaaaaatggtctgcaactgcgtaaacggcacaaatgacaagaatgccgacacacataacccacccatcgatccaatcagatattggacttgtcgatgcttcatcgcatccaagttttctgctagcaaaatcgatgcacatgacaaggtcaaccaataaggattatgcagattcaagccgtgactgacataaacggaaagaaataaggcagcgctgtagaaaacagaatcaatgatcactaaaggctcttcgtgaaatctttcttttaaagttgctttttcaattgtctgctcaggccgtgaatccagtagttttgtaatcactgccgcaatcagggcaaaaacgacacccataaaaaaataaagcgagacgatcggtaattgagcgattggcagctgcatgctcgttcccatggcagaaagcatcgcaaaaaacaagccacctggtttagagatatggaataatcgcaacacaaatctgctggaaaaagcaaccaaggctacagcaaatggttcaagccataaaacataagttgacaaaatccctagaacgaaagcaaacaaaagaccacaaccgatcaaaaacatacgtttcaacaaagatttcatcggtatgttttgataatagaaaaaagtaaagattcctaatgatgaaaaacttgaaatcaaaaagtcatgatttatgtaacctaaccataatacgataaagataagtagcatcaggttcatgatacgaaaaggattatcttgtattttattgaaacgaaaataagtcttgaacaatctatccctccttcctagtgatttgaaaagaagctgaatcaaaatgaaatgccaatcccgtttgtcagcattacctagtataacaactatttcttgatttttcataaaattagtatcaagaagaaaaaggcttggaaaagtcaaaacaaagaacgaacattccgagtcgttttgacataaaaaagatagcaagttttccaagcaactcgctatcttagctttttttattaaaaccgaatgaatcgtatctaagagcgcaccttattctcttttatgcactggatttttctcttgtcttttgtctcatatcaagaagctggtgcatagtctctaaatcattcatcgcgccggtaaataagggccaagcatccaccccatcctgtttctttctaggaataatatggaaatgaagatgagagacatgttcttctactgtctcatcttctgctttgatcaaattgacgccatcaaaaccgcaattttcgacacaatgaagagaaactgatcgaatgacattcatcaattcgataaatagttctttctcgcaatcaattaaattgacccgatgttttttgactagagcgatcatatgaccatcgacatctcctgcgttatctaaaaatacaagaatattttcactctcaactatttttcttcggtgtaatcttccattcactattttacaaaataaacaatcctccaattcatccacccctttgtggactaagaaggggtaagacttctctgtcttccccttgcttttaccaaaatatcgattaactatcatgtttgatcacctgactttcggtgctcagtcaaactgcagatctcacaattttcgatacgcttctaattccttttgattcccgtatacaaaatgtccggggcgtacttcctcgaaaaccggaccgtcttttgtataatcgtgtatgctaggatcatacacatgcaattttcttttccttgctaaaataggatctggtatgggcacagctgaaagcaatgtctttgtatatggatgaagcggatggttgaataactcttccgtttcagctagttctaaaatatgtccttgtctaatcacagcgatcctatctgaaataaaacgtacgactgatagatcatgagcgacaaaaagatatgtcacttctcgttttttttgtgcatctttcagtaagttcaacacttgtgcacggatcgaaacatctaaagcagagattggttcgtccgctacgactaattcaggttccatcactaatgcacgagcgattccgatccgttgtctttgaccgccggaaaattcgtgaggatagcggtacatatgctctggaagtagtccgacttctttgatgatttttgccaccttttccaaacgttcttcttccgagtggaaaaggttaaaattatagaggccttctgagataatatattctactgttgcccgttcgttcaacgatgcggatgggtcttggaatatcatttggatcttacggattttttctgcttgttcttttttcgacaagggaccattgatctttttcccttcaaagagaatatcccctttgcttgtcggatttaatccaatgattgctctgccaatcgtcgttttgcctgaaccagattctcctacgagagagaacgtttctcctttataaatatcaaagttggcgtcttggacagctacgaacttgctttttccttctccaaaagtgatttctaaatcttttacagttaacaaagtttttttatcagctgacaacttgcttccccccgtcttgttcttcactatccaattctgcagccaaagcaatcattttttcatgaagattttcgatttgttttggtttaagtactttcggtgcacgaggatccagcagccaagtcttcgcaaaatgggtttcggatacttggaacataggcggttcactagtaaaatcgaccttcatcgcataggcgctgcgaggcgcaaaagcatctccttggatatctttatataaagaaggtggtgttcctggtacagagtaaagcacatctcctttttgtgctaattgtggtaaagaagaaagcaagctccatgtatagggatgttttggatcataaaaaatttcttcaactgttccgctttcgatgatctgtccagcatacataacagctactttgtctgctatagccgcgacaacgcccaaatcatgggtgataaaaatcgttgtgaattgatattcttcctgaagctctttgattagttccaagatttgtgcctggatcgttacatccaaagcggttgtcggttcatcacaaatcaagattttaggtcggcaagccaatgcaatagcaatgacgatccgttgtctcatcccaccagagtattggaaaggatattcatcatatctttttgccgcattagggattcctgttttttccatcaattcgacagctaagcgtttcgcttctttcgctgatttcttctggtgtttgatgatgacttctgagatttgtgagccaattgttttgataggattcagtgaagtcataggatcttggaagatcgtcgctatttcttttccccgagtatcttcccattcttcatcctttttcaattcgcttaatatcttgtctttatagcggatcgttcctgaagtgatattgccgttttgttccagcatcccagtgaatgtttttgtcagaaccgattttcctgatcctgattcaccaacgatggctaatgtttctttttcttttagctctaatgagacatttctgatcgcttttaattcacggtgacgaacatggaagctgaccgagatgttttctactgataaaattgtttgattctccattgtttgcctcctaaatatgtgttcttggatctgccgcatctgcaagagtttgtcctacgatgtataaagaaacagaaactaacgccagtacagtcacaggaatccagaaaagataagggtaattgctcatgttattcgtatattttgcgatcaatcgtccgagggaaggaacatcactgcttaacccaacgcctaagaacgaaagaaaggtttcatatgaaataaacgaaggtagcgctctagatacatctgtaacgatgatagaaatcaaataaggcaggatattacgaaaaatcatccgcaatgtcggtgttcctagtgtttttgaggctaaattatactcgcggtcgcggatgatcatgacttgtacccgaataaagtaagctacgctcagccagctcgtcacacacatcgcaaaaatcaaattccaaaatccggaaccaaacgtatacgagagaacgatgacgatcagtaaagttggcacattcgagatgatgttgtaaatttccaacatgaaacggtcaattgctttagatgttccccaaatcgcccctactactacaccaataactgtagtgatcaatgtagcaatgacactgatggaaatcgatgttttcgcccctgcccaaactgcatcgaataaggacatgccgttagcatctgtaccaaaccaaaattttgcacttggtggattatagcgtttcgtaaaatcattgatatcttttacatccataaatttatatccgctgaataatggctggataaagctcatcaataagacagccagcatcagtatcagcataaaaatcgctactttatttgaaaagaatttacgcatgaccgaacgccaatacgaatacttcggcgtatcaatcttttctgaagctaacgaattcgtttctacaaaaatgaattcgttcatttgttctgttttcacattttccaagctattttcctcctgacgatagtttgattcgcggatcgactaatgccatcgcaatgtccccggctaagattgaaaatacggatactgtggtaaagacaaaaacgattgcgataactaatggattgttatgggtaatgatcgcatcaggtagcattttccccatacctggtgcagcaaacactgtttctgtgatcgtcgccccagcgatcgctccaatgatacttcctggaatcccattgacgattgggatagcggcatttttgaaaatgtgttttctagcaatttctttcgcgttcaaaccttttgctttcgcaaatttaacataatcagaagactgttggtcgatcatataacgtctcagccaaataacgattccagaaacagacaatagtcctagaatcactgttggtaatatataggagcgaatatcttgtgcgcccaatgctgggaaggaatctggcaaagaaaaccagctgcttccaataaatcggaagaaatagataaaggctagacttggcacggaaatcagcaccgttacgatagcgatccctgctttatctggtatctttcctttgtaacgagccatcaacatcgcagcaggtatgccgattgcataagcaataacaacagcgatggctcccatacgaaatgatgtaccgatcatcgatgggtcttggtaattcgtatctgtgatgacataattgtcagaaaaatatcttttgtctcgtgaagagatgttttttgttttctgatattgacggagatagatattagcagaagagcgcgctgtaaaatcatcattaaatgttgtctctgtactttctgttttcccttgtcctcctgaaatgatgcttgttaccgcttgtccggcaaatgtcggatatgaagtgcctagattcaaatgaacgatattttgatggatataaggaaattgtccattgaaatagatttggtatttatattgtgttcctgaaccgacaagtgcccaaccgaccaactcatcgttttcgatacgcagagaatgttttaagtcaggattgctagcatcttttactttccaagggtgatcgatttggatcatattcgcatagaaattcactacgcgttttactaatggaatatcttttgtcgcataatattctttgctgattggaaattgtttgagcgtccaaccatttttcttcgcccaatcttggtatttttcttctaactgctcagaagaggctttttctgatgaactgcttcctacttcttttttcagttctttcgacgtgtggtattcgatataacccatcttgctgaaggctgtattttcataatctgccagctcatctggttttgcctttaattttccgtaattcacatcattttgaaatattgtttttctcggaacaagtgaatagatcaccgcataggttaaggtagttacaagaaaaatactaagtatagagcgcaggaccctaaataaaaggtatcttttcacaattttccctctctttcatcatataagtaaaaaaggctacaatagaaattgaaagccttttttactattcattcagctaaattacttagaacttgttgtttctgcttctttcgcagcttcttcttttttcgtttcccaagctttcttcgctttgtcgtattgttttgttgtaacgatgtcactttgtacttctatatattttaatttatttgtagcaatacctgtccaagcgaatggcttgctaaatggtacaacatttgtgacgcgaggcgtaccgccgtatgcatagattggtacttgcaaagcattatccaacaaccaagcttctgcatctgcgtaagcggtgtaacgagcatctaaatcatcagtgatagcagcggctttatccaataaagtatcatattcagataaattgattgcttttttcgcagcagctgaaggatctgttccttgtactatggcagaagcttccagtccaagtgtatggatcatatcccctttgcgtgaatcatagatattcaagtaagaagatggatcagtatagtctggaccccaaccagaggcatttgtaatatcaaagtcgccagcttgtcccgtcgttgcttgataagtagcagctaaatatttattatcatttaataagtgtatatcgactactacattatccgaacctaaagaatcttccactgattttttcaaagattttgccatattgacactaacctcagaagtttcctcaaccggcatatctaaatgaatagggaattggacaccttttgcttctagttctgtttttgctttttctacgtaatctttggctttatctgcattataataaccatcttgtccatcagataagtctacatcgccaaaagcatctgaatccaatgcctttaatttgcttgctactgtgtcgccgtaaggtttatcgttgatctctacaaagtcggctggaatcattgtattacgtaatgatttattagccccttcttctcctacgttttgtgcgttataacttttcttatcaaatccgaatagaacagctaaacggaaattacggtctaaaatagcattgtgtgtatcttctttttctttgtctgttgtttttgaagttgcatcaaatgtgcctcggttaaagttgaaggttaaattatatgttgatgcatctgtttcagaccaagtcacgccatcgggataagctttcgttacatctttataccctggagagtttggataaactctggcagcagagagttcgccattttcataagatttgaataacccatccggatcacttccatcattataggtccattttactgtatctaaatggacatttttaggatcccaatacgattcgttcttcgtatattcgatgactgatttagctgtgttgtttgcaaggatgaatggtccattataaaggatagagtctggtgttggtttaccgaaatcttttccttttgattttaggaactcttcattgattggatataagataccgtaagtcgtttttgagttccagaatggttcaggtttattcaatgtgtattgcaacgtataatcatctactgcttttaccccaacagtagaaaaatcattcgttttaccatctatataatcagataagcctttgatactatctgccacgatatataacgtttctgattgtacatctaccgcgtgtttcaacccagtaacaaagtcatttgctgtcacatcagccccatactcatttccttcactatccacccaaggaacacctttgcgaagatgatacgtataagtcaaaccatcatcactgacttcccatgacttggccatatcacctttcaggttcccgtattgatcattctccaaaagcccttccacaaaattagtatagtggtcactattcgttttacgggatgagaatgtgtaatccaatgtttcaagatctgttacatacacagaactatattctgatacaaggtcacttttctttgaagagctagacccttttgcattactcccgcatgctcccagcataacggcacttactagaagcaaagctaaaacttttttcatataatgtatatccccctattatttgtactgctttcacccttttcaacccctattaaccagataattgcgcaacatatttaattaataaatcacctgaaataattaaaagataatgaaagttattgaaataatacatttggcatttggcaatgtcaaggtaattcagaaaaataattcgaattatctgaaatttatatatataactacatatgcaattatctaacttttcatttttatcatcaagaaaataaaaaaataaatattattaatataataagcgtaaaatgaatggattcgaagaaaaaagcgttgaaaaacttatcttttcataattttttcatgtatagcatattccatctttatactaaaaataatatatatatgcatgtggtttatataattattaaaaataatctttgagagtaaaaagtgaacgaataaaaattacttaagttatatattcggatattttctcattttaaactcatttaaaagaaaccggattcccaacaaaaaaagcttctaattttcgcacgataactacgctggtccttaaacttcatacttttttatgatttttcagcggttttcgatggtatactttttaaatggaggagatgtctatgcggtatgtatcaaaatttttattagggatttatttattctttttattatggttgattttattcaagctatcatttaatcttccacaattcctcacttattcttacagcaatgtcaatctcgtccctttttctactttttcttttgaaaatacaacggtattacgcgagaccacttataacttgattgtcttttttccttttggggtgcttttgaatgtcaatttcaagagactttctttttctaaaaaattagggattattttccttgtaagcttcttggcagaattgattcaattcctattcggtattggagtagcggacatcactgatttgataactaatacaacaggaggactgataggtttatgggcctatcagcttctaaacaaacatctatcgacaaataagttagaccgtctagccattattttgggatacattttattcttatttctgatcgtagcttttttatttttgacccgaactgtccgtcttcaataaaatcgttcgtaaaaaaagaccgtcatagatacattccaatgtgtatctatgacggtctttttattcagtcattggtttaaaaaaatctattttcatctctaatctactatattattgcagcaggacgacttgcagtttgaaactgacaggctatattccccttatttaacaaaaagggttttttagcttaaaggcttaacattcttcctagtcaatatctcaatctagaaaggaattccgtcttaatttataccctactcaggtatattatttttctataaaaagcttgttttataagtaattactttatattttctatggtttttctccttatttaggctcccttttccttgattctgccagtatattctgcctgatcctactttttgaaggcatttcaaaggaaaaaaacagtagtttttagaagtagtagagaaatctgagacacggtattttctgtgtcgttattttttaagtataaaataacaaaagtgtaaaatgagatatgttatttttttattccaaaaaccacaccgttttatactgtttgaaaacacgttaatatttattcatttctgttgtatatctcctatcaaaagaaatctatatgcccttctttgactagttttttatttttatctcttacgaagttatccactgtggaaaaactaactatctatttttcgatacacttttctaaaaattaaattttccacaaataaaaacacgtttacaacagaatcatactgctgtaaacatgcttttcttaaatagatagaacatcagattacataaagatgtttatttttttattgctgtgaataatgtcaaaaatcctacgacaccaactactgtccaagtcaaatgaccttgatccaaataaataagcatcgtgacaaaactagtaatcagtcctacatgaattcttttttgatccatctgcatccctctttgaatactagtatcactcggatatttgatcgtttatttattttttctatatttttctcttaaattttaaacacggatcattttaccgatattgtgattcgatggtacgacttgggatgatccaagcagctagaatcacgatgtttgcgatcagcacggctactggcgctactaaataccctaagacaattcctaacacattcaaaccaatcgatagatacgatttcttgtaattattcaacatcgccttcaatgctttctcgtggcctttatttgctttgacaagttcttttgccaagatataatacgcaatattagcggtcaaggtaacaaaaccataagtcatttctggagccaggctattgatgtactcactgatccatgaagttgcaaacggaaaaagcgaaagcgcaaaaacaaagaaactgttcgcccataagacccgtccatttatcttatgtacaacttgaaataaatgatgatgattgttccaataaatcgctaaaatgataaaactgacaatatagataaaaaatcggtaacctaatgcagcgagcgcctcccacgtatctccgttaggttcatgaagttctaaaactaaaatagtcatgataatcgcgattacagcatctgtaaatgcttcaagacgatttttaggcatgatattctcctccttttccgctctattttagatgataaaccagagaaaaagcaattgtttgatcatttaagtagatgaagtaaaaatcagtcttcagttggaggtgtttttaaacaatccctgttatactttttctatagtaaagaatgaacaagaggagggttttgtatgcgtcaaaaaaatatgttcttaaatatcttcatggttcttttagtgctaattgcagctagcttcgtcatcagtctttttgtcagtgtcctaagcgggcttttatggtttgcggtcaaagttctaatcccaatcgcacttatcatctggcttgttcgctggatcaaaggaaatacacatagaaaaaactattattaatgtatgataccattcactttattatgatataacttactaaaaaaaatagggtcgcgatataagttcgcggccctatttgatatatcatatatattttttttatttatcctaatgccacatccaaaatcatcataatgataaatccactcatgacgccaaaaactgcaaaatgacgtttgctggacaatgtctgctgtgcttcagggatcaattcttccaccacgacataaatcattgctcctgcggcaaaagcaagtgcataaggaagcagcagctccactttcgttactagtagcgctccaatcactccagcaattggttcaacgattccagaagcttgtccgtaaacaaaggcctttttacgactcagaccttcttgtcgcaacgggattgatacagctgctccttctgggaagttttggataccaatacctagcgccaccgaaacagcggctaatatagcggctgtcggattatccgcagttgctgctgcaccgaatgctacccccacggctaaaccttcaggaatgttatgcaatgtaatagaaaaaacaagcaagatcgtccgttttaaatgggtaggcaatccttctgcttcatgttgtggtccaaaatgcatatggggcagtgttttatctgccatatataaaaacacaccgcctaaaccaaacccaatacttacaactagccaagcaatatctccattttcttctgcttttgtaatagccggatctaacaaagaccaaaaacttgcagcaatcatgacaccagaagcaaatcctaacatcaagtttagcacttcttttttgatttctttaaagaaaaaaaccaacccggcaccaagagctgtcataaaataagtaaaagctgtcccagcaagtgcttgctgccaaggttcaagtctcaatagccattcaaccatgccattcccctctcttgaatctatctatgtactactctagcatattcccaaaaacatgactacatttttgtgaaaagacgaattagttgggattttcgataaaaagttctatactctagatacaaaaaatttatgtatcatcattgctaaaggagtgaaacaccatgtcaaaaatcaatgcaggaatcgcaatggtaaaagttcttgaaagctggggtatcgaccatatttacggcattcccggaggatctttcaattcaattatggatgcgctatatcaagaaaaaaccgaaatcaactacattcaagttcgtcatgaagaagtcggcgcactcgcagccgctgcagatgcaaaattaacggggaaagtcggcgctgtcttcggctctgcaggacctggtgcgacacatttgatcaatggtttgtatgatgcacagatggaccatgtgcctctagtagcgttcttaggacaagttgcttctacatccatgaactataactctttccaggaactaaatgaaaatcctattttcgcagatgtcagcgtatacaatcgtacagtcatgacaccacaaagtcttccgcatgtagtagatgaagccattaaagccgcctatgagcataaaggcgtggctatcgtgactatctctgttgatcttggttttgaagaaattgacgaacaacctttctccaccgctcacactcacaaaacaagtgtgatattaccagaagaaaaagatttgctagctgctttgccttatcttgaaaaagcaaaaaaaccagttctttatgttggtcaaggaacgcgaaacggatttccgcaaatcaaagaattctcagaacatttttcagttcctgttgtcgcttccgttctagcaaaaggaattattcctgatgattatgaaaactttcttggttttgctggacgtgtcgctactaaacccggaaatgaagcattggcagaagccgatctgatcttatttgtcggtagcaacttcccatttggacgtgcattttttaatccaactgctgaatttatccaaatcgatatcgatgcgtcaaaatttggacgacgccatgaaacatctttgtcgatcctcggtgatgcaaacacagctttgcaaagacttgtcgagttaggggatgctcgccctgctgatagctggtacctagcaaatcaagaaaataaagaaaaatgggtaaattggttgaaatcttttgaagatcgagaggaagaaccgattcgtccagaggctgtctataaagaaatcaatcgtattgctgaagacgatgcgattttcgtcacagatgtcggtaacacgactatccattctattcgtttattgaatatgaacggtaaacaaaaacatacgacatctggatggttcgcaactatgggtaatggtgtgccaggaggaattgccgcacaactaagctacccagaaaaacaagtatttaccttaagtggtgatggcggatttgctatggtcatgcaagatatcattacacaagtcaaatatcagcttccaattattaatgttgtcttttcgaatgattcttttggtttcatcgaagcagaacaagaagatacggaacaaaagaaatttggtgtatttttagaagatgcagatttcggtaaagttggagaagcgctcggggcaaatagctttacagtcacagaatactcgcaacttcgatttgcctttgatgcagctgcaaaatcagatcgtcctgtagtaatcgatgtgaagatcaataacaagcgcccattgccagtagaagatctgcatttagatccaagaaaatattctgaagaagaaatccaagcattcaaagaaaaatatgaagtccatgatttgccagtattgaatgaattgtatgaaaagaggttgtgacaactgcgctatacttcgagtattaagatacaatttgtgtatatagcttctcacatttttgcataaatttgtctcgacacctaaaaatcacctcgtgcatatttgtccatgataaaaaagccagcttccaattacaacagtaaaactgtaatcggaagccggcttttttatttgtttgattttgcttatctaaatgcatagacgatatgtgtgataccaaataacataaaatagaatccaactaaaaagcttaatgtcaacgcagaagaaattggattaaacaataagaaaatacctaataaaattcctaaaatattgacgatgatcgtaaaccaataatatccttcacttactcctcttgccaagtcagcagtaaataacgctaaaacggaatcagcaataaaccatactgcaaaaacaaaaggcaatgctgcgactcctgcaccaatattgaataagaaaaagacgccaactagaatatcaatgatcccgattattaagggcatttttcctttatatcctgttagctcttttaatctattacgtacaaacagttcaaatatccctttaataaaggcaaaaatcgcaaagactactacaattgcaactaaatttccgacagggtcttgaaatgataacaatgagacaagtacaaataaaatccctaaaatcaatgagccccagtcggtagttcttttttcatccattttcaatccttctttcatttcttttacagttttatagtactccctcttataaataacgtcaaaaattatgctgttacaaactaataaatcctatagtagctattttcgctccgcttttatttttatttttttcattctgtttcacgtgaaacacaaagaatgttcgattgccttgaatcttttacctttcccctatataattctataagacttgtcaaaactaataatgataaaagtgaggaaaaaaattgattactgtaaatgatgtgagtttgcacttttcagaccgcaaactatttgatgatgtgaatattaaatttacccccggaaactgctatggcttgattggtgcaaatggtgcaggtaaatcaacgttccttaaagtgttatcaggggatctgcagccttccacaggttccgttactatgggaccagatgaacggatggccgtattgaaacagaaccattacgactatgaagactatactgtacttgaaacagtcatcatgggacacaagcgtctgtatgaagtgatgaaagaaaaagatgcgatttacatgaaagaggatttcactgacgaagatggtattcgagcagctgaattagaaggagaatttgctgagcttaatggatgggaagctgaaccagaagcagctgttttactgcaaggtctgaacatccctgaagaattgcaccatcagcaaatgagtgaattaactggtggacaaaaggtaaaagtgttattagcacaaacactatttggtaaacctgatgttcttttgctagacgaaccaacaaacggtctggatatccaatcgatcaattggctggaagaatttttgatcaattttgaaaatactgtgatcgttgtatcccatgaccgtcactttttgaacaaagtatgtacacatatggcggatctagattttggtaaaatcaaactttatgtaggaaattatgatttttggttggaatctagtcaactagcggctaaacttcaagcaaacgcaaatgccaaaaaagaagaacaaatcaaagaactccaagaatttattgcccgctttagtgcgaatgcatcaaaatcaaaacaagcaacttcacgtaaaaaaatgcttgaaaaaattactttagacgatatccaaccttcttctagacgttatccattcgttggattcaaacctgaacgtgagattggaaacgacttattgcaggtagaaaatgtaagtgtaacgattgatggaaagaaaattttagatgatatatcttttaatttgagcaaagaagacaaggtcgctttcatcgcagaaaatgatataacaataacaacgctattcaaagttatcatgggtgaaattacgccagatactggaacagtacgttggggtgtgacaacaagtaattcttatttaccaaaggatacaacgaaagaattcgatactgatctaacgattttagactggttgcgtcaatatgcaagtaaagaagaagatgataacacctttttaagaagcttcttaggaagaatgttgttttctggtgaagaagtattgaaaccagtgaatgttttatctggtggagagaaagtccgttgcatgctttcaaaaatgatgctttcgaaagctaacgtacttgtattagatgatccaacgaaccatttagacttagaatcaatcacagcattgaatgacggcttgatggcatttactggctcgatcctgtttgcctctcatgaccaccaatttatccaaacattggcaaaccgtatcattgctgtttcagataaaggtgtgattgatcgggcagatacgacatatgatgaattcttggaaaacacagatattcaaaaacaattgaacgagttatgggcgtaatggcctatttagcttaaaaaacaaaaaaacagcgacctctaagagataggatgctcatctatcttttaagagtcgctatttttgttacattcaaatcctgggcttttttacagaatgagttactgcttttatcgactgattcccatcgaaaaaatcgcgatacagccatagcctgtgtgactggcgatcgttggtcctaagggataaagcttcacatctttcatctttatctgctcttccaaaagccgttttgccttctccgcgctctctagatccccagcgtaagccacataaacgatttgatcaagtggcgcaacgattgtttttactgtctcattgacgattgtctggatcgacttgtttcttcctcgaactttgtcaacattcgtcagccttccttctttatccaccgtaataataggctttacactcaatagactgccaagagtagcacttgctttggaaatcctaccgcctcgttctagatatttcagatcgtctactgttacccatgaatggactttcaaataattactttccagccactctagggtttcttcgatgcttttaccttcttttttcaatcttacagcttccaatactaaaagcccttccccaatacttgcagcttttgtatcaaaaacatagatctcagggtcttcatattcttccttcagcaattcaaccgcttgaagcgcactactgtaagagccgcttaatccactggaaaaagccacatataaaacaggaatctgtttttccgcataagaacggaaaaattctaaatatcggccaacattgatttgtgatgtcgtaggcatcgcaccatttttcagctgattcatgtagcggtcataattgaatgtctttccgaggtcatctactaactcttgatcattcaattggagattcattgataaaaaatcaactttttcttttgctaatacatggtatggcagatcacaacaagaatctgttacaatttgatacacatttttcaaccccttctcgttacattttacccttatcgtctattatagcaaatctcttgcgctagacacactttaaccggtttattttcgcaagttctaatcaaaataagaggttgtgacagaagtggtcagcttcaagaaataagaaggaatttacgaaaattgcttctcaaatttttgtgaaatttcggcttatttccgtagaagctacttctggaacaccgtgaatcagaggttgtgaaatcagcgttttgacctgagtattagaaaaaaaacggaaaaaatagttcctcatattttgccgttttttgagctaataccgagggtcagctgattgaacaccgtttaccaagaggttgtgagcctgccgtttagctccgagtcacaaggaacaatttcaaaaaacagcttctcatgtttgttgaatattgtgacttgtgaccgaggagttggcaggagaacaccgtttagtggagaggttgtgaaaaagctgctctgcatcaagcagtaagaacaatcagataaaaatagcactccatatttttcatctgattgggcttagtgccgtagatgcaagcttttgaacaccgtttgttcggaaaaagggactgtgacacggtttttgtcacagtccctttttctgaataaacagtgttcaagagacagcctatcggtaataaggctaaacgtctctttcactacctcttcaagttattattatcgtatagataaacacttcgactcgctctggtaagaacgtcctgattcagtcgtcgtttttatccttagatttgcgcccagacgctttctaagatgtttgtttgtgttctatcaggtccgacagaaaatgttgagatacgtacaccaacaagctctgagatacgacgtacatagttacgtgcgttttctggcagttctgcaagtgttttgcatcctgtaatgtcttctgaccagcctggcaattcttcatagattggtttgcagcggttcaactctttcaagcttgctggatagtggtagattagttcgccatctaattcataagccgtacaaatttttactgtttccaatccacttaatacatcgatcgagtttaaagataggttggtaatacctgaaactcgtttagaatggcgcataactacagaatcaaaccagcctacacgacgcggacgaccagttgtcgtaccgtattctcgtcctacttcgcggatttgttctcctgtttcatcaaataattcagttggaaatggtccatcaccgacacgtgacgtataggctttgcagacgccgacaactttattgatttttgaaggccctacaccgcttccgattgttaccccaccggctactgggttagaagaagtaacaaaaggataagttccctggtcgatatccagcattacaccttgtgcgccttcaaacaacacgcgtttgcctgcatccaaggcatcattcaagataacggaagtatctgtgacgtattgtttgatttgttgtccgtattcataatattcttcaaaaatatcgtcaaaatcaagtggttctgaatcaaacatttttacaaattgacggtttttgtcatctagattcaaacgaagacgttcttcaaaaatttctttatctaataagtctgcaatacggatacctacacgagctgctttatccatataggcaggtccgattcctttaatcgttgtaccaatcttgttttcgcccttagcatcttcttgtaattggtccaatttgatatgataaggcaagattacgtgcgcgcggtcagaaatacgcaaattacttgtttctacacctttttcatgtaaataagctaattctttaaccaatgatttaggattgactacaacgccgtttccgatcacactgatcttgtctttataaaaaatcccagaaggaatcaaatgcagtttataagtcacaccgttaaacttaattgtgtgccctgcattgtcgccaccttggtaccgtgcaatcacttcagcattttcactgagaaagtctgtgatttttcctttcccttcatcgccccattgcgtacctactactactacagatgacatgtgaacacctcgttctatattatttaatcctgaaccattgtatcaataatagatacatatttcaaataaaatcgaatgatttttatttttattttataaaaacgcttaaaaaacgaactttatctttttagagtggttattaaaaaagaggttgtaacagaagtggtcagcttcaagaaataagaaggaatgtacgaaaattgcttctcaaatttttgtgaaatttcgacttatttttcgaagaagctacttttggaacaccgtgaatcagaggttgtgaaaaagctgtcctgcatcaagtaataagaacagccaaacaaaaatagcttctcatatttttcgtttgattgggcgtattaccgcagatgcaagctttggaacaccgtttaagaaagaggttgtgagcctgccgtttaactctgagtcacaaggagcaatttcaaaaaactgcttctcatgtttgatgatattgtgacttgtaaccgaggagttggcaggagaacaccgtttaaggaaaagaggtcgtaagatcagcgttttgacctgagtattagagaaacaaacgtcaaaatagttcctcatattttgacgtttgctgagctaataccaagggtcagctgattgaacaccgtttattcggaaaaagggactgtgacaagacttttgtcacaatccctttggagatctgttttaattaagtgctctagtcactcttgcagttactcgtcgcatcttatacgagtgctcttagtcattgtgcaaggctgaacgcctctttcacaacctcttctttaaaattcttctcttggcgaaagcgacgaaaacttattgtattctttgataaacagtagttcaactgttcctcgtgcaccgcttcggttcttctcgatgatgacttcgatgacgttgtcattttttggctcgtttccatcatcgtcatctccgccttctctttcataataatcatctcgatacaagaaggctacgatgtccgcatcttgttcaattgatccggattcacgaatatcacttagcactggtcgtttgtcttgtcgctgttctactccacgagataactgtgaaagagcaatgacaggtactttcagctctttcgccagttttttcagttggcgagagatatctgatacttcttgttgacggttctctttaccgttaccttcaatcaactgcaaataatcgatcaatatcaagcctagattgcctttttcttgcgctagtttccgacatttcgcacggatttcagagattttgatccctggtgtatcatcgataaaaatatttgctcgagaaagactccccatcgcaacgatcagattcgaccattcttcttccgaaagctgacctgtacgtaaatggctggcctcaatcgaaccttctgcacaaagcatccgatttacaagagattctgcccccatttccaaactgaatatcgcaacagaacgatctgtttttgttcctacattttgagcaatattcaatgcaaatgctgttttacctaccgctggacgtgcagcaagaatgattagttcttcgggctggaaacctgctgtcattttatccagaccttgatagccagttggtagacctgtgatttcttcattgttttgagctagtcgatcgatattttcaatcgtggagttcagtacttcagcaatagataaaaagccgcttcgatttcttttttccgaaacctccaagatactgcgttcggcatcatctaaaattgtttgaacttcttctccttgctcgaatcctttcgtaacgattcctgttgctgtctggatcaatgtacgcagcaatgatttttcttcaacgattttcgcatagtagacgatatttgctgctgtcggaactgctaatgccaagtctgagagataacttaaaccaccggcatcttctaacaaattggcttgttccagccggtctttgacagtaaccacgtcaatcgcttcattacgatcatttaactcgatcattgtctcaaaaataatttgatggccgcgacgataaaagtcttttggctctatgtactccatggcatcaatgatcgtttctgcgtcaagaaaaacagagcctaaaaccgcttgttcagcttcaatattttgcggtgggattcgatcctgccacacttcattcatacgtatcgctccttgtcttcaattgcttcattttacaagaaaatgagagaaaagtcatcattcgtaccgaaagtgtaataaaaaaatagttctcttttattatactcgttttctttatgctattttgctgttcccaaaaaagaaaccgaaatcaatctgaaatcgatttgcagcttttgctttcattgctgcagctgttttctcagataaatttcggtttgtcttttctccttctggttatacttaccagctgaacatcgctatcaagatttgttattcttgtacgacatgaactttgatcgtagccgtcacctcatgatgaagcttaacaggtacgtttgtgtagcctagtgaacgaatcggattttctaattcgatttttcgtttatctaatttgattttgtattgtttgtttaacccttcagcaatttgttttgaagggatcgaaccaaacaaacggctgtcttcccctgctttcgccttcaattcgactacagtatcttctttttccaagaattcttttaactttttagcttcttccaagatttcagcttcgtgtttttcttgcgctttcttttgtcctgctaactgactgatactgcttttcgttgcttcttttgccaagttatttttgattagataattttgtgcataacctgctggaacttctttgatgtccccttttttaccttttccttttacatcttgtaaaaaaattactttcatttggattactccttatcatatatttgattcatattttctttgattgcagcaaatagcttctgttttgtttcctcaactgtcgtattttccagttgagtagctgcgtttgtgaagtgtcctccgccacctaaggattccatgatgatttggacgttgatcgtgccggtacttctggcactgatcccaatcaagccgtctgtccgctttgtaatgacgaaagctgcattgatattgatcatcgaaagcaatgtatctgctgtttttgctgctataacactattatactctttttcgtctgtccctgccgccacaacaatatcagaagtcacatagtcgcttccagcaatcaaattgctgatctccaagtatgtcgctaaatccgagctcaataaatattgtactaaggatgcgtctgctccacaagaccttaaatagctggcaacgtcaaaagttcgtgcagttgtacggacattgaaactatttgtatctacaaccatccctgcaagcaataatgtggcctcaaaacgatctaagcgatttgttttgctgctttggtattggatcagctcagaaactagctctgaagctgaagaagctgaagattcaatataagtcagcagaggtttacttggaaactcttccccacgacgatggtgatcaatgatcacaatcttatcaaattgctcatataggccctgagagatcgatagagaaggtttatggtaatccaccatcacgaggaggtcctcttcttttttcagctctatggcacgttctggagagattagttgcatttctaattcaggatgcttatggatttcttcaagacaccgttctacatctggaatgatctcgttctcgttgataacgatgtaagcttttttctggttgaagcgtgccagacaactgacaccaaaagcagagcctaaagcatccatatccggaaacttgtgccccatgataaacacatcgcctgtttcatcaaaaatccgacgcaaagcggtactcatcgctcgagaacgaacacgcgtgcgtttgacattcttagcagatttccccccataataaacaggttttgctccttcttttacctctttcacgacaacttggtcgcctccacggactaaagcaacatctaaattattctgagcttctccaccgatttcatcgagggttcttgagccataagcaatccccatactaagggtgataggcgagctctgtttttcagcttctgctcgaaagcgatccagcaaatcaaattttttatccatcatctttttcagatcgatcatctgtgcgacgaagaaaaaccgttctgcgttgattcttttgaaaaagacatggtattcattcatccagtcagaaactagtgtagtgacgaaagagttcaaataagaaatctctttgtcatctaatttatcaatggcatctgcatagttatcaatagataaaataccaatcaccggctgactgttcgtctgatggagttttaacaactggttttgggtaatatcattaaaataaacaacaccctttactgtatccatatcaaactgaaatgttttatctgctagatagacttggtttttctttttttcttttgcagtaaaaaaagtatctagcaattcttcctctgttaatccactttgatctttgattttcaatgctaatggattgagccattcgattttttggcttgatggctgataagcaatcactcctacaggcatgacttctgagacataagctagattggtttcagctacagtcgaagcctgctggattttttcacgtttatttaaaataagccaacgtttcattttcaaccaatagcgaacaccccataaattcatcaatagaatgaccgaagcgctaacaaaacgaaatggtaaaattaagactaccaatacttcgattaatataaacaggataaggaagagaggtttcggggataaatgattgtttttattttccataattttcctcccatatatgactaatttgattttaccataactttcgtcattcgagcgactaaacgaatagagggtatttttacagaaaaaaaggaattgaatagctgatcaaaaggatcagtcattcaattcctaggatttattagtcttcgctaacgaaaggtagcaagcccatgatacgagcgcgtttgattgcaacagtaattttacgttggtttttagcgcctgtaccagttacacgacgtggcaagattttaccgcgttctgaaataaatctttttagtaattcgatatctttataatcgatatattcaatatggttagcagcaatgtagtctactttacgacgtttacgtccgcctcttctttgttgtgccattctatttccctcctatcaaattcgtttagaatggtaaatcatcgtctgaaatgtcgatcgttgaacttgagccgaatgggtcagaagtatcacggtcgaaatcaggcataccgttggatgattgagatgtttgattagagttattgtttccgccaaatccgccagctgattgaccagaactttggaatccgccgctttgttggcgattttcagatgcagaacgactttccagcaattggaagttgtcagctactacttctgtcacgtatacacgttgtccttgctgattatcataagaacgagtttggatacgtccagtaacacctaaaagtgttcctttacgagcatagtttgctaaagtttctgctgatttgcgccaaatcacacagttgataaaatcagcctcgcgattgccgctttggtttgtaaaattacgattcacagccaaagtaaatgttgcgactgccgtaccacttgctgtgtaacgcaaatctggatctttcgtcagacgtccaactaatacaacattattaatcaaaatagtcatctcctctcatcgttttctattgtttcacatgaaacaacaattaagcttcttctttaacaatcatgtgacgaatgatatcgtcgttgattttagcaagacggtcaaattcattgacagcatttgctgatgatggagaagatactttaacgatgtgatagataccttcacggtaaccgttcatttcataagcgaaacggcgtttttcccaatcttttgattcgataacttctgctccgttatctttcaagattgcatcgaaacgttcgattaaagcagtttttgcttcttcatcaatgtttggacgaataatgtacatgatttcatatttcgtgttttccattgatattcacctccctgtggactttcggctcttaggttcctaagagcaaggagagttatctaattaattagactactcacaagctctgattatacactctattttggtcaaaagcaatacagaatgaacagtttcgaatattttaagagaaattcaactaatcaaaaaagccagcaggaataaccgattaaaaaatctggttattcctgctggcttacacacttagtcttgatggttattcttctgatccttgttcttcaactgtttgttctgcagcttctggttcgactgctgccatcgtgacaactttcgtatcagcttccatcttcatcaaacgtacgcctaatgttgaacgtccagtttgagaaacagtcgatacgttgaaacggataatgacacctttatctgtaatcagcatgatgtcttcatctccagaaacagtggtcaatccagctagtggaccatttttttcagtgatgttcgccgttttgatccctttacctccgcggcctttcactggatattccgatacttttgtccgttttccgtaacctttttctgtgatcactaatacttcttgatcttccttcattaaggctgccccaacgacataatcttcctcacgcaggcgtattcctctgaccccggaagctgtacgtcccatatcgcggactgcttcttctttgaaagtgacagagtagccgttatgtgttccaataatgatattagattgaccatctgtcagtagcacattgacgagctcatcgtcttctttcaaaccaattgcgatcagaccattacttcggatgttagcaaaagcagtgacagaagtacgttttactgtaccttgacgcgtcgtaaagaagagatagtggccttcttctgcttctcccgtcaccgcaatgattgcctggatgctttcactcgaatcgatacctagtaaattgataattggtattcctttggctgtgcgcccgtattctggaatttcgtatccttttgcccgatacacttttccgttattcgtaaagaataacaatgtatcatgggtagagcaagaaaccagatttttgacgaagtcgtcattgtggatacccattccttggacaccacgtccaccccttcgttgagctctgaattcattatttgccaaacgtttgatgtaaccattgtttgtcaatgtaataacgatttcttcttcttcgattaaatcttcatcttccagacttaagacctcaccgactagtaattctgtgcgtcgtttatcaccaaatcgttgattcaagtctgctaattcattcttgatgatttctgtaacacgttctggtcttgccagaatgtcagttaaatcttcaatcagttttaagagttcttggtattcattttcgattttttcccgttccaaaccggtcaatcggcgtaaacgcatatctaaaatagcttgagactggcgatcggataaatcgaaccgttcgatcatcgtcgcttttgcttcgtcatctgatttagacccgcggataatcgcaatgatttcatcgatatgatccaaagcaatacgcaaaccttctaaaatgtgtgcccttgcttctgctttttctttttcaaagactgtccgtcttgtgatgacttcgcgctgatgttcgatatagttttcaagaatttgtttcaagctcaaaactttcggcacacctttttcgattgccaacatattgaatccaaatgaattttgcaaggatgtcaatttatataagttattcaagataacggatgcgctggcgtcacgacggatgtcaatgacgatccgcataccttcacgggaagattcgtcccgcaaatctgtgatcccttcgatacgcttgtctctgtgcagttcagaaatccgttcgatcaattttgctttattgaccatataaggcaattctgtcacgatgatccgttctttaccatttggcatctcagtaatctcaacttttgcacgtacggtaatagaacccttacctgtttcatacgctcttcggattcctgattttcccataaccaaaccacctgttggaaaatctggtccaggtaatacttccatcaattcattggtcgtcacatcaggattatccatcagcaaatcgatagccgctactacctcagacaagttatgaggtgggatattcgtggccatacctacggcgatccccgttgttccgttcactaaaagattcgggaagcgagcaggtagtacaactggttctttttctgtatcatcatagttgctttggaaatcaacagtgttcttattgatatcacgcagcatttctgtagcgattttactcatccgtgcttcggtataacgcatagcagcggcaccgtcaccgtcaacagaaccaaagtttccatgaccatccactagcatataacggtagctgaatggctgcgccatccgtaccattgactcatagatcgcactgtctccatgaggatggtatttacccatgacatctccgacgattctggcagattttttatgggctttatccggtgttacacctaattcgttcatgccgtataaaatacggcggtgaacgggtttcagaccatctctgacatcaggaagtgcacgtgcgacaataacactcatcgcataatcgatgaaggagtctttcatttcgctggttagattgacatcatggatgttttctctgatttcttcactcattctttttcctccttcatgattaaatatctaagttcttcacatagtgtgcattttcctcgatgaatgcacgacggggttctactcgatcccccatcaacatttcaaatatctgatctgctgcaatagcatcgtccacactgacgcgggccatcatccgattgcttgggtccatagttgtttcccatagttgatgatcatccatttctccaagtcctttataacgctgaacgcttggttttggtgaggcaggaagtgaagcaacgacttgtttcaactcttcttctgcattttttcctggttgtacatacgtaatattcttcccttgttttaccccgtataaaggtggctgagcaatatagacgtatccagcttcaacaataggacgcatgtaacgataaaaaagagtcagcagcaatgtacggatatgcgcgccgtcgacatcggcatcagtcatgataactaatttgtggtagcgagctttcgatacatcaaaatcttctccaaaccctgtacccatagcagtaaataaagaccggatctcttcatttgccaagatcttgtccatgcttgctttttcaacattcaagattttcccacgaataggcaagatggcttgaaactctcgattacgaccttgcttagctgatccgccggccgaatctccttcgacgatgaacaattcgcatttttcaggatcgttgctagagcagtccgctaattttcctggcagattactgatctctaaagcacctttacgtctcgttacttcacgcgcacgtttcgctgctagacgagctctggaagctagtaatcctttttcaacaatttgacggcccacacttgggttttccagcaagaatttcatgaaatgttcgctaaataaccgatcagtgactgtccgtacttcggaattgcccaattttgtttttgtttgtccttcgaattgagggtcaggatgcttgatagaaataacagctgtcaatccttctcgcacgtcttcaccggtcaagttgtcgtcattttctttcatcagcttttgttttcgggcataatcatttatcacacgagttaaagcagtcttgaatcctgattcatgtgttccgccttcatacgtatggatattgttggcaaaactcatgatattggaatggtagccgtctgtatattgcatagagacttcaactgcgatatcttgctgttcaccttccaaatatacaggttctggaaaaatcacggttttgtttgcattcaagtattcgacataacttttgatcccgccgtcataatggtattcattgatgactggttcttcttctcgtttgtcttcaatcgatatacgcatcccgcggttcaagaaagcaagttcacggatccgggtagccaattttgaaaaatcaaactcagttgtttctgtaaaaatttcagggtctggcgtaaagtgaaccgttgttccatggcgatccgtttgttcgataatctttaagtcgtccactacagctccacgacgatattcttgatagtacacatttccttctttgtatactttgacatcaagctgtgtagaaagcgcgttaacaacagaagatcctactccgtgaagtccaccagaaactttgtacccaccaccgccgaattttcctccagcatgtaaaacagtaaagaccgtttcaactgcaggacgtccagtttttgcctggatatctacaggtatcccccgaccgtcgtcaataacggtgatactgttgtctttttcaataatcacatggattttcgttgcaaaacctgctaatacttcatcgatcgaattatcgacaatttcccaaacaaggtgatgcagaccctcagaactagtcgaaccgatatacatgccaggtcgtttacgaacggcttcaagtccttcaagtacttgaatctgactggcatcatactctttagcgcgttctactaaacttctttcttctgtcattcagtttcttctccttttagtttcccttgttgaacataaaaaatctcaggttcaacagtcattttattttttacatggtcaagtgtcgttgttgttaagaacgtttgaacttttccttcgattgtttctagcagatggagttgacgattatcatccagctcgctcatcacatcatctaacaaaaggattggatattcccctgtctcttctttaatcaaatcgatttctgctaatttgacacttagtgcagttgttctttgctgtccttgcgatccataagtctgcacatttttctgattaataaaaaaggaaagatcgtcacgatgaggaccaactgtcgttgttccccgaaaaaggtctttctttttattttggttcaaaagtgcgagaaattgttcttggatttgctcttgcgtatgtgtttctaaagaatcgactgcggtgagatactcgatttccagctgctctttttgatgggtgatttgctgatgcaaagaattagcccaaaactccaatcgcttgacgaactgtgctcttgctttcaatactttgctgccaaacgctgctagttgttcggacaaaatatccaaataaagcaaatcagtttgttttttttcattcaattgctttaaatactggtttctttgtttcaaaattgcttggtattggacaagatcataaagatagattggattgatctggcctaattccatatctaaaaacttccgcctgatctgcgggctgccttttactaaagaaagatcttctggtgcaaataaaatgacattcatttgtcccacgtaagtacttaactttttctgttcgatatggttgatcttggtttttcggccttttttagataataagatttctaatggaagagtggatgaaccttttgtaatctctccttgaatcatcgcctgatcgtcagtccagccaatcaattcctgctcactacttgtccgatgacttcgcgtcatagctaatacgtagatactttccaaaagattcgtttttccttgcgcattttctcctaaaaagatgacgaggttcttggaaaattcgatgttcagctcttcgtaatttcgataattttttaaatacagcttattcagcctcattatcgtcgtttcctttttttaccataaaaaaagttcctacttctggaacttcaaccatcatgccgggataaagtttgcgtccacgacgattttctggttcgccatcgactaacacagtgttttctgccaaataccattttgcttgtccgccactaccgataactgtgacttctttcaacatttggcccaacgtcatgaattccgtatttagaatgacttgttgtttcaatgcccatccctcattttcattattaaaagtatactctattataccttttttttcgcaataaaacaaatttatccatatatttttccatataagacgatttaatctaaaaaaggtgatttaaacaaaaataaacagaaagccttaaaagagattttagggccttctgtttaaaattttattttttctatttcttttcaattaaattttcaagaacattgaaaatcattgttaatttgtacgtacaggagtaatcagctgaataaattgaacgccatcttccgtaggttccaatgtaaatggacgaatagcagagataaatttcactttgatgctcatatctccaaatgcacgcaacgctgctttcatataatccggattgaaagaaatatctaatggatcgccactgcttgctgtataactcaagctttcttctaccttcccgatttctggcgaatttccgtataaaacaaccgcatctggacgaatagataaacgaacgatgttgttacggccttcatgagaaagtaaagaagcccgttcgatcgccgctaaaaagctaggaacagaaaattcaacctctgtattaaaacttgaaggaatcaaacgattggtatcaggatagtttccttctagcaaacgggaatagaaatacatcgtttctgttttgaacaacacttggttttccataatgctgatttcgacgatttcttcttcatttgttaatgagcgagataattcgatcaaactttttccaggaataacaatatcaaaatgatcagccgcttgttctactggaattacgcgttgacttagacggtgagaatcagtagctacagccaataaagaattatcagataaaatgaaatgcacacctgtcaagattggacgactctcatgttgtgagacagcaaaaactgtttcgttgattagtttagtcaatacgtgtacaggtaatttcatctggttatggctttcgacaacaggaagatgaggatagttatctgcatctaatccatttacgataaaattcgcttttccagaagtgatcgctacttgtttattttctaaaacttctaaagtaaatgtttcttcaggaagtctccgaatgatttcgctaaagaaacgtgcttgtaaaacaatggaaccagtagattcgatttgcatatttgctttttcgttttcaacagacaaaaaagtttcaattgatatatcagcgttgctccccgtcaaagtcaaaccttcttgtgtcagtgtgatttttacacctgtcaaaatagggatcgtggttttgcttgaaatagctcgttgaacagtttgcaattcctgcataaagctagctcggtttaaagtaactttcatgatgtatctcctttgaatgtttgtttatttattattagttaaaaagaataataaaagtaatagggcatgttgattctgtggaaaactcaaaaaacgtaagagagaaacgaaaaaacagctgtggaaaaagtgtgtataacttttgaacgtttttttcttttatccacatgctattttcagttgatagaatcgacaaattaatttagtaaaaagtttttgatttctgatacttcattttgcatactgacactagaatccatcagctgctggattttttcatgagcatggataaccgttgtatgatccttgccaccgaattcagctccgattttcggtaaagaattatctgtgagctcacgtgccaaatacatagcgatttgtctaggaacaacaatagatttgacgcgtttctttcctttgagatctttcaattggatgtgataatactttgccacttcttcttggatctgcaggattgacaattgaggatgtccttttcctgattttaacgttttcagtgcgtctgcagctagactagtcgaaatatcttcactattcatcgcagcaaaagcttgcactcgaacaagcgcaccttctaattcacgaatgttagaatcaatttgtcctgcgatgtagcttagtgtgtcatctgggatctctagacgttcagccgccgcttttttacgtaaaatcgctgttcttgtttcaagatccggcggtgtaatatcaacagacagcccccatgcaaagcgagaaacaaggcgttcttgcagtttcggaatctcgtttggcaaccgatcactggttagtacgatttgtttcccttcattgtacaaggcattgaaagtatggaaaaactcttcttgcgtagcttctttttctgcaaaaaattgaatgtcatccactagcagtaaatcaacatttcgatattcttgacggaactcttctgctgttttgttttggatcgaattgatgaaatcattagcaaaagtttcactgcttacatattttactttggcattaggctgactttgcagcatttgatgaccaattgcatgcatcaagtgagtcttaccaagtcccacgcctccataaaagaagagcgggttataaatagaacctggatcttctgctacaacgagcgctgctgcatgagccatctggtttcctttaccaatgacaaacgtatcaaaggtatatttagggttcagcatggctttttttagcggactaggtgccacaacttttggatttttttcttctataacttcttcttgctctgcttcttcgccagtaataaagcgagggataatctcatttcctgataacatataaccgacttcaacgatttttgtcgccaggtttttttcccaatattctttatgaatcttgctaggaacctcaacaacgagctggttttgatcaagggttcgagggttcgctgtttcgatccatgtattatagctagcaggcgataaatccttttggtatgttgcttttaattcattccataaagcatcgagggataccatataaggcctcctccttcattaaaaagtgaataactagtactaatttagcatttttttcaatagttttccacagaaaccgaagaaaaaaattttttaattacaattatccacacaatcgacaaaaagaaaaaagagaaaaacacagttgtcaaaaaaagttttccacaccactaatgcacaggtggaaaactcgtaaaaaccaatagatttcctcttgcgtctgtggataaaaaatatagatataccaatagttaggagacggaatacacaggaaatcgcctgattgttgattactttttttacacgtgtgttttctgtgtaaaaccagctatttattatctgtggataatccctgtgcataactttttccacataggattcccatagaaaaaaataatcttgtggataagttttaacaatcgatcttctattttatattgacaaaatcactactttgtcgttatactatcaaagtatgtctgtgtttataaaatagataagaacattttggaggtggaatatatgaaaagaacataccaaccaaataaacgtaaacgtcaaaaagttcacggattccgtaaacgtatgagtactaaaaatggacgtcgtgtgttagctagccgtcgtcgcaaaggaagaaaagttctttcagcttaggccactggggtttcagtggttttttttatactcttttttagggaaatgatgaaaggacaatcgtaattatggtatgattatgagcgtaagtgagagatagaaaaggaaagaaaactaatgagaaaagcgtatcgagtaaaaaaagaacgagagtttcaagccgtgttccatacgggagattcttttgctaaccgcaaattcgtcgtttaccgtttggaaaaaccgggacagcctcattttcgagttggtttatctgtaggaaaaaaggtcggcaacgcggtaaaccgcaatgaagtcaaacgaaaaatccgagcagcagtttattctataaaagaagagattgatccggagttggattttattgtgattgctagaccaagtgtgaaggggttgacttatgatgaggttcgctccaatttagtccacgtcttaaaacttgcaaaaataatcgacagagaggaaaagagtaagtgaagaaatacaaacgtttacttttgatggccggtatcgttagtttggtcatcgtcttatccggttgcggaactggggaagtcagcgcacagagtacaggaatttgggatcgttatattgtttattactttgctgaggcgatcaaggcgttgtcatttggtaatgcagggatagggatcattttatttacactgatcatccgcgtgatcctattgccgttgatgcatttccaaacaaagagcatgcgtaaaacgcaagaattacaaccgaaattaaaagcattgcagcaacaatatagttcaagagacccggaaacacaaagtaagttaagagaagagcagcagcgtttatatgcagaaaatggcgtcaatccatatgctggttgtcttcctttattagtacaaatgccaatcttgatggcgttatggcaatctatttcacgtgtacctgagttgaaacaagggcatttcttatggttgaacttagggaacgcggatccaacatttattttgccgattttagcagcaatctttacttttgcaagtacgtatttatctagcatgagtcagattgaatcgaatgcatcaatgaagatcatgaatttcgtgatgcctgtaatgattttagtgatgggtgtcaatttagccagcggtctttcattatactgggtagtttccaatgccttccaagttgtacaaacgctgctgatcaacaaccctttcaaaattcgaaaagagcgtgaagaagaagcacggagaatccgcgaaagagaacgtgctcttaagaaagcaatgaatcctaagaaaaaacggaaataataggggaggtaatgctaatgccgatttatgaagctgcaacaatagacgaagctgtccaactaggtctggctgatttgggtttggccaaagaccaagtcgaaatcgaaatactggaagaaggaaaaaaaggtttcctaggaatgggtcgaaagaatgcacggctttcgatccagccaagtatcagcgaaaaagtttctgaaacagtagaacagactgtagaagaaattttggaagaagaaccaacagctgagatcgaggtagtcaacgaaacgattcttgaagaaaaaacagaagaagtaagtgagctaggtgatgaagcagctttaacggaattggcagtttatcttactgaaatttcaaaacagcttgatgctccagctcttgtcaaaatggaaagagaatcaaataatatggttgttttccatttagaaacacaaaagcaaggcatactgattgggaaacatggaaaaacactgaatgcattgcaatatctggcacaagtcttcatccatcgtttagcaagaaataagctgtctgtagtagtcaatgtaggcaattaccgtgaaaagcgccaagagatcattcagcgtttagctgatcgcacggctgaaaaagtaaaacggacagggcagccggttttcttagaaccaatgcctgcatttgaacgtaaacaaatccatgctgcattaagcaaagatgaacatgtaaaaacacattcggaaggtgaggaaccttatcgttatttagtagtagaacctgctaaaaaatattattgattccattactttttgaataaatcacgttgacaaagtttttcaaaccaagtatattttactagaaatcattcttatcagagtatacgatgaagtagtcactaactttgatagaaaaaagcggatcgaaactgtcttcagttttgatccgctttttttgtctgtttcatttaaccaatcgttgtttggataaattggatcactgttccataagcaaaaagttccagaaaatactttccgtcgcgttttttttgctgatactcaaaatgacagttgattactgcattcgcaccatattcaagtaccttcgtctttaatttcctcttcgttgttaagaaaaggtcatctttgggaaaagatgggtcaaacaaatcagcttctaagcattccacaacaaaaacgatatcgcggacgatatatttctggttgatattccctgtagataaaacgacatcgttgatccgagggtcactttcttcttccaatgcagcagatctgaacgggctcacatattttctcctttcaaaagtgtatagtttagatagcgctaccatttagtgtaccgttttttttaagaaagataaagccttgtttatacagtatcttctcttcgaataaaccaaagaacgcaaagagacatccaaggacaatcaaatataaggtaatggaagcagaacaggctcaacttcatctaacttgttttaaacacttgattccttatagcaagtgtgataatctatgaccagaatttaatcaagaacaagcagtcaaagtgcgaagttcaccgtttattgtgcataaagggtggagtgggcactttttttgtgcgcaaaatgaaaaaggaagtgaaaaaatggctgaaattactttagaatttgatacgattgcggcaatttctaccccacctggagaaggtgcaatcagtatcgttcgtttaagtggcgatcaagctgtgcaactagcagataaagtttatcaatctggaaacaaacgattatcagaagtaccaagtcatacgatccattatggacatatcgttgatcccaagagcaatcagcttgtcgatgaagtcatggtctccgtgatgagagcaccaaagacatttacgcgggaagatgtagtagaaatcaattgtcacggtgggatcgttgtagtcaatcaaattttgcagctattgttaagagaaggtgcaagattagctgagccaggcgaattcacaaaacgagcattcttgaatggtcgtgttgacctttcacaggcagaagctgtgatggatttgattcgggcaaaaacagacaaagcaatgggactagctcttaatcagttagacggcaatctgtctgctttgatccgctcattgagacaagagattttagagacattagcacaagtagaagtaaatattgattatccagaatatgatgatgtcgaagaattgactacgaagttattgcttgaaaaagcgcagatgatccaacaaagaatccaagcgctacttgctacatccaagcaagggaaggttctgcgggaagggttaagtacggcaatcatcggccggccaaatgtcggcaaatcaagtttgttaaaccatttgttaagagaagaaaaagcaatcgttacggatattgcaggaacgactcgagatgtaatcgaagagtatgtcaatgttcggggggtaccgctcaagctaatcgatacagctggaattcgggaaacagaagatgtggtggaacggatcggggtcgaaagaagccgaaaagcattagcagaagcagacttgatcttacttgttctaaaccaaagcgaaccactgacagcagaagatgaacaattattggaagcgacaagtggattgaaacggatcattcttctaaataaaacagatttgccagcacagctggaacaagaaaaattgaagaaattgatcgaaaatgaaccagttttttcaatttccgtagctaaaaacgacggactagatcgtttggaatcagctatttctgatttattcttcagtggagaaacaggagaaagagacgctacttatgtttctaatacccgccatatcgcgttgttagaaaaagcttccctctcacttgaagaagtcattgcaggtattgatgcaggaatgcctgtggatctcgttcaaatagatatgacgcgttgctgggactatctaggagaagttgtcggcgacagtgtacaagatgagctaatcactcaattattcagtcaattttgtttaggaaaataaaaggaggaacaaacgattggaacattatgaagcagatgcgtatgacgtgatcgttgttggcgcaggacacgccggttcagaagctgcacttgctgctgcacgtatgggatcaaaaacactattactgacaataaatttggacatggtagcattcatgccatgtaatccttctgtaggcggaccagctaaaggcgttgtcgttcgagaaatcgatgcgttaggcggagaaatgggtaagaatatcgataaaacctatatccaaatgcgtatgttgaacacaggaaaaggcccagctgtccgagcattgcgagcacaagcagacaaacatgcttattcaacagaaatgaaacatacgatcgaaaaagaaccaaatttgacgctaagacaaggaatcgtcgaagaactgatcgtcgaagatggtgtttgtcatggagtagtgacttccacaggagcgagctaccgggccaaagcagttgttattacagccggaacagcacttcgcggagaaatcattatcggtgaattgaaatattcatcaggtccgaataactctcaaccttctattggactagcgaatcatctaaaagaacttggctttgctatcgaacggttcaaaacaggaacaccgcctcgagtaaaatcaagtacgatcgactattctgttacagaagagcaacctggtgacaaagagccgaatcattttagcttcagcacaccagatagtgcctataaactagatcaggaatcttgctggctgacctatacaggtgagacgactcaccaaattattcgagacaacttacatcgtgccccaatgtttacagggatcgttgaaggggtaggcgctcgctattgcccatccatcgaagataagatcgtgcgttttgcagacaaaccacgtcatcaattatttttggaaccagaaggcttaaatacggaagaagtctatgttcaaggtttatctacttctttaccagaggatgttcaagtcaacatgcttcattctattgctggattagaaaaagtagaaatgatgcgtacaggatatgctatcgaatatgacgtagtagagccacaccagctccgtccgacattagaaactaaagtcgttgaaaatctttatacagctggacaaacaaatggtacaagcggttatgaagaagcggctggacaagggctgattgccggtatcaatgcagctttgaaagttcagggaaaagaacctttagtgatcaaacgaagtgacggttacatcggtgtcatgatcgatgatttggtaacaaaaggaacgaacgaaccttatcgtttgctgacttcacgtgctgaataccgtctgcttttacgtcatgataatgcagatttgcgattaacagaaatgggtcaccgtgtaggcttagtaaaagaagatcaatacaagaattatttgaagaaaaaagaagcagttgaacaagaaatcaaacgtttgatgaatgtacgaatcaaaccaacagaagaagtccaagactttttagcaacgattaatgcggcaccattaaaagatggtgtactagcaagcgactttttaagacgtcctgagattacttatgcagatcttctacggtttattccagaaaatgaagaattgacacgaaaagaaatcgaacaagtagaaatccaaatcaaatatgaaggctacatcaaaaaagccatggaaaaagtagaaaaattaaaacgcatggaagcgaaaaagattccagaaaacatcgactacgcagcaatcaacggattagcaacagaagcaaaacaaaaattgcagaaaatccaaccagaaacaattgcccaagctagccgaatcagtggcgtaaaccctgcagacctaagtatcctaatggtctatatcgaacaagggaagattgcgaaagtcagtgaaccagcgtaatacgtaataataaatagaagagagaactagtttttgcagaaattgctcaaagctagttctctcttctgtgtatattttatgagtcatactagaaagaaaaagtctatcggcttttcttacttttcaaatttttaagaatccatatggaaggattgcatgtctagagattttgcgttaaagtagggagagaatctgtgaaacaattgctgtttcacaatgaaaggaatatttatgataccagaagaatttcgccaatccttggcagaaaaagggatagagcttaccgatcatcaaatgaatcaattcgctatttattatcggacattagtcgaatggaacgaaaagatgaaccttacagctattacggatgaaaaagacgtatatctgaagcatttttacgattcacttacattagcatttgaagtagactttacgcagcctttatctttatgcgatgtcggttcgggggcagggtttcctagcatacctttaaaaattgcctttccagaactgcagataacgatcgttgattctctgaataaacgaataaccttcttatctgagttaacccgattattaggaatcgatgcttccttatatcatgaccgggcagaaacatttgggcaaaatcctcactttcgtgcatcatttgaccttgtcactgctcgtgcggttgctcgtttgaatgtgttagcggaattgtgtttgcccttggctaaacaagaaggctatttttatgcattgaaagcagcaaaaagtgaagaggaattgacagaagcaaaacaagcgattgctttattaggtggtaaattcctcaaagaagaggcggttaccttgccgaatgtctctgaccaacggcatatcatcgttattcaaaaaaagaaaccaaccccaaagaaatacccaagaaagcccggactgcctaataagcagccaatcaaataggaggagaagagatggcacaaataatatctgttgcgaaccaaaaaggtggcgtcggcaaaacaacgacgacggtgaatctaggtgcttgtcttgctagccttggtaaaaaagtattgctagtggatatggatgcacaaggaaatgctaccagtggtgtcgggatcagaaaacctgatgtgacaagagacatctatgatgttctagtcaatgaattgccaattgatgaggcaactttgatcactgaacacgaaaatttaagtattgtgcctgcgactctccaattagcaggagcagagatcgaattgacgtcaatgatggcaagagaatcaagattaaaaggatctttagcagaagtaagcagtcagtatgattatattttgatcgattgcccgccttctcttggccatctgacaatcaattcatttacagcaagtgattcgattttgatacctgttcagtgtgagtattacgcattggaaggattaagccaattactgaatacggttcgtttagtccaaaaacactttaatccagaattagagatcgagggagtcttactgacaatgtatgatgcacgaacaaatctgggaaatgaagtcgtagaagaagtacgtaaatacttccgcgaaaaagtttacgaaacgatcattccaagaaatattcgtttgtcagaagcacctagtcatggaaaaccgatcatcgactacgatccacgttctcgaggagctgaagtctaccaagcattggcaaaggaagtggtaagtcgtgaagaaaagtaaaggattaggccgaggaatcgatgcactgtttcaagatttagaaaacttagagacggtggatgtaaaagatgataccgttgtccagctaccattgaatgagctgcgaccaaatccgtatcagccccgtaaaacatttgaagaagtatctttacaggaactagctaattctattgaacaatcaggcgtctttcaacccatcatcgtacgccgttccgcagtaaaaggatatgagattattgcaggggagcgacgttttcgagcgtccaaactagctgaaaaagaaacgatccctgctatcgttagagactttgacgaagaagcgatgatgcaagtagcagtgctggaaaacttgcagcgagaagatctgaatccgttagaagaagcagaagcatatgagatgctgatgaaaaacctgaaactaacacaagcagaagtagctagtcgtttaggaaagagcagaccttatatcgccaattatttgcgcttgctttctttaccggatcttgtcaaggaaatggtacaagatcagcgtttatctatgggacaagcccgtacgctgttaggtttaaaaaataaaacattgatcttgaaattagccaatcgtgcagtaactgaaaatttaactgtccgccaactggaacagcttgtttctgagttaaatcaaaatgatggaaaagaaaagaaaaaaatcccaaggctagcaaaggaaaaaccatattatatccgagaaagcgaagatcgtttgatggataaatttggtacaagtgtagctatccaagaaaaaaacgggaaaggtaagatcgagatcgaatacctttctcaaaaagatttgacaaggattcttgatatattggatattcaatttgatgaagaataaacaaaaaggaggctatttttatgtacgacttgcacgatatcgttgaaatgaaaaaacctcacgcttgccagacgaatcgctgggaagtcattcgaatgggcgcagatatcaaaatcagatgtatgaattgcggacatatcgtcatgatgactcgccgagactttgaaaagaaattaaaaaaagtaattgaaaaaaatgcagagaaagagtgaataaatttatggcattgactgctggaattgttgggttgcccaacgtaggaaaatcaactttgtttaatgcgatcacaaaagcaggagcggaagcagcaaactatccctttgcaacgatcgaccctaacgtagggatggtagaagtacctgactggcgtttgcaacgcttaacagaacttgtacatccgaaaaaaactgttccgacgacttttgaatttacagatattgctggaatcgtaaaaggcgcaagtaaaggagaaggtttgggaaatcaattcttaagccatatccgccaagtagacgctatttgtcacgttgttcgctgttttgatgatgataatattactcacgtagaaggacgtgttgatccactagaagatattgatacgatcaacttggaactagtgttagcagacttagaatctatcaacaaacgctatactcgtgtagcaaaagttgctaaaaccaaagataaagatgcagtggcagaactagctgtactggataaaatcaaacctgtactggaagaaggaaaatctgcccgaacgatcgaatttactgaagaagaacaaaaaatcgttaaatcactatttttattgacgacaaaaccaattctttatgtagccaatgtctcagaagatgacgtagcagatgcagacgcgaatcattatgtacaagaagtgcgcaactttgctgcagaagaaaatgcagaagtgatcgtggtcagtgctcgtgcagaagaagaaatcgcagaattagatgaagaagacaaagcggaatttttagaagatttaggaatcgaagaatcaggtttggatcagttgatccgtgctgcttatgatttgttaggcttagctacttactttactgctggggaacaagaagtacgtgcttggacattcaaaaaaggaatcaaagcaccacaagcagcaggaatcatccattcagatttcgaacgcggatttatccgtgcagaaactgtctcttttgaagacttggatcattacggaaacatgcatgcagcaaaagaagctggacgtgttcgattagaaggaaaagattatgtcgtacaagacggcgacgtaatgttattccgctttaatgtgtaaaagggctatcaaactagctgtagaatatggtagaatgtcttttgtgacgaccgttgagaaaaggaacggctaaggaggactattagataatggaaccagaacaattacgagcaatcgtaaaagaaaacaatagtttagaaacaaaattaaccaaaagaaatcaacagtacatttttgatttgaaaaaatctttagaagcagcgaatttgtctgaagaagaaaaagtaaaagcccttcatgacattctgcctactttagttgcagaacaaaaaggcggaagaacagcccgtcaattgtttgggacagtctctgaaagaacggaagcaatcatcaataagccagcagaagtaaaaaattcatccacccctttattgatgtggttagataatacgttgctgttgcttggtctattaagtatcatgattgcgattaccggattgttttcacgtggaacaacgccagcttatggcttttctacactcgttctaggttctgcaatcggtggctgggtcttttatatgatgtacaaatacatctatcaatatgaatatcccggagcagatcgaagcaagaaaccaggaatgggtaagacattgcttatcctaggtggaacgacacttctttgggtcgtactgttttctgcgacaacactattgccgccagttatcaatccagtattagatccagtagtagttatcattatcggggcagctgctttagcaatccgttactacttgaagaaaaaatacgggattattggaagtttatccgtcccaagaagataaactagcaaaaagatcagctattttgctagatatctaggggtagtaaagaacctcattttgtttatccatagttaaataatagtaaggggctgtgacaaaagtcttgtcacagtccctttttacgataaacggtgttcaatcagctgaccctcggcattagctcaacaaacggcaaaccatgaggaactatttttccgtttttttctctaatactcaggtcaggacgctgatttcacaacctcttccttaaacggtgttcaaaagcttgcatctgcgataataagcccaaccaattcaaaaatatgaaaaactatttttgattggctgttcttattacttgatgcagggcagcgttttcacaacctctccactaaacggtgttcaaaagtttgcatctgcggtaataagcccaaccaattcaaaaatatgaaaaactatttttgattggctgttcttattacttgatgcagggcagcgttttcacaacctctccactaaacggtgttcaaaagcttgcatctgcggtaataagcccaaccaattcaaaaatatgaaaaactatttttgattggctgttcttattacttgatgcaagacagcttttttacaatctcttttaatatacacagatgtaaacgctttatattggtattctatgagaaagctaacttgattccaagtagatcattgacttaaatgaaaaaatcaattattttaatagataaactaaattagaggagtggtactaaaaatgtccaactgggaaacaaagttcacgaaaaaaggatttacttttgatgatgtcttattgataccagcagaaagtcacgtgttaccaaacgaagtggatatgagcgtacaattagctaaaaatattaagttgaatattccaatcatcagtgcaagtatggataccgttaccgacagcaagatggccattgctatggcaagacaaggcggactaggtgtgatccataaaaacatgacgatcagccagcaagcggatgaagtaagaaaagtcaaacgttctgaaagtggcgtaatcattgatccgttcttcttaacgccacagcatcttgtagcagacgcagaagaattgatgagcaaatatcgtatcagtggtgtgccaatcgttgaaacacttgaaaacagaaaattggtagggataattacaaaccgcgacatgcgttttgtaacagattatcacatgccgattgctgatgtgatgacaaaagacaacttagtgactgccccagtaggtacctctctaaaagatgcagaaaagattttgcaaaaacataaaatcgaaaaattaccaatcgtagataacgaaggtcgtttaagcggattgatcacgatcaaagacatcgagaaagtgatcgaatttccaaatgcagcaaaagatgaacatggtcgattgcttgtagcagcagccgttggtgtaacaagcgatacatttgagcgtgcgaatgctttattagaagcaggggcagatgcaatcatcatcgatacagctcatggacatagtgcaggtgtgatccgaaaaattcaagaaatccgttcaacttttgcagatgcaacattgattgcaggaaacgttgcgacggctgaagcgacaaaagctttatatgatgcaggtgtagatgtcgtaaaagttggtatcggaccaggatcgatttgtacgacacgtgtggtagccggtgtaggtgtacctcagctcacagctatttatgatgcagcatcagttgctcgtcaatatggcaaagcgattattgcagacggagggatcaagtattctggtgacatcgtcaaagcattagctgccggcggacatgcagtgatgctaggaagtatgttggcaggaacagatgaatcaccaggtgaattcgaaatcttccaaggacgtcgattcaaaacataccgaggtatgggctcattaggcgcaatggaaaaaggttcaaaagaccgttacttccaaggtagtgtcaatgaagcaaataaattagtaccagaaggaatcgaaggtcgggttgcttataaaggaagtgttgcagatattattttccaaatgatcggcggtttgcgttcaggaatgggttatgttggggcagctaatctacagcaattacgtgatgaagcgcaatttatccaaatgagcggcagtggattaaaagaatcacaccctcatgatgtacaaatcacaaaagaagcaccaaactattcagttgaatcttaaaaacattaaagagcgtgggacaaaagtaaagaacacttttgtctcacgctctaaacacgtataaacggcggaagtagaagcaactccttcggaaataagaagaaattcacaaaaatttgaaaagcaattttcgtgaatttcttcttatttcttggagttaaacgcttctgtcccagcctctttttgaataaacagtgttcccttgccacctccgaatcacaagtacaacattcataaaatatgaagagctgttttttgaatttgttccttgtaactcggagctggggggtaggcttacgacctctccactaaacggtgttcaatcagctgaccctcggtattagttcaacaaacggtaaaatatgagggactatttttccgtttttttctctaatactcaggtcaggacgctgatttcacaacctctcgataaatggtgttcaatcaactaaccctcggtattagctcaaaaaacggcaaaatatgaggagctattttttcatttttttctctaatactcaggttaattcgctgatttcacaacctctcgataaatggtgttcaaaagccagtttctcggtattaagtccaatttatgcaaaaatgtggaaagccattttcacaaaatttttcttaatactcgaaactgagcggctttttcacagcctctttatttaataactttcagattccccatataaggaacgagcgcttctggaactgtgacagaaccatcttcattttggtaattttccaaaatggcagctactgtacggccaactgcaagtcctgaaccattcagagtatgagcatagtggatttttccatcattatcgcgataacggatcattgcgcggcgtgcttggaaatcttcacagttagaacaagaactgatttcacgataagtatcttgtgcaggtatccatacttctaagtcataagttttagctgcagaaaagcccatgtctccagttgataaggccatcacacgataaggcaaatgcaattttttcaagatatcttctgcatcagctgtcattttttccaattcttcgtaagaatgctctgcatccgaaaatttgaccatttctactttattgaattggtgaagccgaatcagtcctcgtgtatcccgaccagcacttccggcttcagaacgaaaagcagggcttagtgcagtgaaataaataggtaaatctgcaccatctaaaatttcatcattataatagttagttaatggtacttcagctgttgggattaacgttagatcagtattctccaattggaaaacatcttctttgaattttggaaattgtcccgtaccaaacatcgctttactgttgacgatataaggagtgatcatttcagtatagccgtgttcgtaaatatgctgatcaagcatgaagttgtagactgcacgttctaatcgagcacctaatcctttgtaatagacaaaacggctaccggctacttttgcgccacgttcaaaatctaaaatatcaagattttctgcaatttcccagtgtggttttggttcaaaagcaaatgtacgtggttcgctccaacgacggatttctacattgtcctcttcatctgttccaactggcacagaatcatggggaaggtttggcaaagtagttgcaatttgtttcaatttttcatccacttcagcaatttcagtatccaatgctttgatgttgccaccgacttctttcatttcagcgattttagcagaagcatcttcttttgcacgcttcaattgggcgatctcagcagaaacatcatttcgatatttttttaattcttcacttttgactagtagcttacgacgattttcatctagttccatgaattcagctaatgtttctttttttacgccccgagtcatcaatttttcttgtacttcttcaatattttgtcgcatcatttttacatctaacatatgatttcctcctttttgaaaataaaaaaagactgatccatcccattattcttgggacgaatcagtctgaaattcgcggtaccacccaagttcagcgtcagctgcacttgttgaacacataacggctgttgaaccgacctttcttatttcgaaagggcacgtaaacgaactggaacttccaaattatcctttgctgatttacacctgccatcagctctctgaaaaagaataaagtgtactgggttctgtgtttttcatttattctaataattgtaataagaatagcgaatatttcagctttcgtcaataacttcctgtgtatcaataggtaatttttcatttttcttgattggaaggtgcatgatgaaagaagtccattgcttatctgattttgcataaatgtatccgccgtgcaaagccacaatgctttgagcgattgctaaaccaagtccagttcctccagttgcttgtgaacgagattcttctacacgataaaaacggtcgaatagattatcgattgcctgttgtgggatcattgctccattatttttgactgttgcaacaacttctgaaccgatacgttctacttcgattacgatcttcgttgctccttttccgtatttcaacgcattcgtcaaaagattattgaagacacgtacaagtttttcggtatcgccatccatgataagggagtctacttttgattgaacaagtatttggatattttttttagaagcttccaactcaaaatcagctgctaactgttcgatcaactggatcatgtcaaaggcagaaaaattcaccgggacagcaggctggcgtaccttagtgtattcaaataagtcgtccactaaagatttcatctgctttgctttgatataagcagtatgcgtatactttaaaagatcttcttctgagtgatactggccatcttctatcagtcctaggtatccaatgatggacgtgagtggggtacggatatcatgactgacattcgtgatcaattcatcttttgatttttcgattttacgttcgtcttcaatcgctgctacggtactatccaccaatccattgatacttgttaccactcggcttaagtcaccactcagttcaaaagggatacgatgatcataatttccgtttgcgatgtagtgaagttcgctgatgatatgccgcaattgcatttggcgatatcttcgaatcaagcgccaatacaaaacaccaatatctaatagaaagaaaaagggaataataaaattccggccgttccagaacaaatcagtgttcaatcgttctgcaaaaatattctttgaatcccaaatcgcattcgtcaaagaaggtgaactgttgatcaccgaactgataacaaccagaatagaaacatttaatagaagcaaaaggataatcgtgatgattccttccgctaacaattcgctgatttcttttgaagtcaaattgatccgacggcgtttttcagttgctcgtttactatcttgcgtcaattttatagcccactccccaaacggtttgaatgactttttcaccaccagttgcttcttcaatcttatctcttaaatgactaacgtgaaccatgacagttttagcagagacaatactttcttgtttccaaacacgctcaaaaatttcatccgcgctaaatactcgattaggatgactagcaagcaagtagaggataccgaattccaaagctgttaactggatttctttcccatcgattgttttaacttcatgagagtctttattgatgattaatgcatttacttctaatacatcaggctgatctggggcaatctgcatttttgtacgccgtaataaagactttactctagccattacttctaacggattaaatggcttggtcacataatcatctgcaccagcgaccagtcctttgatcttatccatatcagtagtttttgctgtcagcataatgattggtatttgggattcttttcgtagctctttcactacttgcatcccatccatctcaggcatcatgatatccaagataagtaattcaatatcgggaattgttctaatcttagataatgcttccttcccgtcataagcctttactgcttcatacccctcattgtgaacatagatacttaataattcaacgatttctttatcatcgtcagcaatcaaaattttcataaataaatcctccagagtcatattgttactattattctagcaaaaaaaagcagaaatagataaaagcagcactttgttaaggaaaattttagaaggtgagacatctagttggtgtgaataagacaagaacatgaacattaaactgaaaacaaaaggattttacgtctctcggagttataaagacgaacgaaaaaggaccagaactaaccaatgatcatgtaagctagaaatgttgataaataagcattttcttattgactttcacatgtgatgttgatatattattatttgttcaaaagaacaccaataacttattaaataataaaaaataagttgttgacatgttggaaatgacaaagtttttttgcgaaaactatttttatatcatatatatgtctaaaatctatattataaaagaaatgttgtttgatcagcttctcttcggtattagttcaaaacaaaacggcaaagtatatggagctactttgccgttttgtttctctaatactcaggtcagtttatagacgctcaataaacggtgttcaaaagtcagtttctcggtattaagtcaaatttatgcaaaaatgtgagaagccatttttcaaaattactttttattgctcaaggctgaacgtctctttcacaacctcttttatcaatctgctacttcttctttcttagcgaaactccaaatcagtccgataacaaaaccgataactgctggtacgatccaccccatccccaatttgaaaaacggcaagtagctttccgcaacatgtaaaagattttgaacaataggtgtttgtttgatagtttctgggcaagcgttcaacccatcaaaaatcgaagcaatcaatgtaaaataagtagtcattcgataaacagccgtacgctgcttaaacaaaggaccaactaacactagtaaaatcagtgtcattgctaatggatagatgaacatcaaaacaggcaacgaaaattgaatgatattcgtcaagcctacgtttgccgctaaacaaggaaggatactagcaagtgcaacaaagaatgcgtaatttctttgcggaaacaaatctgtgaatgtttctgcaaaagctgtaatcaaaccaataccggtcttcaagcaagctaatataacgataaatgctaataagatactgccataagtacctaaataatgatcagcaatctgagccagcgtgatcccgccattttcacttagagcaaagctacctaagctcatagcacctaaataagcgagcaaagtataaatgattcccatcaatataatgctgatcgcaccagatttgatcgtgtctttagcgatttcagcaggttttgttacacccatgttttggattgttgtgacaatgatgatcccaaatgctaaagcagcaagcgcatctaatgtgttatatccttgagtaaaccctgtgaaaaaagcatgctcttggtaatttggctgaataggcgcttgatttacagaacctagtggattcaaaaaagcaaggagaagcaaagcacctaataaaaccaaaaatgcaggattcaggaactttccaacataatctaatatctttgtcggttttcttgaaaaccaccaagccagcacaaaaaatacaatactgaaaattgctagatatagcgtctgtctgctaggatcgataaatggtgctaaaccaatctcgaaagatgtggttgcaaggcgaggtaaagcaaaaaacggtccgataactaagtaaagcaagatggtaaaaaccatcgcatatgtttgatttatccgttttgctaattcatatacacctgagcttttcgatacaccaatggcaatcacccctaagaagggaagaccgataccggtaaccaagaaacctagattcgcccaaaaggtagcagcgcctgcttcttgacccaaatgaacgggaaagataagatttccagcaccaaaaaatagaccgaaaagcatggagcctataaaaagatagtctttaaatgataatttttttgtcatacataactcctttacggtttttttaaaagtaacaaaatttcgaaaaatatgcaacaattttcagaaaatttcctatataaaacgatggttatttaataacgtaagtgataaaataaaagcgctgaatcatctgaggaggaatcatcgtgacaaagtcgagattagaagcatttactgatggagtggtagccattgttttgacagttcttgtattagagatcaagatccctaatccatctagctttcattctttatgggtcatccgaaatacattattagcttataccatcagctttatatttgttgcggtgatctgggtgaaccatcatcgtatatttcagatggcagaacgaattaattaccgagtggtctggtcgaatatcttttggctcttctggctgactttatgtccttctgttactagttgggtcgggcgtaaccctgaagctttttggcctgagatggcttatgtcttagtatacacgatgtggagtttttcttttggtatcttgatgaggcaaatcatgaaagcaaataaaccagattcccatgtcgtgagagttttgtcaaaggaccgtcgaagtcttatctccatgatgattaacttatgcttgattgccggtgtcttttttgtaccgttgatcgggttattcggacgtttttttgtatctggtatttggattttttcctataaaaaagcagatgcctattatcagcggttgtttccggggaaatagaaaagaggctgggacagaagcttttaactccaagaaataagccgaaatttcacaaaaatttaagaagcaattttcgtaaattccttcttatttctcgaagctgaccacttctgtcacaactactttcttacttcttacgttcatatttcatatgatagatcagtaatagaagcaagaaccacacaggtgttagtaataaagcgattctcgtatcttttcctaggaacaagacgacacacacaaaggccatgtaaagaaataccagataattactaaatgggtacaacggcattttaaatgaatgagcttttttgccgaggatacttttacgatatttcatgtgcgtgtagacaagcatactccagataaacaagaaacaagtagtggcaatactgcttactagtgtgaatacttcactaggcatcacgtaattcaagataacagaaatgaaaatgacgatagtagaaaatgtcaaagcattccctggcacatgatgtgttgttaactttttgaattttttaggggcactgccttcttgcgctaaagaacgaagcatacgtcctgtactatatattgcactgttgcaggcagaagctgctgcacttaatacgactaaattgatcaaggaagcagcaatcgtgatcccaatttccgaaaatacttctacaaatggactgttatctggattcaagctgttccatggatagattgccataatgacaaaaagagatcctaagtaaaataagatgatcctgataggaatattattgatagcttccggcaacactttttcaggattttctgtttctccagcgactaatccaactaattctatcccagcaaaagcaaaggttaccatttggaaagctaagataaatccttttgcaccagttggaaagaatccgccatgagaccatagattcgtgatactggctgtgccaatatctgtcgtatagtgggtgaggatcatataagctcctacgaggataaaggcaatgatcgctacaactttgatcaatgcaaaccaaaactctaactcaccaaacaatgagacagccaccatattcaagcaaagaagaagacctaatgcaatcagttcaggaagccactgaggaacaccaggcgcccagtagcgtacatacattccgatggctgttaaatcggccattgcaattgatacccagcagaaccaatacgtccagccagtgatgaaagccgcttttttgccaagatattctgcaacaaaatccagaaaagaatggttattggtgtttgataacagaagttcgcctaacgcacgcataatgaaaaaacagatgcatccagtaataagataggcgagcaatatcgaagggccagctagctggatagactttccggaacctaaaaacaaccccgttccaatcgctccgccaatagaaatcagttggacatgtctatttttcagtccacgctgcagttcttgctcttcattcatttttaaatcatcctaactaaaaaagtttaattacttccatattaagatagttttctgaaaaacacaactaagattccaaaattttcagaaatttaccttttatgagtaattcataaaaaagaactgcggtaaacaccgcagctccctgtctcgatcagctattgatcctaagcatttaaaatacgtgaaaggaattcttttgtacgttcttctttcggatggacaaagatatcttctggtgtaccttcttctgcaatcacacctttatccataaaaatgacacggtcagatacatcttttgcaaattccatctcatgcgtcacgataagcattgtcaagccagtatgtgctaagtctttgatcgtattaagcacttcgccaaccatttcagggtctaacgccgaagtaggttcgtcgaatagcaatacatctggattcattgataatgcccgagcaattgcgacacgctgtttctgtccaccagataattgtgctggtttggcttcgatataacgatccataccaactttttccagattttcgattgctacttttttggcagtttctttatctcgtttcaggacagttgtttgaccagacatacagttttccaagacgttcatattgttgaacaggttgaaggattggaaaaccatacctagattcgttcgatatttaggtaaattatatttaggagctaatacattttctccattataaatgatctcgccgcctgttggtttttccagtaaattgatacagcgcaagaaagtagatttaccagaaccggaagaaccgatgatcgtcacaacttcacctttattgactgttacgctgatatctttcaatacttcattttcaccgaagctttttcttagatgattgatttcaataattttttcattcatgattctttctccttattcctgcaaatttgaattgtcgatttcttcaagcttggtataagctgaaggtccatcgattttcttttctaccgcccgcaggattctggtgatcgtaaaggtcatgactaagtagatgattccgacgatcgtaaatgtttggaagaattggaaattcgcaccggaagcagagttcccttggaagaacaagtcagctacgccgattacacttaaaacggctgtatctttgatattgataacaaattcattccccgttgccggcaagatattccgtaaaacttgtggaataacaacttttctcatcgtttggccatgggtcataccaatggcttgcgcagcttcgaactgtccttcatctactgcaaaaattcccccacggacgatctctgtcatgtaagctccagtattgagagagacaataaacaaagcggcaatcgttcggttcaatgaaatgccaaaagcgagtgccagaccgtagaagatgaccattgcttgtaccatcatcggtgttccgcggaatacttcgacatagatagaaagaagtgcatttccgattttttggaagaagcgagtcagtgcatttcctgattcaggtaccgaacggaagacaccaatcagtaatccaagtgtagtaccgacaactgtcccgatcaatgcgatgaacaaggtaagtccagcacctcgtaagaacatattgccgtattgtttccaaatcgtagtgaaatcagaaatgatgccaggtttttcttcactatcagttgcagcaggctgatctttgactgcttggtccataattttggttcgttcatcgttagagatgccagaaagaatctggtttactttttggatatccgggtcgcctttacgcataccaacagaaatctgaacatcttccgggtttgtctggaagccatctgcaccgctgaattcaagcatttccaagtctttgttcacactagttgccgttacaccttccggacgttcgctgacataaccatcgatcattccagaagctaaagctgttctcattgctgagaaattatccattgcttgttgtttctgcacatctggtatctgatcgatcacagtatagtggaatgtatttaactgagcagtgatctttgctccagaaagatctgctaaactttttgcttttgcatatttgctatctttttgaactactactactaattgtgattcgtaataaggatcggtaaaatcaatttcttttcgtcgttcagcagtagggctcattccggcgatgatcgcgtcgatcttgcctgattgaagggcaggagccagaccatcccatttcgtttggacgatgactaattttttccctaaaccatctgctacttttttagcgatttgaacatcataaccgccggcgtaactattttggccttgaattggcaaggcattattctcatctgtttgttgagaccagttgaagggtgcatacccagcctccatacctacgcgaaactcatcgctcggtgttttttcatctgcatttgccagagatcccacactgaatagtgagaagacaaaagcaaatagtacggcaactgaaaccatattttttttcatttttttctccctttctgattatatgatacacgagcggtctagatgaaatgcggtaaagctttatctgaaaaaataaaaagcgaccgatttatagatataaaaaggccgctaaaattccataaggtgataaacctctcacaaaacatagcgcaacttagcatcactgctaagacagtccgcaagctcttaacttgcgtcccaacatacactccaagcaaaaaagtgcacatttcggcgatcctccctattcctgcttctccatgtttgcttcactccacagggttaatgattctcgcgacctctacctcattgattgaggcatctcgtattcagttatttatacaaaaaaagtttacgatactcgagaggctttgtcaatctataactgctgttttttgaaaaaatactgataaatatagaaatctttacttttaccgaaaaaacaatcaaaatgtgaatcatctatctattgcaaacgatagtataattatacacaaaaatgtatgtaatacaataaaaaaagaactagaacagaaaatttcctgtgtccagttccatctcgaccatttaagctgccgctttctttggctcacgtcctaggatcgcttgcaaaagaacaacgacgccataaatggctaatattagataaatcaaacttgagtattgggtgattccccagccccatgttcgatatacggctaatgtaatggctaaaacaattgcggcaatcacgttgaataaagcaaaagcccaaagatttccattttctttgcgtacaagataaaaaacagagaaataaacgcttaacgctaaccaggcgatacaagccagaataacgccccaataaataaagaatggtaacatatcgattcacctcacttttatacagcagtattgtaacacgttttcattcttttgtcagtgaacattgtgataaattgcttaaatgcccataacacttttttattcccatttttctgacttttcaacaataaatttgttcgagtatgggctataatggaaagtgaggtgacaaaacatgaaacaattaacagtagacgaagcagcaaaagagatattagcttatcagcaaattacatttttgaccggtgcaggggtatccacaccttctggagtgccagactatcgatctttgtcaggaatctaccacgggatggagcagccggaatacttgctgagtcatcaagcaatggtgaatgaaccggataaattctatcaatttgtcaaaaagatttatcatcctgaagcaaaacccaatatcattcatttggaaatagcacatctagcgaaagaaaaaaatgtttgggttgtttcccaaaacatcgacggtttgcacgcaaaggctaaaagcccgcaactcgtcaattttcatgggagtctgtatcaatgtcattgtcgaaaatgtcaacaaacggtagactggaaagaatatcttcacagcgacaaacatcaagcatgcggaggacaaatacgcccagacatcgtgttatatggtgaagggtttcaagatggagtcatggagcaggcggcttatgccgtcagccaagcagaactgatcgtcattgttggaacgagttttcaagttcatccgttttgtgatctggtacaatttcgccagccgtcagccaaaatcttagtaatcaatcaaacgcctgtttatttagcggagccttatacgtttattcaagaagacggagcggttgttttcaaaaaaatacaagaattaggagcagattatgactgaattcaaaaccgaaaaagaaaaaatgattgcaggcgagctttattttgccaatgatcctgagctggttgccgaccgtatgtttgcaagaagtcaaagccaaatcatcaaccaagcagaatcagcggaactgcgatcccaattgttgaaagagacttttggccgtacagggaaaaaaatctatatggagccagttatcaattttgattacggatataatatatttgttggggagaatttttatgcaaatttcaattgtacatttttagatgtcagcacgattgaaatcggtgataactgcatgttcgctccgaatgtccagctttacacggcgacgcatccactacatccagtgaaacgtaacagcggtctggagtacgcaaaacccattaaaatcggtaataatgtttggttaggcggaggagttatcgtcacgccgggtgtcactctaggggacaacgtagtagtcggcgcaggttcggttgtgaccaaatcttttcccgacaatgtagtgattgcaggaaatcctgctcgtatcatcaagacagtagaggaagaactaacagaagagtctcttgaaacattacgtcataagatcgatatgatcgatcgagagttggttgctttattagaaaaaagaatggatacggtaactaaaataggacaagtgaaaaaagaagaaaaccaagcagtttatgatgcaaaaagagagcagcaagtattggataaagttgttagtcttctgaaaaataagagatataaggaaacaataacagacacgtatgttgatttgatgaaacactcgcgcgaataccaaaacaaaatgaaggaggaataagtgtgatcgaaggagagacacggcgaaaacaaatcatgcaaaccttggcaaatacagaaaaaccagtgagtgctagcaagtttgcgaaaacttttggagtcagccgtcagatcattgtaggcgatattgctttactacgagctgcaggtaaaagtatcgtggcaacagcaagaggttatatcctcgaaacagaagaaaccaatactgggcacatcagtaaaatcgctgtccagcatggaaaagatcaaacagaagaagaactgagactaatcgttgaaaatggtggtgaaatcattgatgtaattgtggaacatcccctttacggtgagttagcaggaactttgcacatcaaaacgccacaagatatcgattcctttatgagacgttatcaaaaaagtaatgctactttgttatccgaattaacaggcggcatccatctgcatacgatccgctacccagaaaagcatatgctgaaaaacatcaaacaaaaactagctgaagcaggaatcctctacgaaggataacatcgtagctgctactttttatcctagaaactattctatcatctctgagataaacacccatatggaagaaataagaaaaaataagaaaagatgcgtatccaatacacagaattttttggaattgcgatttctagatgtctatctaaatttcgattagtggagaaacataaaaaagggaagtgcagcttttgagcactccccttttttataaagctttcttgtagcatagtatcgaaggaacctgccaattctctactcgattaccaatacgccttcttttagtgcaaatggattttgatcgttgatgtggtcatagaacatcacaccgttgatatggtcgatttcatgttgaacgacgattgattcataattcttcaaacgaatcttgtgtttttcaccattcatatcataataagacacagtgattttggcatggcgaacaacatatcctggtacttctcgatcaacagataaacagccttcaccttcccctaaacaagcatcttgaacagaatggctcaaaattttaggattatacataacagtacttagagaaggtccatctgcctctgggtcaggacttggtacgtgaacagcaatgattcttttagaaatatctaattgaggagcagctaagccaacaccgcctcgtaagtgtagttcttcagctttgattggatcttggctgttttttaagaactcaagcatctcttttcctaaagagatatcttcttcgcttaatggaagagaaacttcttttgcaacttcgcgtaaggtcggatttccttcacgaatgatatcatccattgtaatcatggaatatgtacccctttcttaaaagactgtgtttcaagtctattttcgcattatagtttaccacaaaaatggaaaagtagtagtaagattgtttgaaaactaccttttcttaatgattaactacttgattttcaacccggtttcaggtaaagtatagctgtgtgctctaggcacatgacctgccacttggttaagcgaatcaccaacgttttactcagtcgcaggggaataatcgaaagaggtgaaagaaatggcaatttcaaaagaacgcaagaatgaaatcatcaacgaatacgctcgccatgaaggggatactggttctccagaagtacaaatcgctgtattaactgaagaaatcaaccacttgaatgaacatgcacgcgtgcacaaaaaagaccatcattcataccgcggcctaatgaaaaaagttggtcaccgccgtaacttgttagcttacttacgtaaaactgacgttcaacgttaccgcgaattgatcaaacgtttaggcttgcgtcgttaattttagtcaaaaagagtgggattcacatgaatctcactttttttactcgtatatcaattaagtaaaattccgtgatcaagctagatggactcctactaaccaaatgaaagctgctcaaaagacggctttcggcagttttcatttgtttagtagcgtcttgctttcacgagaaggaaaaggagaagttatgtcagaaaaacaagtattcaaaacgacatggggcggccgtcccttacaaatcgaagtcggtcagctagcaaaacaagcaaacggagccgttttagtccggtatggagatacagtagtcttaagtgcagctgtggcctctaaagaagcaaaagatacagactttttcccattaacgatcaattatgaagaaaaaatgtatgcagcagggaaaatccctggaggtttcatcaaacgagaaggccgtccaagtacggaagcaacattgactgcccgtttgatcgaccgtccaattcgcccgatgtttgcagaaggcttccgtaatgaagtccaagtaacgaacatcgtgatgagtgtagaaacagactgctcgccagctatggcagcaatgctaggttcttctttagcactatcaatctcagatatcccatttgacggcccaatcgcaggcgtagaagttggtcgtgtaaatggcgagtacgtcttgaatccaacagtagaacaagcagaacaaacagatatcgaattgactgttgccggaacgaaacaagccatcaatatggttgaaagcggcgcgaaagaagtttcagaagaagacatgcttggtgcattgctgtttggttttgacgctatcaaagagttagttgctttccaagaagaaatcgttcaagcagtagggaaagaaaaaatggaagtgactttactgcaagttgatgaagtattgaaaaaagaaatctttgatgcttcttacgctacaatgaaagcagcagtaatgactgaagaaaaacttgctcgcgaagataatatcgagcaagtgaagatcgatatccgcgaagcttatgctgagaaatttgcaggtcatgaagatgaagatcacttgttgaaagaagttaaacaaatcacagaagatcttgaaaaagatgtcgtacgtgaattgatcaccatcgataagatccgacctgacgggcgtaaattggatgaaatccgtccattgtcatcagaggtcagcttattgccacgtgtacatggatcaggtttgttcacacgaggacaaacacaagctttatcagcttgtacactcgcacctctaggagagcaccaaatcattgatggtttaggggtggaagtcagcaaacgattcatccaccactacaatttccctcaattttctgttggttctacaggacgtgcaggttctccagggcgtcgggaaatcggacatggcgcattaggtgaacgtgcgttagcacaagtaatcccttcagaagaagaatttccttatacgatccgtttagtagcagaagtattggaatcaaatggttcttcttcccaagcaagtatctgtgctggcacattagcattgatggatgcaggtgtaccaatcaaagcaccagtcgccggtattgcgatgggacttgtttctgatggtgaaaactatacgatcctaactgatatccaagggctggaagatcatcttggcgatatggactttaaagttgccggtacaaaagatggtatcactgctttacagatggatatcaagattcaaggaatcacagaacaaatcctaactgaagcattaactcaagcaaaacaagcacgtatggaaatcttagaagaattgacttcaacgattgctgctccacgtgaagaattaagccaatatgcaccaaaaatcgaaatgatccagatcgaacctgctaaaatcaaagatgttatcggtaaaggtggcgatacgatcaacggaatcatcgatgaaactggtgtgaaaatcgatatcgatcaagatggaaaagtaagtattgcttcagctgatgcagaaatgatcaaaaaagctatcaagatcatcgaagatttgaccaaagaagtcaaagttggtgaagtttatctagggaaagttgtccgtatcgaaaaattcggtgcattcgtcaacttgatcaaaggaaaagatggacttgtccatatttcccaattagcaaacgatcgtgtcaataaagtcgaagatgttgttaaactaggtgatgagatccttgtgaaagtaactgaaatcgataaacaaggacgcgtaaatctgtcaagaaaagcaatgttgaacgaagatggttcaacgaaaaatgaagaaaaataatttaattcataggaataatgtacttgtgatcgtgaaggtgacagggggacaataattattcgaaaaaaggggactgtgacaaaagccgtgtcacagtcctttttttgcgaataaacggtgttcaaaagcttgcatctgcggtaataagtccagccaagttaaaaacattaggagctgtttttacttggctgttcttattacttgatgcagaacagcttttttacaacctctccaataaacgatgttcaatcagctgtccctcgatattagctcaaaaaacggcaaaatatgaggaactatttttccgtttgtttctctaatactcaggtcaaaccgctgatttcacaacctctgattcacggtgttccagaagcagcttctacggaaataagctgaacacttttgttacaacttctttttttctggagtttcttggcgcatatttttggagtccttctgaataaagcgtaaaataaaagtgagaaatatggataaaggagggaaaggagatgctgaattttttatggtcgttatttatcggcggtatattaggtttgatagctggcgcaattttaggaaaggaagtcccgggaggcgtatctggaaatatcattatcggttttttaggtagttggctcggcgaatttttactaggaccactgggaccggaactcggcggtttttatttgataccagcattattgggtgcaattttttgccttgctctttattcatttgtggcaagacgtatcagagaacgtccaaagaaagaataattttattcaaataagttgacacttcagtgtgttacttggataattagaagcaatttaggaaagcgggtgtcatggataagaatatcatctatcattcaagcttacctaaaggatatccatataacaagaaatgagggaaaaacgtggcaacaacgcacaataccaaaaagatatcaatggctggcctgcttgtagcgatgggagtcgtctacggagacatcgggacaagtccgctttacgttatgaaatcgattgttgaagataatggcggattgtcaggaatcaatcctgattttgttatcggatcagtctcattgattttttggacattgactctactgacaacaatcaaatatgtcgtgattgcattgaatgcagataaccatggtgaaggtggaattttctcactctacacacttgtccgaaaaggtgggaaatatttgatcattcctgcaatgatcggaggagctgccttactagcagatggggtattgacccctgctgtgacggtaacaactgcgattgaaggcttgcgaggaattccgcagttttttgaccggttcggtaataaccagaacgtgatcgtcattatcactttagttattatttttgttttattcatggtccaacgctttggtacagatattgtcggaaaagcattcggaccaatcatgttcgcttggtttacttttttaggcgtaatgggattaatgaacttcagtcaagattggacagttatccgtgcactgaatccttattatgctatccagctgctttttagtgcagataacaaattaggcttgttcattcttggaaatattttcctggctacgacaggtgcagaggcgctttattccgatcttggacatgtcggcaaacgaaatattcgtctgagctggccttacgtcaaaatttgtttggttatcaattattttgggcaggctgcgtggttgttgaatgtttatcaaaaccctgaagcacagcaaatcaagaacctgaatccattcttccaaatgatgcctcaaagttggatcgtgatcggcgttgcttttgcaacagtcgctgcagtcattgcttcgcaagcattgattacaggttcgtttacgctagtttcagaagcaatcaagttgaaactgctgcctcggttaaagatcatgtatcctgggaacagtatcgggcaaatgtatatcccagcagtcaatctgattttatggatcgcctgttctctagtggttgtcacattccgaacgtctcatcatatggaagctgcttacggtctatcgatcactgtgacgatgttgatgacaacagcactgctttacttttatcttatccaaaatgggcattctcgttggcttgcatatttagttacctttttcttcggcgcgatagaagtcgttttctttatctcaagtgttgtcaaattcttccgaggcggttttgtagccgttctgattggtttgatcatcttagtcgtgatgtttatttgggaacaagggaacattattcgcgaatcgtcaaccgaggatgtgtctttgagagattatatcccgcagcttagagaattacgtgatgatacgtctttaccaatctatcagacaaatgtggtcttcttggttcctgatatggctgaagataaagttggccgacagttcatctattcgattttagataaacggcctaaaagagcacgagtctattggtttgttcatgtggaagtgacggatgagccatatacgaaagaatatcaagtagatatgatggacactgattttattgtccaagtgaatctgttcttaggtttcagggtccaacaggaaatcaacgtatatgttcgccaagtcatccatgatttgatgaaacaaggccgtttgccaaaacagccacaaagatactctctgacaccaggacgagaagttggcgatttccaatttgtcctgattgatgaagtagtttccaatgtgacaactctaggaaaatggcaacgtcaaatcatgcaggcaaaactggcaatcaaaaaaatcgctacctcgccagaaacatggtttgggctagagtacagcgaagtaaaacatgaaactgttccgcttatcattggaaatactcggaaaacatggttgaaagagcggttgtgaaagtagcgctttgacctgaactaatgtcgaatgtcagctacttgaacaccgtttatcagaggtcatgaaaaagctgtactgcaacaagcagtaagaacgagcagataaaaacagcttctcatgtttttcatctgtttgggcttaatgccgcagatgcaagcttttgaataccgtttttatcagaggtcatgaaaaagctgtttagcaacaagtaacgcaatgattttgaagtgataaggagatgtggctgaaaaatgccgcatctccttttttattcctaaatatgaatacgcattattttcaatctttttgtagaaaaagggtacaatagaaaaagagaaaggcgggagaatatggttatcaatttcattattttatttttgatgattgcaattacttcattttttgtagcaagtgaatttgctttagtgaaaatcagacgatcaagattggaacaactagaaaaggaaaatgtaaagaacgccaagctagctcttcatgttacacaccatttagataactatttatcagctagtcaattaggaattacgctaaccggtttgatcatcgggtgggtcggtgaaggatctgtcgcggctttactagaaccagtgatcggtaaactaccttttagttcggctattagcagtacaatctctgtggcgctgggatttattttagttacgtatatcgatgtggttattggcgaactgcttcctaagagctatagtatcgtcaatacggagaaggtcgtcttgttcgtagttaaaccacttcattatttttataaagtaatgtttccttttatttgggtattgaatcattcagctgcagggctagggaagctattaggtgtgcggctcgtatctgaaggagaagagacattgtctcaagaagagctgacattagtcgcattgaattcttatgaaaaaggagagttgaccaaagaagaatatcattatttggaaaacgtgtttgaatttgatgataccttggcaaaagatatacaagtagaccgtacgtccatgcaagtattcgaagcttcagaaaccgtcaaagaagcgataaaagcttcgattgaacaaggacatactcgctattcggttatcttagaatcaaaagacaatgttttaggttatgtcaccttgccagatttgatcaagcaatcttataaagatgaccagctgacagtagaacagttgattgaagagccgatcgtaacaactgaaacgatccctataaaaaaattattgacgatcatgcgaaaaaagggaaagcatattgctatcttaaaagatgaatacggagggacaagcggcttagtgacgattgaagatattttagaagaaatcgtcggcgaaatccgagatgagacagatttggacgaagcattggtagcggaacagtcagatggctcttatatcatctccggcaaactaacattagatgatttccagcgttattttcatgtagagattccagagtttgaagaaacgaattttactacacttgcgggctttgcttctagccgatataaagaaataaaagcaggaacaatcattgagattgcatcattccgtttcacggtattagaataccagcatgcacatatcgattatttcaaagtagagtccacggaaagaaaaacagaataaaagaaaaaaggctgtgacattttttgtcacagcctttttgttatctaaaaaacctgttttcggtaaacgaagaagatattttcaataaaagttttcatttttagccgcaacgatttcttttaatcaaggctatcttgcttctgcatgttctaatgtgaaatgttcctcttcacccatgtgtttcaattgtttcatcgaacgcatataagagtaaagcaacacggcaacagaaccgatccaagctaaaggagaagctgctgctgctcctgggtatccccacattcctgtaagaacgatagctgcaaaagaacgcataagcaattccatcataccggcgatcgtagggatcttgctttgtccaagcccttgaagtgtgtagcgtaaaatgaacaggactgctaagatccagtaaagagacccattgatattgaagtaggtttgtgctaattcaaatacacgtgtttctgatgggctaacaaacaattgaacaaagaaatgaccgaagaaaatgacgatagcacctgctaagagactaaatccgacactcatcagtaaagtttgacgtaccccttgcaagattcggccatattctttcgcaccatagttttgtgcagtgaaagttgccattgcaataccaaatgacatcatcggctgatttgcaaattggtcgatacgaccagcagcggcttgagcagctacgacatctgtccctagactatttagtgctgcttgtaacacgatagcaccaacagcgatgatcgaagattgaaacgccattggcaaagcagcatttaggtgtacagcaaactcttctttttcaaatttgaaatcttttttgcgtaactgtaacaaaggcatttttttcttgatatacactagacacagtacgctggaagaaacttgtgcgattactgtagcaatagctgcaccttccacacccatgccaaaatagataataaagatcaaatcaagtacgacgttgatgatgaccgcaatgatcagaaagaatagtggtgtgcggctgtcaccaagtgcgcgaatgacattagaaagcaaattgaaactgactgatgcaaagatccctaataaaataattgaaataaatgtttgtgcttgatcaagtatttcaggaggagtttgcatcaattgaagcatcggacgaataaacaggagacttaggacagttaaaatcacagtgacgacaagactaatgacaacactagcagcaaaacttttcttcagaccccgataatcttttgcaccgtaacgttgtgcggtaataatggctaaaccagctgttaaaccttgggcaaagccaatgatcaaaaatgtcaggcttccagttgcaccaaccgctgccagcgcatttttacctagcgtctgacccacgatgatcatatcgatcatattgtagaactgctgaaaaacatttccgatcagtaaaggaacagtgaacatcaaaatcagtttagcggggcttccttttgttaaatcgcgcatcttttaaactccttatatctttaaaatttagttagtagtatatagcgtttatcctgagaataccaattagaaatcaatgataatttatgaaactccataaaaagaagccaagaattgagtcaaagaatcaacaacttggcctggtctgtaaaataagggacatccacgtttatctatcaccttaatattgtctgatctcacttggtaaaaggatcgtttctctcgtaccgtcatcataggcgtatacttgagcaggaaattggttcgaataggcaaacggcaaatcaatatccatttccacattgcttcctgcttgagaaaaatgcatcgtcacttttccacgattttcgatcaaatcaaaggttaatatattttctaatggaatgactcccttaagatctaggtcaataataaaccatatactgtcaatcaattcatctggcaaacttgatacgacaccaactgaagcgtaacggttgcggctgctatcaaaactttcaaacatctgtttaacctccttcgaatcaacgaatgttttatttttataattaatcctaggataaactagaaatacttacttcaacgagggttcattctaataaagaatcaggaaaaatgcaacaataattgaatacttttttttaaagtataaatttttataaaggtacgataaaagtatgcgaggaaaagcttggtaaattaggatttttgcgtttgcaaagctatttgtaaaagtggaagcctcatatgaaaataaacgattagaaagaaaaaaaggcgtgttaaaagctgctgacccgccgcttctaacaccacctgattgtttcagtattattcttctgttgaaccgattacttctggttcgccaccttcacctgtgctttcttcttcttcactttgagcgactacagcagcgatttgctcttcactgtcggtcacgaatttgtaatcgtcgttttttggaagatcggctactgtaatagaatcacctaattccaagtttgtcacgtcaacttcaattcgttcaggcaatttgtctggtgtagcagatacgactactgtatacaagttttgagctaacactccaccagatttagcacccactgattcgccaacaagaacgacttctgtttcgacttctgtttcttccgacatgtttacagatagaaattctgcatgttcgaaatgattggtaaaagtgttcgtttggatcttgtgaaccaatgtattgactttttgtccatcgatgtccatcgtgataactgtgttcgctccatgttcacgcaacaatttgcttagtgtcaaaccatcgaatgagataggggtactttctactttatacccataaacaacagctggaactttcccttcgtgacgaagtttgtttcttaatgaacggggacgtacttctcttttacttacttctaatgatactgacataaccaaaattcctccttaaaatgtgactgtctgctttggtaacggacagattttatttaagtgaattctaaaggctaatctcgtgcacatcatcgaaggcagggcgcttaaaaaagcgcaaaaggagagatgcgcgcatctccccttagaaagtcaggattcaacttttctccaccaggtcattacgctgtgtatgagaaatccaattcactttactatttaaccgtaacgtgaactgttaattaagtcaaggaataactatgatgatgtatttgcaagcaagaatattcaaggtataattaattagtagtaataagaaaggaaacagcatgcgtttagataaattaatagaagaaaaattagaaacgacacgcaaggaaatgaagcggctgtttgctttgaagcaagtgatgatagatggcacagtcgaatttcgacaaaatcgaaatgtagatagtttactgcatcaaatcgaagtagcaggtgaacacttagaaacaaatgagtcctattatcttctcaataaacctgaaaaagctgttacagctgtatcagatccagaaaagacgacagtaatcgatctgattgcaagtgccgatcgtttccaaccattatatccagtgggaagactagatagagatacaacaggactattgctgatcacttcgaatggacaattgggatatgaaatgctacttccagaaaaaaaggtttcaaagacttatcaagtagttgtgaacgaaagggtgacatcagcagacgtaacagcatttgaaaatggaatcgtattcgctgatgggtatcaatgtaagccggctgatttaaaaatactcaaagcagacaagcaccaaagtacggttttattgacgatccaagaaggaaaattccatcaagtcaaaaagatgttcttagcccaaggaaagaaagtgaccgcattgaaacggctaagcatgggaccattggaattagatgaacagctaggagtaggcgagtatcgatcgttgacattagcagagatgaaaaagttaagtatttattttaaataggaggtcaaaaagatgaaatataaaactttattgttcgatgtagatgatacattgttagattttcaattaactgaagccaatgctttaagtgctttgtttgcagaacaaggaatcacattgacaccagaaatcgaaaccagctataaggctttgaatcatcatttatggcaggagtttgaaaaaggcagactatcacgagaagaaataataggcagtcgttttgggttacttttccagcaatttgggaaaacagtagatagtgatcaaatggaaaaacgctaccgccactacttgaaccaaggtcatgatcttgttccaggaagtctagaaatcctgaaaaaggtccatccgcatgctgaactttatattgtgacgaacggtgtgtcgcacacgcaacatcggcgattaacagatgcaggaatgcttgattacttcaaggatatctttgtctcagaagctgtcggagcgcaaaagccgatgaaagaattttttgatcatgtcttttcccacattcctaattttgataaaaagcaaactgtgatcattggtgattctttgacttctgatatcaaaggaggaaatatggcagggatcgatacgatttggttcaatagaaataaattaccagaaatcgaagaaatccagcctacttatcgaatcgattcattagaggaactttattcattattggaaattgaaaaggattaattttcagaaaaatatagcattttcgtgttttttcgctataatagattagaatgaaaaaacggatacgaaagaggttttagtcaatgacaaaaagcaagccaattatcattggtgtgacgggtggatccggaagcggaaagacaagtgtcagccgtgcgattttcaacaacttcccggaccattccatcatgatgcttgaacaagattcttattacaaggatcagagccatttgagttttgaagaacgattgaacacaaattacgatcacccatttgcctttgataatgatctgctgattcagcatgtaggcgacttactgaactataaagccattgaaaaacccgtgtatgactatgtagcgcatacaagaagtcaggcaacgatcattcaggaaccaaaagaagtgatcattctagaaggaatcctgattttagaagacgaacgtctgcgtgacttgatggatatcaaagtatacgtagatacagatgatgacattcgtatcattcgtcgtatcaaacgggatatggaagaacggggacgcacattggactccgtgatcgaacaatatttgacagttgttaaaccgatgtatcatcaatttatcgaaccaacgaagcgctatgcggatatcattgttccagaaggcggagaaaaccacgttgctattgatttgattacaacaaaagtagctagtttcttaaaccataaatagtgcgcagcgaaacagttgaacggactgcgaccgtttgaaaagcaaggattctgctttttgaacagtcaccagccaactgtttttttatttataacaagaggttgtgaaaacagcatcttgacctgagtattaaaagaagaaacggaaaatagctgtttatattttaccgttttttgagctaataccgaaggtcagctgattgagcaccgtgaagtagaggttgtaaaaaagctgtctttgcatcaagcgataagagcatccaaataaaacagctcctcacgtttttcgttgggttgggcttattatcgtagatgcaagcttttgaacaccgtttaacgagaggttgtaacagaagtggtcagatccaataaataagaagaaacttacgaaaattatttctcgaatttgtgtgagatttcgtcttatttttttgaagaagctcttttgtcgcaccccctaaggaggcagttttaataaatgaaaaaagatgtggggaatatagatgtctaaaaaaggatcagttttacaaaaatgtcttcagatcatgcccattattggtctgttgtttttctttgtgttgattctttatgcttatcatcatgggatttttcgatcgagcacgtctttgcaagcgtttatccagcaatttggcaagtatgcagtgatgatatttgttctgctgcaagtgatccaagtgatcattcctattttgccgggagggatctcctcagtagcgggcatgctgatgtttggcaatggatttgggcttttatatagttgtattggcctagtgattggggaagcaatcggatttttacttgtccgttactatggcgtagcctttgtccagcttattttatcgccaaaaaagtatcagaaatttgatgaattgctgacaagaaaaacgaaagatatcaaaaaagtactagtcgttaccttgctgcttccctttgcgccagacgacttgatctgtctagtagctggtttgacgaaattatcttttagggaatttatgcagattgtgattttcttgaaaccatggtcggtaggtgtgtatagcatgatcatgctctttttattccatcaagcgcaaggtcatttataatgtaaaaaaggacgtgggtgtatggaaaaaataaaagtaacagaaaatgaattggatgagctgatggcagtcatacaagaagtatggccggaagcttttgtgccgatcattggtcaaaaacaagtggattacatgctgaaaacttatcagtcaaaaaaacagattcaaaaagaactggcagaaggtgtgtcctactttttattaaaaagcgaagaaaagacggtcggttacactgcttatgaagagataaatggaaaaatttatttaagtaaattatatttgctaaataaagtacgtggtcaaggattgacttcttcagtttttcgctggtatgaagaacttgctgcgcaaacaaaggaaagagagatctttttgcgagtgaaccagggaaatcatcaagcaatcgaggtttataagcatgaaggatttgagattacagaagaacttgtttcagatatcggtcaaggatttcaaatggtcgattataaaatgaaaaaagctctcgcataaacataggaactgtgttaaagtaaatttatgcgacgggtcgagaaggactctggtttacagagctcctaattgattttggaggcacaggataattgatttctatctttatcacctgccggatgcaggggtgtcgggcaaggcttttgtggagaagggcttgtctgcttgagtaatcaagtaccgtaaaaatgcagaaagaagcttatgcttctttctgtattttttttttacaagaatatattctgtaaaattggtttatttcccctttaatgctaaaatcgaagagcagattagttataagactgtttaaggagccattgtcatgttcgaaaaactcaaacgatttgggcgtaattttacacaaacaacgccctttatcttaagtaacacggttatttttattccttatcttttatttttgggactaacagactcacataattggctgacgattttgccatttacgctgttttatgcctttcggatgactggactatttttagtcaacagtctacgatttggtctagatagttacacgttgctgatgatcgctctgctgattggtggtgctggttcattgcttggaatattaggcgtattttattttcctttattttatttttcaagtgttttgctagggctgagtgcagcatggcttgtacctgctaataccacggtcaattttcacgaaaagacgcaaggttttatcaatatggatgggaaaaagtacttatttgcagctatctggctatttctcctgtatcaagcgattgagttgcctgcgccgactcagattgcagcaagctttactatttatacacttttttacgtcatggcctaccatacggttagtcattatccgcgttacgaactggatttcaaagacatcaaaagaaatctggtagctacgcgagagcttgttttatttttgatattctttggcttattgtttcttttgagaaatgcccgattgttattcgatgaaaggctttttgatcttgctatttatggtttcttgctgctgttcatcttgttcgtgtttgttttaggacaccagaagaaggaatggaagttgccaagctggctaaatctgtttacttttctaaatggaatgctagggaatttcctttttttatttagcagtttttatgttggcatactgtacggattagaaaaactttcgatttttatgtatttgccttatgcagcaggcttgattgcagcaaaaatagtcggaccatggattttgaaacgtttaacatggtctccattggctatgcaattgcttggactgagttcttctttattggtcctcttgattccaaatggttttgcgataggtgtctttctgcttagtttctggcacgtagtaacaggcagctggctaaataaggaatattatcaaactgatgcagctattccaatggatcgccggatcgttgtcaagtatactactcaaaataaagggagtgtgatccaccagtttttattgatgacgcttttgtttgttttagcaaaagaaatgggagagccaatccatctattattgatcacgctgaaccatgaatcagtgccgatagaaagtgtacaactgcttatcttggcaaaatggatcaatgttggtctcttactgagcggattagtaactgtttatcatttatggaagaaggcgaaaaagaatgaggctattcattgatggagatggttctccagtaaaagaagatgtcataaaattaggagaatcctatggtcttgacgtggttatcgtgaccagtgtggaccattatacgaccaaagaatacgctaatcatgtccaaatcgtctacgtagaccgcggagctgatagtgcggattataaaatcgtcggtatggttaagaagaatgactttttgatcacgcaagattatggtttagcttcacttgtattgccgaagggtgtgcgagtgttccatcactctggaaaagaatttgacgaagcgaatatcggcacacttctcgaacaacgttaccatagtgggaaattaagaaaagctggcataaggacaaagggtccaaaaccctttacggagaaagatcatatgtcttttcgtcaagcgttgaaaaaggcaattgaccaaggtttaccaagtacagaagatagtaggtaacgaaggtattttatttatgctcgaatacatcaaaaagggaacagggaaacaggataaatgtgttccatgttcctttttgattgttcttattactgggtgcagaacagctttttcacattttttattctcggtgtttcagaagtagcctcttcgaaaaataagccgaattttcacaaaaatttgagaaacaatttatgtaaaaccccttcttatttcttgaagctgattctttctgtcacaacctttttctactttttcctcttcttatacatttggatcaatgcatcgattgccaaaaaaataatgacgaatgcggcaatagcatacgtaaatatccctaataaggaaacgacctctgcgttttctacaggtgctgcttggacaagcagggaggaccctacgatcaatgcagctaaaatcataccgaaaacaagccgattgatcatactttcgatcctgctcaataatttgtcttgctttttcaattccaaattgacttttccttgtcccgaagtccacatttctaatagatggtggagctgttgagggatcttaggcgcagccttcatcccttccaataagtctaatccgctttgtttcaatgtatcttctacatccagatgagtgagaaaataatgttgggcaaaaggcgaagcgacttccatgagggaaacttcaggatcgaggacgcggatcaccccttctaatgtcccaaatgctttcagcaaaagcgtgatatcacgatcgaactgcagattattttgatgacaaatcgtcacgacatgtgtgaatacttcttgcaagttgatttcatcaataggagaatcataatactgttcaagaaaacttgtcagttcttggtggaaccgactttcatcaaacgagccttcttgctgacaaagtcgaaggaccgctttttcgattcgataagcatctttcgtatacagcgctaaaacggcttgtgtgagtttttgcctaagtcctgcagaaagatgccccatcataccaaaatcgatgtagttgatggtatatggcgcaacagggtcttctgtagaagtggaggctcgaaaagcaaaggaaccgaactctttttcatggactgtttcagtttttcggctagcttgtgtctgttcttcttttgttagtacatggaatagcagattccctggatgaggatcagcatggaaaaaaccatcatcaaacacctgtttcataaagttctcaactaaaagctttgcaacttcttgtttcagctgcttgttttgaattccagtgataaaagtttcagttttgttttcggcgttcattaaatgattcaagtttttaccagacatttcttccatcacgatcacttttttcgaacaaaaagcgtcataaatcttggggctgcggatctctttccagccattgttcttttgatagaattgttcgccattttgactttcttttaagaagtccatttcattgatcaaggaacgttttacttcttggagtaccccttttagatcaactacgctagtttcaggaatgtatttgatcaaagggatcgctcgttcaaatagttgaagatcaagtcggatctcttcggcgatgttagggtgttggatcttaacgacgaccgagtcaccgttcttcagcttggcacgatgagcctgccccatagaagcagaggcaaaaggcgattttgaaaaatcatcgaatatatctgataatgaaagagaaagttctgtttggatcgtctttttgaccgttgaaaatgtgtcgctaggtacactatcttgtaatgttttgaatgtttgagtgaaggcagaagaaagcaaatcttctcgaacagaaagcatctgtcctatcttaatgaaggtggggcctagttcttcaaaggctttttttacctgttcgggatttttttgctgtacaaagtttggcactacattgtaattgatgaacactcgaatgatttctgccaagcggctgcgtggatttgtttgcgccatcatcatccctccttttctttatcataactttttataaaaaacgggacaaataatctagctgacaaaaaataaatgacgtttgttcttttagaaaccaactcgtttttttataaataagttattcgtttatttttgttttgtgctaaaatatgagagtaaatcactgaacgatttagaatacaggaggacaatcttttgaagattactttactatatggcggacgcagcgcagagcatgaagtgtccattctttccgcattttcagttttaaatgccatttattataattattaccaagttcaactcatatttattacaaaagaaggacaatgggtcaaaggtccattactaacagaaaaacctgccagcaaagatgtcttgcatctttcatgggacccaagtggacagacagaggaaggctttacaggaaaagtgatcaatccgggcgaaatcaaagaagaaggagccatcgtttttccagttttacatgggccaaatggggaagatggaacgatccaaggcttcttagagacattgaatatgccttatgtcggcgcaggcgtattgaccagtgcatgtgccatggataaaatcatgaccaagtatattttacaagctgctggtgtgccgcaagttccttatgtaccagtacttaagaatcaatggaaagaaaatcctaaaaaagtatttgatcaatgtgaaggttctttgctttatccgatgtttgtcaaacctgcgaatatgggttctagtgtcggcattacaaaggcagaaaaccgagaagagctgcaaaatgctttagcaacagcctatcagtatgattctcgagcaatcgttgaacaaggaattgaagcgcgcgaaatcgaagttgctgtattaggaaatgaagacgttcggacgactttgcctggtgaagtcgtaaaagacgtagcattctatgattatgaagcaaaatatatcaataataaaatcgaaatgcagattccagccgaagtgccggaagaagtttatcaaaaagcgcaagagtacgcgaagttagcttacacgatgttaggcggaagtggattgagccggtgcgatttctttttgacaaataaaaatgaattattcctgaatgaattaaactctatgccaggatttacggagttcagtatgtacccacttttatgggaaaacatgggcttgaaatacggcgatctgattgaagaactgatccagttaggaatgaatcgataccatcagcgtcaatctttttttgaaaaaaatgaataaagaaaaaataaaggaagaagctggagtgaacgcgtagccgcgttcattctagcttctaaatacgaatagagaaatttacttggaagtgagagtcatgcgaacccgccgtttaggccaaacgcttttttcacaaccttttttaggagagatctcaatgaatctaacaatacaagaaattgcacaagccgtgggcagcgaatgctctgcactgacaaagattaccaatgtcgaatttgacagccggaagataaccgaaggaagtttattcgttcctcttgctggtacgcgagatggacatgaatttatccagcaagcgatcacaaacggagcatctgcttcattttggagcttgcctgttgaacaagctccaaaagattttccagttattcctgtagcagatcctttgaaagccatgcagcaattggcaacctattacttggaaaaagtaggcgcagaagtcgttgcaattacaggaagcaatggtaaaaccaccacgaaagatctaaccgcgtctgtcttgtctgaaaaatacaaaacatataagacgcaaggaaattacaacaataatattggtcttccttacacgattttgcacatgccccaagatacagaaaagatcgtcttggaaatgggcatggatcacgccaatgaaatcacggaactttcacttatggctcaaccaaaagctgcagcaatcacaatgatcggtgaagcacacatagaaaatcttgggtcgcgagaaggaatcgctaaagccaaaatggaaatcactgacggacttgtaccagacggattactcgttgtgcccgcagatgaaccgttgctgacacctttaacggcaacattagtacaaacagtcacaacattcggtattggaaatggcgatgttcatgcggaagtgacagcaaaaggaaaagcacaaaccgattttgtagtagaaggagaaacatttacgatcccgctgcctggaagttataatgtaacgaatgctttgattgcgtatacgatcgggcgcttctttggactgtccatacctgagatacgccaagggctcgcccatgtttctatcactcaaaacagaaccgaatggctaacggcaggaaatggtgcagctattttgagcgatgtctataatgcaaatccaacagccatgggactggtattagatacttttaaaaatctgccaacaaaagggcgcagaattgctgtgttagcagatatgctggaattagggaaagattctttaagcatgcatgcgcaaatgagtgaacatatcgatcctgagaaatttgccatgattttcttgtacggggaacaaatgcatgcattaaaagaagaattgaatcaaaaatacccccaactacctgtgttctattttgaaaaagaaaagaataaattgattgatgctgtaaaacaaaatcttgaagcaacagatagtattatgctaaaaggcagcaacagcatgggcttatttgaagtggtagaacagcttcagcaaatgaaataaaaatctgtaaacttgcagaaaacgaaaaactatgttagaataacctattgccgaaagatgaagataaattggactggttttgccatagaaacaacttgttgaagccagatgtcataataatgataaagctgaacgcgacccgtttggcttttctaatgcctaaacttcgcaaagtgatttttcggtggtgccacaggggctaagaatggataaaaacgtgcgtggccactgtcaaaaagaaacaatacactttgaccgaacaaatcgacggggtagcaaaaaagctacatcctcagttaacaatcatataggaggattcatttgaaatttaaagaactagaattatcaccagaattgttgaaatcagtcgaacgcgctggttttgaagaagcaacgcctatccaatcagaaacgattccactagcattagctggaaaagacgttattggacaagcacaaacaggtacagggaaaacagctgcatttggattaccaatgttagaaaaaatcgatccagatcgtcacgaattacaaggtttagttatcgcaccaacacgtgaattagctatccaaacacaagaagaattatatcgtttagggcgcgacaaaaaagtacgtgtacaagccgtttacggcggagcagatattggccgacagatccgtggcttgaaagatcgtccacatatcgttgtgggtacaccaggacgtatgcttgaccacatcaaccgccacacattgaaacttggaaccgttcaaacattagttttggatgaagcagatgaaatgttgaatatgggcttcttggaagatatcgaaaaaatcatttcacaagttcctgatcaaagacaaacattacttttctcagcaacgatgccgccagctatcaagaatattggcgttaaattcatgaaaaatccacatcatgtgaagatcaaagcgaaagaaatgacagctgacttgatcgatcaatactatgtccgcgcaaaagaatacgaaaagttcgatatcatgactcgcttgtttgatgttcaaacacctgaactaacaatcgtcttcggacgtacaaaacgccgtgtagacgaattggcacgcggattagaagcacgcggttaccgtgcagaaggaatccatggcgatttgtctcaacaaaaacgaatgagcgtattgcgttcatttaagagcggtcatttagatatccttgtagcgacagacgttgctgcacgtggattagatatttcaggtgtcactcatgtgtacaactatgatatccctcaagatccagaaagctacgttcaccgtatcggacgtacaggccgtgccggaaaaggcggtatgtctgtgactttcgttacaccaaatgaaatggactacttgcatgtgattgaaaacttgacgaaaaaacggatgacgactttacgtccaccaaccgaaaaagaagcattcaaaggtcaattaggtgctgcagttgaacaaatcgaaacaaaacttgcagaaaatggtctagataaatacctgcaaacagcagataaattattagaagaatattctgcacaagatttagttgcacttttgctaaaaacgacagcaaaagatccagctgatgcagtgccagtgaagatcacaccagaacgcccattgccaatgcagaaaaaaggatacaataaaaatggcaaacgtggtggcggaaacaaccgtaatcgtcgtgacggcggtaattatcgtggaaacaaatcaaaaggcggttatagcaaaaataataacagccaaaaagatggcggtaaacgtcacaatgataaaaaacgcggatttgtaatccgttcaaataacgattaaacataaaatgaaagtttctcttttttaagagaaactttcatttttgttatttgtggacttatttgtggcaaaatggttataatttggtagaatgagagtgttctaaatttattgaaaagagaaaagcatatgataaaaggaattgggatcgatgcagtcgaacttcctaggatcactcggctgatcgaagaaaaaccaaaattcattgcacgaatcttgacctctgatgaaatgaaactattccagtccttgccttttcatcgccaagtagaatttttaggcgggcgttacgcttgcaaagaggctttctctaaagcttggggaactgggatcggaaaagttacctttcaagatgtcgagattttaaaaaatgaaaatggtcagcctgttgtgacgcgttcacctcatgaaggcaatgtatgggtcagtattactcatacaaatgaaacagcttttgcacaaattattttggaagactagaaagaaggaaaaacgatggttgtcgcttggcaccgcccaacgaaagcagtgatacataaaaaagctataactgaaaatgtagcaaatgaagttgcaagacttccgcaaggaaaagaattgtttgcagtagtaaaagcaaacggatacggtcatggagctattgaaacagctgaggcagcagttgcaggtggagcttcgggcttttgtgtttcaaatttagatgaaggagtcgagttgagagaagctggatttactcagcccatccttatcttgaatatggttccttacgacgcactgactgtagctgttgctcatgatttatcagtaactgcaggtacacgggaatggttgcaggcagcagctgctgttttagagaaaagtaagctagagacgcctctttcgattcatctaaaagcagacactgggatgggtcgtatcggattttgtacacctgaagaagtaaaagaggcagctgcattcatcaaagaaagtcgtgtattagaatgggaaggtttatttacccatttttctacagcagatcaggcagatgatacatattggaatctgcaaaaagaacgctttatagaagtgctgaaaaaacttcccgaacttcctcgatatatacatgtcagcaatagtgcaacggctttatggcatgatgaaacaatcggcaatatgattcgttatggagtagcaatgtacggacttaatccctctgggcacgcactaccggaagtttatccattgcagccagcacttgagctggtttctgaattaattcaagtcaaaaaactcccagcaggtgaaggaatcggctatggagaaacatatatcactcctgaagcagagtggatcggaacgataccgatcggttatgcagatggctggccacgaaagatgcagggtttttctctattggtagaagggaactactgtgaaacgattgggcgtgtatgtatggatcaactgatgatccgattgcctcaagaatttcctgtcggaacaaaagtgacgcttatcggcaaaaatgcagacaaagaaatcactatgcaggatatagcagatcaattaggtacgatccactatgaagtggcttgcggattaggacagcggataccaagagaatatcaagaataaggaggatcctatggtaaaaagaggagatatttattttgctgatctttctccagtcgtgggatcggagcaaggcggaacacgcccagttttggttattcaaaataatctaggtaaccattttagcccgacgatcattgttgcggccataacggcaaaaatggctaaacctaagcttccgactcatattgggatcaaagctactggaacaggaatagaaagagactccgttatcctgttggagcagatcagaacgatcgataaatcaagattgaaagaaaaggtctgccatttggatcgacccattatggcagaagttgaccgagcattgaaaattagtgtgggtatcgaagcactgactcctgttactaaataaatatagcgaagtaaccatgcagcctttacatataaaaaaggaccagctgtgcgtaaaaaaagatacgtctgcttctagtaccagcatttctgctagaagaagcgaacgtatcttttttgatgatccaaggagtggtccatgcgccctcctcctttacattacagccagacttggattaccagctggctttttttactcctggaatcaaacctttatgtgctaattcacggaattttatacgggacatcccgaatttacgcatgtatccgcgagggcgtccatcgatcaaatcacgatttttcaatcgttctggacgagcatctaaaggaagtttgcgcaagccttcgtaatctttttgcgcttttaattcctggcgtaaagcagcatagcgttcaatcgtttcttgctgtttttttgctttggcaatctttgattttttagccatcaacaaattcctccaattattatttttattagcgtaaatcgtaatctttacgcttttagataaataatttaacacgtttcgcgaaaaaagacaattattttgttttgaatcatgcgccaaaacgaaaagacattttttttgtcaaaataaaggcataaacgtaaacttaaagaaaaagggagatggtgaccatgcgaagatttgcaattaacggttacggagaagcacaagatgtttttgaagaaatcgatgctcatcccagagaagtcggttctggacatgttcgtgtagaaataaaagcattcagtgtgaatccttatgatgttgccttgcgtttaggagaaatgaaagagatacgaacattgaaattcccttatgtaccaggtaatgatggcgctggtattgtgacagagattggttcagatgtcacaactgttcatgtaggtgatcgagtagctgtccatgcagtcggcgggacttacggagaagaagtcgtgttgccatcagcaaaagtagcaaaaattccagataaaatgagttgggaagaagcagccggaatggtcacgccaggaattacggcttataatctaatcaaccatttgacggaaatccagccaacagatattgtaatgatactaggagcatcaggtgcggtcgggtcaagtctgatccagcttctccatgaaaagggaatccgaatcttaaccagtgcatccagtaaaaatgaggaaaaggtaaaaaaattaggagcttcagcatttgctgcttatgataaaacaaatccaggtctgcaatttgctgatcaggcagaccttgtaatcgatgcgacgaaaggaagtatcaaaggagaaaccggcatccagatcatgaaaccaggcggcaggtatgttgcattaaatgacctcccagatctagatttgcggcaaaaaaaggaaggcttttatgaatcgtttgttccaagaaaggaatatctagatgcagaagcctttgctggcataatcaaagcctaccaaaaaggagcctttcatgtttttatttcaatgaatctgtctgcttcacttaagcatgtcatccaagcacatcagctagttgaaggacatcctcctgctgggaaaatcatcctgtcattcgaaaaataagaaatacaggaataaaaaacgaaaaaagctgaaacatttttgtaggggcaaagacaaaaaatgttttagcttttttgcgtatacgtataatagataaaaactttggcataaaattatctttcccttttatttcatgataaagtaaaggctgtaatccttaattatttctcaatatgtaagagattacaatgagacaattgccgtgatatgtccaaaaattcgacttttttgaaaaaagccgattgaaaaaagtatgaaatacatggtaaagtaattcagctgaaaaaagaagaagggggagaactatgcagtcaatcaaaaatacgcttcgattatatttgcttgactggaaacggattttcaaaaacccgattgcaacacttctgatcatcgcgatcatgatcatcccttcgctatatgcgtggtttaacatcaaagcattatgggatccatatggaaatactggagagctgccaattgctgtttacagtgcagacaagccagcagagtttcaaggtaaagaagtggccattggggagcaagtcatcgaatcgcttcataaaaataaacaattaggatggcaattcgttgattcaaaagaacaattagaagacggagtccgttccggaaagtattacgcaggtatttacttgccaaaggatttctcagaagatctgctgagttttactagtggtgatatcaagaaaccaaaaatcgaatatacagtaaatgaaaaaatcaatgcgattgcaccgaaaatcaccgataaaggagcaagttcgatccaatcgcaaatcacaaatgaatttatcaaaacagccagttcgactttattgaaagtattcaatgagataggttacgacatcgatacgaacctagtaagtatcaataaagtcaaagatatgattttatcaacagatgaaaatttggacacgatcgacggctacacaaaacaagtcctcgaattacaaagtcaactacctgaaatcaaggaaaaactgaataaagcaaatgaattcgtggattacatccctaaagtagatgagatgggtgaaaaagtcgttgcattgaatgacaaaatgcctgagttgaaagaccaagcaaaaatcatccttgatttgcaagaaaaaatcccagagatccaaaatgccggtaaacaactagcagagatcgacggcgattttgcttcgatccaagagacaatgaaccaaggaatcgatgaagcaaaacaaggcttgacgatcatccaacaagtacaggatatcttgccagatgtgaaaaatttagaaaatcaggcaagtgatctagcaaaccaaacaaaatcaggtgcctctcagctgaaagatgcgataccaagcatcacaaacagcgtagatgtcacattgaagtcaattggacaagtggcaacaacgacaggttcgttaatagatactgtaagaacagctattgaagatggtaagctgactgatgatgaaaagaaaaacatcagcaatgtattgaacggctttattgacggaatatctcaacaacaaaatgcaatcgataaactggtcgagttcctgactaaattgcaaacaagtgctggaaatacgaaattgcagccaattattgatcagctaaatcaattaaaacccttgctaagcaatctgcaaaaccgcctatctgctttgaacacagctgttcaaaatgaagacacgaaggctattgatgaattgctagatcaaattgatgccgttgttaataatatcaatggcatcattgctggtatcaatacaggtcaaatcagttccactgtcacttctctactagaccaagtcatcgatacgattgggactgcacaaggggcgctaagcaaagcggaccagatcgactttgattcgcttctcagctcaacgaaagcaactgtaacgaatgcagtggcaattttagaaaaatatcaaaaagaaatgcctgcaattggacaagaaatccatgatgccaatacaatgctgaatggaaatatggataccatcgtcaatggcatcaatgaaggggcagacctatacaacaatgaattaccgatccttcagcaaaaattaggattggccgctgattttatccaaaatgattggccagcactaaaaaatgaaatcaccggtacattgacaacagtaaatgaaaaaatgccagaagtcgaaacagctgtgaacgctgctgcggacttgatcaacaatgactggccaaatatcaaagctggtatccaaaaagcagcagacgcgatccgaaaaggcgaacaagaagtcgatctaggcgaagtcatcaaattattgaaactagatgcaacaaaagaaagtgacttctttacacaacctgttgagctacaaaccaatgcgctttatccaatcgcaaataacggttcagctagcaccccgttttatactgcactatgtctgtgggtcggcgctgttcttctttcaagtgttgctacgacagaatactatttaggaaagaaagaccgaaacaattttacgaaacgagaacaattcgttgctcgtatgctgacatttttgacaatggcgattgcgcaaagcttgatcgttacattagggaatattttcttactaggagtagatgtccaaaatccggtctacagcgtgtcatttgctgtcttgatcgccttagcgttcatgatgatcgtctatgtcttggctgcattattcgataatgtcggtaaagggatcgctattatcatcttagtactgtcgatctctggcggaggcgggaactatccgatccaagtctcagggaaattcttccaaatgatcaatccgttcttgccatttactcatgcggtaaacttgttacgggaatctgcaggaggaatttattggccaaatgctacgaaagcaatctggatcatgatcggtttgtttgttgtctttggaatcgtaggaacggcaatctatccgttcatcgaagaaaaaatgacgaaattcaaagaagcggcgcatgagagccatatttttcattaaaaaaagaggttgtgaaatcagtgttttgacctgagtattagagaaaaaaatggaaaaatagttcctcatattttgccgttttttgagctaataccgagggtcagctgattgaacaccgtgtaccaagaggttgtgaaaaagctgctctgcatcaagtaataagaacgaccaaataaaaacaacttcttatgtttttaatttggttgggcttattaccgcagatgcaagcttttaaacaccgtttatcaagaggttgtgacaactgcgctatgcttcgagtagtaagaatgatgggtagaaagcaaccttacatctctctttcaaaagttaagatatcaaaaaggatagaacttgattttctaagtcaagttctatccttttattatagaattcaaagaaaaagcccataaaaaaatgttagatttttgctgtattaaagcgtttgaaaaagcgcttgatatttttctgttttttttccaattattttcttaaagtttattgacttttaaggtcagtgagcgtactataacatcttgtttactataaattttcgactataaaacttgaagtaaaattgtgtgtaaaggagtttagaaattggattacttaaaaaggttgttagtaggtaagcctttaaaatctgctgaaaatgatgagcacaaattaacccgatttgctgctttggcattattgtcgtctgatgcgttatcatctattgcatatggtacggaacaaatcgttgtcgttttagtcgctttgtctgctgcagccatctggtattcgctacccattgccgcttttgttattattttattgatttcattaacgctatcatatcgtcaaatcatccatgcttatcctcatggcgggggagcatatgtcgtcagcagtgagaatcttggaaagaatgctggcttgatttccggtggctctttattgatcgactacatgttgacagtagcagtatctgtctcagcaggtgctgaagcgatcacatcagcggtgccagcactctacggtcatcaagtcgctatttctgtgacaatcgttttgctactgatgatgctgaatcttcgtggtctgagggaatctgcatcgttcctattatttccggtgtacacatttatccttgtgatctcgttactgatcgttgttggtttatataatatcgtgacaggtgctgtgccattgcaagctactgcacttccaggagcggctgtgccgggtgtttctatcgctttgattttacgagcattttcttctggttcttcctctttaactggggtggaggcgattagtaatgctgtaccattctttaagaagccaagagcaaaaaatgccgctgctacattgacgatgatggcattgatcttaggtttcttcttcgtggggatcacatttatcaactattggtatgggatcgttcctgaaaaagaagtcactgttttgtctcaaattggtaaagctgtctttggacatggtattttgtattacgtccttcaatttgctacagcgctgattttagcagttgctgctaacaccggtttttctgcttttccagttcttgcatacaatctggcaaaagataaattcatgcctcacatgtatcaagatcgtggggatcgactaggctattccaatgggattatcacactagcgctaggttcgatcgtattgctgtttattttccatggctcaacagaacgcttgattccgttatactctatcggcgtgttcattccatttgctttatctcaaacagggatggtcgtcaaatggaaaaaagaaggaaaaagatggttaagcaaatcgattgccaatattacaggtgcgttcatctcatatgcaatcattgcgattttgtttgtctatcggttaggggacatttggcctttcttcatcattatgccaatcgttatgttcattttttataagatccatgatcattataaaaaagtagcagaacagcttcgtttagaaaatgatgcaaaactacatgattatgacgggaataccgttcttgtattagtcgggaatgtgacacgggtaaatatcggtgcgttgaattacgcacgttcgatcggtgattatgtcgttgcgatgcatgtttcgctagacgaagatgtcgaaaaagaaaaagaaatcgaagcagaatttaaaaagcatttcccagatgtccgtttttcaatcgtccactcttcttatcgctcgattgaaaatccaattatccgttatgtagatatcgtaagtaaaaatgcagcgaaacaaaactatacaactactgtgttgattcctcaatttgtaccaaacagacgctggcagaatattctccataaccaaacaagtttgcggttaagattgcgattgtcttggcgtgaaaatatcgttgtcagcacctatagctaccatttgaagaaataaaccaagttttaaaatcaaaaacagaccctctagctcttaattgaagctagagggtctgttttgtcttattcccagctaaaggtgccctctataagccattaaagatgggaacagcgtatgaaatgttattattcttcctatttagctgtaaaacattttgattttgatgtcttgatcataatttccgaatcctttgccaaataatgtacagccccctatattttcagcttcttcctttacctcgactcttaagtgccatgtgtcttcataagtagaaatctcagcctcgtcaagtgaccattttttgttaccataactcagtgccatttctaattggtgattcacaaacccaacggtctaagcaagtatcaaatcgatagtgaacatgaatgacaggagacgaaagaggcaatcatttttgaggtagtagaagacttgacggccaaaatcagttttgaacaaccgttacaaatcttgcgtgcgtatcctcaggttattcaagatatcaatcaagtcacactgcaacgaggaaccttcgtgtattggtgttgttgcatagactcacaggctttggattcgacctttgctaaagatgatacgttgttaccaattactttacgtttggctaccgctagtcgtaaaggagtaagaagtgagcatggacaaagatcctccctaaaaaggggtctttttcctatgtaaaaaagaggaaaagtttgctgaatttaagtgctttattgtattttttgacgtacttaatcaagtacgctataattatatcagaaaaaggaggagagacaatggctaatacaacgatgaatcctagcactgctcgtaaaaatttttatcagttattgaaagaggtaaatgaaaatcatactgaaatcgagattattagtgatcgtagtggaaacaatgctgtattgattgggctagaagactggagagcgattcaagaaaccctttttcttgagcaaacaggtactttagataaagtacgagaccgcgaaaaagacgacagtggctttacgaatatcgatgatattgattgggaagctctttgatgagtaactatacagtcgcaatcaaaaactctgcgaaagtggatttaagaaaaatcaagcaatcgaatttaaagaaacaatttgaagaagtgattcagacattgaaggaagatccatatatgcccacgcagtcttttgaaaagctgagacctacacatgaaggcagatactcacgcaggctgaatagacagcatcgagtggtttacaaagttgatgaggaaaataaagttgtggaaatttattctgcctggacacattatgagtgaagtgagaagagccaacctttttagatagttaacaaagagtctccccaaaaaggagactctttttttgttctaaaaccaaccttcttggatttattgcatgatttctttaatttgttcctatatctccacctttgaagggtcattgtttgagtttaggaatggaatgttgacgggtttatgtaaaacaaggaggaagaagtgtgacaaggaaaatcagtaaaattggagcatcgttgttagtgttggcagtggcaacgaccatcgattatcgccaaagtgaggcgaagacaattggaaatgtcgtttatcgagaaacagccaaaagtatgttgaaaaaagcaatggacaatcaaccggagtcgtcttattggttcccagaggattcgttggcatggtcttttggaaaagatacagatacgaaatacaataccagtgtcgttcctttagcagagcgggtatccaaagcgacattgccgaacatgaatgtcactcaaacggaagaagtcaaaatcgtggcgctttcggccatgaatagcagtatcaacggcaatgcatcacgagggatcgatatcttttacgccaatgtcttttcttattggcaatatatcgatcaattggtttacgggggtgctcttctggtgaaggatcatcgtatcgccaagtctagttgcgacggatgcagtccataagaatcgtgtaccggttttaggaaccgcaaaccgcccatggcgagaagctggaatggctagatatgtttttagccaaggatgaggatggcaagttcccgattgtataaaagatgatcgaagttaccgatacggcagtcaccagttttgatgatgcagctgaaggcatcgaacaatcgaggactgatggaaaaggcttaaatgaaagccacgccaaaggatgtaagaattgatgcccaattcaaagaacaagcagacgagtatttagagatcatgtggtatgaattccatgacgagtgatgggaaaatggattggcaaaatgccttagcggataagaaaaaaacttagtcggtggatgcagagatgaacccgttggcagtatgaagttggagtatacggaatggataaatagctaagaaaagcaactctttgcccataaggagggaagaatcagagtggattattgccttaaaaaatgacagaactaaaaaagcctttgcgaccaacaaatggtcgcagaagcttttgttttttacaataacatcagcgtgatgtacggctggctggatctagccgtctttccaaaatacctaaaagccagtccgtgatgatcgccattaatgcagttggcaatgcacctgctaaaataatcgatgtgccatctgttgcattggttcctcggataatgatatctccaagaccaccagcaccgacgaatgcaccgatcgcggttatcccgatggcaacaactaacgcgtttcttatgcctgccatgataacagaaacagagagtggtaactctaccatgaatagtcgttgtctagcagtcatccccatgcctttgccgacatcaaggatgtttttgtctacttggatcatcccggtatacgtattcttgatgatcggtaagagggaatacaaaaatacagtaacaatcacgacattgactcccaggcctaatccaatgattaaaatggagatcatggctagagaagggatcgtctggatgatattcgccaaacgaatcacccagtttgctaatttacgtctcctagaaatcatgatcccaaccggaatcccgacaactgctgcaaagaggacaccatagatagaaatcaggaagtgacggataaattgtgcaaagatataggagccattttcctggaaataatagaaaaattgttgaaagacattcattttatccaattgcttcacttcccttcaaaatagtggttttcttgtaagaaacgttgtgctactactgatggttccactagattattatctgcttcgtagttcaattcctgcattttttccgtactgatggtatgacctaacttatttaaggcttcttttaaatgaggcgtatcagctaatatcttgttgtctacaactggagcagcatcatatggtgggaagaattgacgatcatcttccaacatgactagatcataactggcgatccgtccatccgtagagtagccaagaacaatatccatttttcctgcttcgactgcgtcataaacaagtccaatctgcataggtaatatcgaattgaaggagaagccataagtttcttggaagccgtcataaccgtctcctttacgattgatccaagaagtatctacaccagctactaattcatccgctacatttttcagatcgctgactttagatagatggtatttttgtgcggtgtcttttcgaacaagaaagacatacgtattttcaaaaccataggacgggaaccacgtttgatcgtatcttttctcaaattcatctttcacggtagcaaacgcttttttcggatctttttcaggaggaaggttcaatgtagtcgttaaatctgttcctgtgtagcgagccgctgaaattgaagcatctccgttcatcatcgcttgatggttgatagttgtggtagccagattgttgatgattgcggtatttttatctgtataatgttcaaccattccggcaactaggcttgctaagatctgtgcttctgaagtgattccacctgtgatcgaaatggtgtcttcatctgtattactggcaagaccagggaaagaacaactcgcaagtataagaagagagaaaagaaccatggtcatttttagtatacgtttcattcttcattctcctctctaagtgcgatcggtgtcagccggtgttccaagagacctagaagccaatcagccaatagtgctaaaatcgttacagggatcgtacctgccaaaatgagatctggttggtaattattcagtccactaaaaatcaaatcacctaaaccaccagccccgatataagaggcaagtgtagcccatgcaatcacgtaaacggcagctaaacgaataccagccatgatcgttggcatagcaatgggcaattcaacggaaaaaatggattggaactcagtcattcccatgccttttgccacatcccgataattccaatcgacatttttcatcccaatgtacgtattacgtaaaatcggcaataatgaataaataaagagtgcgataatcgcaggtaatttacctacgccaaatagcgggatcatcaatgccaataaagcaagagaagggattgtctgcaaggcactggttaagccaatcacaatcgtggcagcttttggaaaacgtgtcagtaagacaccaagcggtacagcaatgatgataccaatgatcaaagcaagtcccgaaatataaagatgttcaaaaccttttgagagaatttctgaaccgtgctgatgaaaaaactgctgcataggtcagacctccttagattcttcaggagtagctgactctgcaacatcagtagttgcgggatcttctccccaaatcacatcgtagacgatatccactaatgatgcacgagtcaggatacctacgactttgttctgttcatcaacgaccggcacgtatttcagcccgcgttttaaaatgcgttgcaaggtatcacgaagataggcggattcttttacgtaaaaaacatgtttattcaaaatgtcgccgacactggatacttttcctcgttttttattcaacgtttctacatcgataaatccttttaatacattcgaattatcggtaactaacaacgtatctacacgtttttccctcatcagtttgattgcttcttgtaatgatttttccggtgtaatcgtgattgctgtatttagcataacttctccgactcttgtcgcatttggcttggcttgtagtaggcgatcttctccaatcaactcttctacgaaatcgtttgcaggatgacgtaaaatattttctggtgtatcaaattggatcacacggccttcactcatgatggcgatacggcttgctagcttaatcgcttcatccatgtcatgggttacaaatacgatcgtttttcccaagcgctcttgtaaatctttgacaaggtcttgcaaagaatcacgagtgatgggatcaagcgcaccgaatggctcgtccatcaagatgatatcttgattcgctgcaagggcacgaacgactccaatacgctgctgctgcccaccagataattcatgtgggtagcgatctaacatctcacggggcaattccacaagatcaatcattttttcagctgttttattccgttcttcttgactgactttcaacaatttttggacaagagtgatattttcacggatcgtcatgtgaggcatcaatccagtactttggataacatagcctatctgacgtcgcaattccactggatcaatttcttggatggattttccatcaatcaaaattttcccttgtgttggatcagtcatccggttgatcatccgcatcgtcgtcgtttttccgctcccgctcgtaccgataaaacaaatgaactcacccttttcaaatgaaagattgacgtcctctacagcaactttcccacctttataaatctttgacacattttgaaattcaatcatggtgccacctctttttctattttcaatgaagaactatctattactagtatgcctaaaacaatgaaaaaatacaaatagggtagtttttttattttaattagagacatgatcgtttctttttaagaaaaatcaatataatagcgatatttgtttccaatgtaatagcattcgctatattctctgaaatctgtttcgagttgtttggtgattcgtaccctttttaaaatcggttcatgttctgtaatattcaatacttcctggatttctttgtctggtaatatggcttcaatatattctttcgattggtttacttgaatatgatatcggttcaatagttcgtaaaaggagtcataataagccgaatcctctgtaggaaaatctgctcgatatttaaagtaggtaatgaaataaacgaatggcttttcatcagctgtagttgcacgagtacgtctcatgaccattactttttcgtcaggactcacgttaaggagttttgctatttttcgattggctttctcaattgaaatacttgcatgaatcgtttttatttctttacctaattctctcatttcatctgtaaaagagcgtacaagcgtaaaatgttcatctttttctgttttccaatccgtcacaaacgttccttttgctctttttctttctactagcccttcatttactaaactgtcgatagcagttcgtacggtaatgcggcttacatggtaggattcacaaagattttcttctgtagggattttcatacctgttacccattcttccataaaaatctttgttcgcagttcatcagcaatttgtgcatataaaggaatattacttgctgtttttttcatttttaccctcctaaaataaatcatcatactattgttataacatagtttggttatttttataattataacaaactaagaaataatgagaatatacacttgatttaacgctattgtaatgaaatttcatacatcaatacccattgttatcatggtatcttagctatataatcataatgtaatgacaatagaaaggttgttagagatgaaatataatttgaagccaactgtagatgtcagaaataaaggaaaagcgattgtagggtacagagcaattattgaagaaataaaaagctatctaggtaatagagaagacgcagtcatcgttttggaatgctatcctggagtaagaaaagaagaaattgaaaacgatttccttagcgagtttccagaaatcaaagaaaaaatctttatagacgaatacggattgacagtagaggaagttcagaaaaaaattcgagatcatatcacagaagatcgagtatttggtgtctattctcattataatatccaagatttttatccatctgaacaattggaagcagcacgagaacgattagcaggtaaaggattaaaagtcatctatggatttggtgcaagtcttcttacaaaagcagatgttcttatttctataggggtatcacgttgggagatacaactacgttaccgaaatgaacaaatgaccaattggaaaaccaataatcctgatgaagaaggaatcggtaaatttaaaagaggattcttttttgaatggccaatggcagatcgtttacagcatggtatatatccaataatcgattactatatcgatacggtcaaaactaatcagcccaaaatgatcactggcagtcaataccgtcaggcaactgctcaaatagcgaaacagccctttcgtacagtaccgtattttgatgaaagtgtttggggcggtcaatggatgaaaaagaattttcatttaccagaagacaaggaaaattatggttgggcttttgacggtgttcctgaagagaactcattgcttttacaattcgagaatgacattgttgagataccttcacaagttgtggtggaggaagagacaactaatttgctgggagagaaagtacgagcaagatttggaagaaagttcccgatccgttttgattatttggacacgatggacggaggaaacttgagtttgcaagtccatcctttaacggaatacgcttttgataaatttgggatgccttttacacaagatgaatcctattacattttggattgtaaagaaggagcaaaggtctatttagggacaaaaacaggaataaccaaagacaccctgtttaatgacttgaaaaaagccaatcaaactggagaaaatttcgaagctgaaaaatatgtcaatgaaatcactgtcaaaaagcacgatcatttttcgatcccagcaggtaccatacactgttcagggaaaaatacagttgtacttgaaatcagtgccacaccgtatatctttacctttaagctttgggactgggggcgtgtaggactaaatggactgcctcgtccgattcatttagaacatgggattgaaaatatacaaatggatcgaaatgaagaatacattaatgaacacctttttactcgactggaaaattgtgaaaagcttgaaaaccaacaaataggagtaacgagtgagcgtacaggtctagcagagattgaatttatagatagtatccggcattggttcacagatgaggttcagctacaaacaaatgaaagcgtcaatatgttatgtctagttgaaggaagcgaaattcttgtttgctcgactgataacactttccaaccgatggaagtccattatggcgaaacatttattgtaccagaaagtgtgaaggaatacacgctaaaggcaaaagaaaaaggcaaattcgcagtgatacaagcgtttgtaaaaatttgacaaggagggatcgtttatgaatgcagtcattctattagtttcccatggacaactcagcatcgaattaaaaaatgcctatcaaatgattgctggtaaggcggagcatatttttgcattacctctgacagaagaaggaatcgaaactttctctaagcaattccattctttagtcgaggaaaaaatcaaaaataattatctatttttattcacagacatcaaagggggaacaccatataacgagagttatcgtttgaaattgaaatatccagagaatattgaagtgatttctggagtaaatcttcccatgcttttagatataggtacgatgctttcgtttgaggaaaacgtagacaaggatacattcactttgtacgctcgaaaggctgttgaaacagcacaaagttcaatcgaacgtctgcttgattcggaagtagaaaataatgatttggatgactttttttaataacggagggaaataaaatgacaatcacattagcaagaatagatgaccgggttatacacgggcaaacaatgacacgttggacgaagcaatacgctgttcaaggaatacttgtagtgagcgacgaagtggccaaggatgagttaagaaaaaaggttttaaaagcagcagcggcagaattaaagctaggtatttatacagttgaacaagcaaaggaaagtatcccaaaagcagtaaaatcaaataaaaatttctttcttatcactgattctccagcttattttgcgcaactagcagaagcagggatcgattttggaaaagtagtaaatgtaggacctatttctggcggcacaggtgctatcaatgtggcgcgtaatgttgcgttaactcaaaacgaatatgatgcatttgaaaaattagaaactagtgggtatcgggtaactttccaattgttgccagatgatgaaaaaaaatcatgggaagttgtcaagaaaaaatacagttagaataattttgatgtaggcgaaggattatattttttaaatgggggataaaaatggatattaatttactactttccgctgctttaactggtatattttgttatttaggagcagttgattctgcacccctgcttggtgtgacaggtggtttttacgttgttggccggccattagttgcaggttttttgacagggctagcctttggagatgtgaaagcaggtgtgttatgtggactagccgtacaagcagtttttatagcgaacttatctactggcggtgcgacaaatagtgagattacttatgcatcatatggtggactgggactcgctttggcaactacaaaggatccagcagtagcagtcactttagctattcttatagggcaaacattcggattgattttccacaactcaaaacaggcgtttttctctttcttcaataatcgtgcacagaaagcagcagaaaatgcagacggtaaaggaattgtttataatcacgttatctatccgcaattagttattttcatcattcgatttcttcctgtaactctggctatttatttcggtaaagggatggtcaattggttattgaatagtgttcctcatcaaatcacagatatcatcgctgtcttaggcggtgtattgccagcgcttggtgttgctatgttgatgagtatcgtaatcaaacaaaaaatacagcttattttcttctttgccggttttgtgttgattgcatttgcgaatctcagcacactcgcattagtttttatcgccgctctgattgcctatttggtttacatcgcaacaagtaaccaacaaaaacaaccactggcagctacaaatctaggggctgaaatcgatacatctaaagatgacgcagcttatgaagatgaagatatgttctaggaggaagaaatgatgactgagaaaataaagttaagcaaaaaagaattacgtcaaatatggataaggtttgctatgacatccttatcctcctcgtcttacgaaaaattacaagcacatgcggaagcttattcatttttgccatttgccaagcggtattattcagatgatctggaggcacaaaagagacttttggtccgtcactctatgttctataatactgaaccgcaaactggacagttgattaatgggatcgtgacttcactagaagaatctatcgctaataagagtggtgttgatgaggaaatgccgactgccatcaaggctactttgatgggcccgattgctgggattggtgattcgattattcaaggtattgtcattccgattttattgtcgattgctatgggaatggctaaagatggaagtcccatggggccgattttttatatgatagcttatttcatgattggattatttattagctatttttgctttatgaaaggctataaacttggagtagatgcaattgatgtgattgttggagaaaattcaagacacatcacaaatgcatttaatattttgggaatcatggttgtaggaggcctatctgctaattatgtagctttaacaacgaaaataaaatacatgagtggcgatgaaagcgtcaagcttcaatctgttttagatggtgtttttccaaaaattttacctttgatcatggttttactagcttggtatcttatttctcaaaaacatttgagtgccgtaaaagtgattcttattttaacgggtattacaacaattggagtattggtcggaatattttaagaagagtcaggctaatgaaataataaatatatagaatggaattaacggatagaagcaatcgcctctatccgtttttagttagtacacaatatacttgtaagatttcgttttttgccaacagaacgaaaaacatgatagaatgatgaagcacatgatagaaagtgagtgacgatatgttaacaacagaagattttgattttgacttgccggaagaattaatcgcacaaacaccattaaaagaccgcgatcattctcgtttacttgttttggatcggaaaactggagagatggaagataaacgtttccatgaaatcattgaagagttacagcctggtgatgcgctagttatgaataatacacgagttctgcctgctcgtttatatggagaaaaaccagatactggtgcgcatttagaagtccttcttctaacgaatacacaaggagatacgtgggagacattgatcaaacctgcgaaacgtgccaaagttgggacaagaatctcttttggtgatggcagattgcaagcagtagtgaaagaagaattggaacacggcggacggatcattgactttgagtatgaaggaatttttctagagattcttgaatcattgggagaaatgccattgcctccatatatcaaagaacgtctggaagacccagatcgctatcaaactgtctatgcgaaagaaaatggttctgctgcagcgccaacagctggattgcattttacgaaagaattacttgatgagatcgaagcaaaaggtgttgaattagtctatctgacactacatgtagggttaggtacattccgacctgtcagcgtagataaaattgaagaacaccatatgcatagtgaattctaccgtttgacggaagaagcagctgagcgattgaaccaagtacgtaaaaatggcgggaaaatcgtggctgtcggaacaacttcaattcgaacattagaaacgattggaacgaaatttaatggagaaatcaaagcagacagcggatggactgatattttcattacgcctggctatgaattcaaagtggtagaagctttctcaactaatttccatttgccaaaatcgactttagtcatgttagttagtgcctttgcaggaagagaattgactttatctgcttaccagcatgcgattgaagagcgctatcgtttctttagttttggagatgcgatgttcgtgaaataaggttatgaaaaaccgctagttttgaataacaaaaaagctttacaaagattttatgacaaagaaaaagccgagctctcgataagctcggctttcttgtacctcggaaggattcaaataaacagaaatgattgtaactttccatcatacatgcaaagcacggtgttgaatttcttcatgttaaacaaaaattttgttttcgttacatcttcaacatttgaaacatctcttgttcctattcaattttcagacgtttacgttattcaattgttacgtatcgcattacttcttgtttcggatacttcgtgatccaaacatccatacgcattcactatttataggtttgtactctacacgcatgtctgggtgaaacctgtacttctaacaactttgtttgcttacactgttctatcgagaaattcttctgtctatttgatggtatcctccttccttacatctatataatagcatcctttggtggcgtttgcaaatataagcactttaaattttacgctttcttaacaaataatcgataagccctttatttgaagtaaataaaaaaaggatgttatagtaaaataagtacctttttttgtacgaagattttaaaggaggaataggatggaagaatacaagcagacaatagaagaagtaaagaaggtaacagaagcagatccagatactgggttgtcttcacaagaagtggatgaacggcgaaaaaagcagggattgaataaattcgatgaggcgccgaaagaatcgatgatcaaaaaattctttcgaagcttgtccgattttacaacgatcatccttcttgtagcagcggtgatttccttttataccgcatttgctacagaacatggggatttatttgaaggactgctgatcatcgctatcgttgtgatcaactcggtattggcgattgtccaagaaggaaacgcagaaaaagcactggaatccttgcaagatatgaataaacaaacggcaactgtcatacgagacggcaaagtgaccactgttgagtcagagcaactggtagtgggtgatattcttattttagagtccggtgatgctatttctgccgatgcccgtttgatcgaagcatcacaattacgtgtagaagaatcggcgttgactggagaaagtgaagcagttgaaaaagatgcagcatttattgctgaagaagatgagtcattaggtgaccaacttaatatggtatttaaaggatgtacggttgctgcaggtcgtgggaaagcgatcgtcactgccattggtatggctacagaaatgggtaagatcgcggatcttttgaacgaaaatactatgcaaaaaacacctttacaggtccgattgaatcagctaggcaaacgaatcagtatgatcgctttagcggctgcggctttagtatttgtgattggtgaactgcaaggagaaccactccttgagatgttcatgacttcgatttccttggctgttgcagctgtaccggaaaccttgactgttattgttacgttgacacttgcatacggtgtgcagaagatggcgaggaaacatgcgatcatccgacagttgccagcagttgaaacgctaggaaccgctaatgttatctgctcagacaaaacaggaacgctgacacaaaatgaaatgcgcgtccgccgggtatggagcaaagaagatgaagtaacgaatatcgaagattcaatgacgaacagcgcgatggaaatattgaaaatggctgcactatgtacagatgtgacggtcgagcaagaagatgacgaccttgttatcaaaggtaatccaacagaagtagccatcgtaagggctgttgaagagaattatcatacaaaagcagaattagaagaaaaatatccacgagtaaacgagcttccttttgattctgaacgaaaaatgatgacaacagttcaccaaatgggcgaaaaatacatctcaatcaccaaaggagcattcgatgttcttgctccgcgctttagttcaggcgatgtagaacaagcggcgatcgttaatgatcgctttggtaaacgggcactgagagtgattgctgttggttatgctacttatgacgaagaaccgcaagatatttcttctgaagcactggaaaaagacttacgtttgattggtctgatcggaatgatcgatccaccacgtccagaaagtaaaggagcaatcaagcgagcgaaaaaggctggcatcaaaacagtcatgatcactggagatcatgtggtaactgccagtgccatagcgaaagaattaggtatcttgaatgatccgtcagaagcactctcaggatcagaactgcatcaattatcagacgaagaattagatgcgcgtgtcaaagctctctctgtctatgctcgggtaacgccagaagacaagatccggatcgtcaaatcttggcaacgtacgggtgcagtcgtagcgatgactggggatggtgtgaatgatgcaccagcgttgaaagcaagtaacgttgggtgtgccatggggatcacagggacagatgtggcgcaaagtgccgcagatatgattttgacggatgacaactttgcgacgatcgtagacgctgtcagtcaaggacgttcggtttatcagaatattcgtaaagctatcaactttttgctaagctgtaatatttcggagatctttattgttttgattgcgatgctgttaggctggggagcgccattcacagctgtgcaactactgtttgtcaatgtagttgccgatggtcttccaggatttgctttgggaagagaaccagcagaacacggcatcatggatcagcctcctattccgaaaaacgaagggatctttgctcgaggcttgttgcaaaaaatcgccataaacgcaggagtcttcaccatcgtaacgctgtttggttactatttaggtagttatgtcgatactattagcccatgggtagatgcaagtcagcatgtcggtcaaactgttgcattcttgatcttagcttattcatcgattttgcatgtgttcaatgtacgcagcagccaatcgatcttcaaagtcaatttagcaaccaataaagctttggtagaaatggcgttactggcattagctattacaacggctgttgctttgctgccgtttacgcaagaactattcggcctagtacacatcagtttgaatcactggttcttggtagggattttgtctatcgtaccaatcgcggtcaatgaactgatcaagttccatcgattaccggaagcagaagaagaggaatgattaactgtttctaagttgattttctttttactggaactatacaaaaaggaggtgtgacatgaatgttgtcacacctcctttttgctaatgggctgaatgtttcttttactgcctctcgataaacggtgttctcctgccaacccctcggtcacaagtcacactctcttttaaatatcttttggcaattgttcataaaatgctgcttttgttgcggaaatgtatgggctgagccatagataaccaataccagcagttgctaatgctaagatatgccagccgataaatgaaagatctaaccagaaaagttgtcctttataaccatccatcaattttcgacttgcagtgatcgtatccagtactttaggtgtttgtcctgtttcttggacgatatcgtagtagataaaatagctttgagaataagaatagcttttaatgattccaggaataactaatagcaacccccataatgttgtaaagatcgagatcagcacagctaagccgatcactccgccgataaacaaacctttgaatccacgaaatgcatctttgaatggttcgatctgatctttttgtccacgtaaaatatcaagataagtccaagaaataccgctcatgaacaaagcgctaatgatgctggaaataattccgccaccgcctcctgaactaccgcctcctgaagttgtcgcttctgagacgctcgctgatccatcatatatggtggtggcaaacaagataataggaatcataataagaagaatagtagcaataccaatcaatgtagggattagatttagtaaaacagcttgcccccaacgtccttttaaactctcttttgcttggcgttttagttctgcagaagattgcatgatttttccctccttttctttaataacaccaatataccatgtataaaaaaatatttctgtcataatgtttttctttttttttgttattcataaaaaaaggataaaaaaaaagaatattaaataaaatagaaggaagccgagggaacttgcaaaaagcacttgaaacgattatgatggtgggagttgtcaagatattttatatagaaagtagggaaatgaatgacgcaacctgccattcgctatcgtttaatcaagaaagaaaaacatactggcgcgcgtttaggggaattgatcacgccacacggaactttccccacaccaatgttcatgccagtaggaacattagctacagtaaaaacaatgtccccagaagagttgaaagaaatgggtgctggcgttattttaagtaatacatatcatttatggctacgccctggtgaagacttagtagaagaagctggcggactgcataaatttatgaactggaatcaaccgattttaacagattcaggcggctttcaagttttttcattaagtgatatgcggaatattgaagaagaaggcgtgcatttcaaaaaccacttgaacggttcgcgtatgtttttatcaccagaaaaagcaatcaacatccaaaataaattgggctctgatatcatgatgagttttgacgaatgtccaccattcgatgaaagttacgactacgtgaaaaaatcagtagaacgtacgtctcgatgggcagaacgaggattgaaagctcatgctaacccagaccgtcaaggattatttggaatcatccaaggagcaggatttgaagatcttcgtcgtcaaagcgcgaaagatctagtcgggatggatttccctggttactcaatcggcgggttatctgtcggggaacctaaatcagaaatgaatcgtgtattagaattcactacaccgttgatccccgaaaacaaaccacgttacttgatgggtgtcggtgctgctgattcattgatcgatggtgttatccgtggagtagacatgtttgactgtgtcttgcctactcgaatcgctcgaaatggcacatgtatgacttctcaaggccgtctagtagtgaaaaatgcgaaatatgcccatgatttccgtccaattgatgagaaatgtgattgttatacatgtaaaaactatacacgtgcctatatccgccatttgatcaaatgtgatgaaacatttgggattcgtttgacttcttaccacaatttatacttcttgttgaatctaatgaaacaagtacgtcaagcaatcatggatgataatttgcttgaatttagagaagccttttttgaagaatacgggttcaataaagaaaacgcaaaaagcttctaaaggaaaatcttttaaaaattaagtaaaaaactagtgttagcagcatttttctgctaaagtgttttttgtagatacagaattagtgaggtgaaaaaaatgggaacattaccaatgcttgtgatgtttatcgcgctattagcaatgtggttttttatgtcacgttcgcaaaagaaacaacagcaagaacgtcaaaacttgttagatagcatgaaaccaggtgattcagtcgtaacgatcggcggattacatggagttgtttcagaaatcgacaatgacaaacggacagttgttttagactgcgaagggatcttccttgagtacgatcgtgcagcaatcaaaacggtcaaaccagggactgtcgtaacaaatgatgcaacgactactgttgaaacaacagaagaaccagctgagacagttgaagtaaaaactgaaacaacagaaacgctggaagagacagaagagaagaaagaaaaataagtatcaaagcttatttaaagacgaggtagggcagaaatatgtcctacctcattttttattcaaaaaagaaagagataagagtataggatatattgctcaatattgaataatcgggtgtgtcatataaataataataaataactttatatatttttctatacaaacacctgtaaataaagcaattttatatttaaaaataactgtgaaaaaaatcacaaaaaagtgtttacatagaaaaacaaatattgtatgatatacatgtgaatgatttaacaaataaccatgacccattaggaggataatgatggctaaagtaatggaaaaagaaaaaacgaagacaattgatgtacaagcaatgattgatgatttggcagaaaaagcaaatgcagcattgaaagaaatggaaagctttgatcaagaaaaagtggaccatatcgtgcatgaaatggcaatggcagctttagatcaacatatgccattagcgaagatggctgtggaagaaacaggccgcggtgtttacgaagataaagcaatcaaaaatatgtatgcgtccgaatatatttggcataatatcaaacatgataaaacagttggtgtgatcaatgaagatgtccaaaaaggattgattgaaattgctgaaccagtcggtgtggtttgcggagtaactccaacaacgaatccgacttccacaacgattttcaaatcaatgatcgcgttgaaaacaagaaatccgatcgtttttgctttccatccaagtgcccaaaaatcttctgcagaagcagcacgagtagtacgtgatgctgctatcgctgccggagctcctgaaaattgtatccaatggatcgaacatccttcgatcgaagcgacttctatgctaatgaaccatccaggtatcgcgatcgtcttagcgacaggtggagctggaatggtcaagtctgcttactctacaggaaaaccagctttaggtgtaggtccaggtaacgtaccagcttatattgaaaaaacagcaaaaattaaacgtgcagtgaacgatttgatcgtttcgaaaacatttgataatggaatgatttgtgcttctgaacaagctgtgatcgtggataaagaaatctatgcagcagtaaaagcagaattccaagcacaccaagtttatatcgtaaaaccagatgaattgcaaaaattagaagatgcagtgatgaacgaaggaaaatatgcggtcaatccatcaatcgttggacattctgcgatggaaatcgcaaaattggcaggaatcagtgtaccaaaaggaacgaaaatgctgattgctgaattggaagacgtaggcccagattatccgctatcaagagaaaaactttctccagttcttgccatgatcaaagctaacaacacggaccatgcgtttgatttgtgtgaaggtatgttgaatcttggaggattaggacatacagcagttatccattcagaaaacgaagagttgcatgtcaaattcggtcttcgaatgaaagcttgtcgtattttagtgaatacaccatctgcagaaggcggcatcggtgatatctataacgaaatgattccgtcattgactttgggatgcggttcttatggtaagaactctgtttctcgtaacgtctctgctgtaaacttaatcaatgtcaaaactgtagcgaaacggagaaataacatgcaatggttcaaattaccgccaaaaatcttctttgaaaagaactctctattgtacttagagaaaatggaaaacgttgaacgtgtcatgatcgtttgtgaccctggtatggtccaattcggttactgcgatacagttcgtgaagtattggcacgacgtaaaaatgatgtgaagatcgaagtcttctcagatgttgaaccgaacccatcgacaaataccgtatacgcaggaacgaaactgatggcagacttcaagccagatacagtaatcgctcttggaggcggttctgcaatggacgcagctaagggaatgtggatgttctatgaacgcccagacacatctttctttggtgcaaaacaaaaattcttggatatccgtaaacggacatataagatcgacaaaccagaaaaaacacaattcgtatgtatcccgacaacatcagggactggttctgaagtaacgccatttgcggtcatcactgacagtgaaacacatgtgaaatatccgttagcagattatgcattgacgccagatgtcgcaatcgtcgatcctcaattcgtcatgtcagttccagcatctgtcacagcagataccgggatggatgtgttaacacatgcaatcgaatcctatgtttcagtcatggcttcagattatacacgtggattgagcctacaagcaatcaagttagtctttgactatttagaaaaatcagtaaaaacacctgatatggaatcacgtgaaaaaatgcacaacgcttctacaatggctggtatggcgtttgctaacgcattcctaggtatttgtcactcagtcgcacataaaatcggtggggaatacgggatccctcatggacggacaaatgcgattcttttaccgcatattatccgctataatgcaaaagatccacaaaaacatgcgatgttccctaaatatgactatttccgtgcagatacagattacgcagatattgcaaaattcttaggtctgaaaggcgaaacaacagaggaattagtcgaagctttagcaacggctgtttatgaattaggaaaatctgtcggcatcaacatgagtctaaaagctcaaggagtcacacaagaaacactagatacaaccgtagaccgtatggctgaattagcttacgaagaccaatgtacgacagctaatccgaaagaaccattgatctctgaattgaaacagatcatcattgatgcttacaacggataagcaaaagaaagcgtagaaaaaagataagaaaatagatgaaaaagaacttggaaaacgttgtttctccaagttctttttttaatttccaagtaactgaaagttacttttgttatttaacatttaggtcaattttagacagtttttgttcaaaaagcgatatttatagtggacggtattactgctatattaaggatataaaatgaaagcgtttaaaaaggtggcgtaaagatgattattaaagaagagatttttgtacctaaagaattagtgaaagaaaaaattgacctgctcgttgaaaacctgacaacgatcaaagacgataatggtgaatttttgttggactttgatggactgaaagtagatgacaagagctggacagtgtggaattggccacaaggtgtcggtctatatggtatttataaaaattaccagatgacaaaaaatcctcgcgcttatcaagtggtcaatgaatggtttgaggatcgtatggaagaaggcgctccgcccaaaaacgtcaatacaatggcaccgctattgactatggcttacttgtatgaagacacgaaagattcacgctatttgccttatttagaacaatgggcagaatgggtcatgaatgacatgcctcggacaaatgaagacgggttacagcatgccacatatggaccggaaaataagaatcagttgtgggacgatacattgatgatgacagtgcttcctttggcaaaaatcgggaaactgttgaatcgcccagaatatttagaagaagctcgttaccagtttatgatccatatcaaatacttgatggataaacgaacaggattgtggtatcacggctggacgtttgaaggaaatcataactatgccgaagcattttgggctcgtggaaactgctggttgacgattgctattccagagatcattgaaatcttagaattatcgaaagaagatgcattgcgcaaattattgatcgaaacacttgaagcacaagtgcgtgcattaaaaacttatcagtctgaaagcggtttatggcatacgttgttggatgatccttcttcttacgtagaatcttctgcaactgcaggatttgcttacggtattttgaaagcggtccataaacgttatttaccacaagaatataaagaagtcgcttatcgtgctatccaaggattgcttgaacaaatcgatgaaaaaggagaagttcaaaacgtttcaatcgggacaggaatgggggacagtttagatttttatcggaatatcggaatcacagcaatgccttatggacagtcgttaacggtgctttgtttgacagaattgctcgtctcttattgttaaaagaaaggaaacccatatgaaaaaaacatcactgctgtttgcagcaagttcgcttagcctaggtctgctaggtctaagcggctgcggaaataattctagtgtggcaactgtcgcagatgcagacgtaaatgagatagttaccttgcgctttgcttatgcaagcaacagccagccagtaattgatgcaatgaatgaatttgggcgtttagtaaaagaaaaaacagatggttccgtacagatccagtatttcccagatggacagctgggtggagaacgtgaactgatcgaattgacacagtcaggagcagtagatttcacaaaagtaagtgcctcagcgttggaaagtttctctaaagattattcgattttttcagttccttatctattcaatgatgaagaacatttctttaaggtgatggataatgaagaaataatggaaccaatctaccaatcgaccaaaaatttaggatttaccggattgacctattatgattctggtcagcgcagcttttatatggtagacggtccgatccatacgccggaagatttgaagggaaagaagatccgtgtgatgcaaagcgaaaccgctatcaaaatggtagagcttttaggcggttcgcccgtacctatgggaagtgatgaagtgtacacgtctcttcaatccaatttgatcaacggatcagaaaacaatgaatttgtcttgtatacagctggacatggtggtgtggctaaatactattcctatgatgagcatacacgtgtgccagatatcatcatcatgaatgatgccatcaaagaacagctaactgatgagcaggaaaaagccattgaagaagcagcgaaagaatcaacggtttttgaaattgaagcttttgcaaaagcaattgaagaagaaaaagctttagcacaagaagaacatggagtccaattcaatgatgtagataatacaccgtttcgagaggcagttgccccgcttcatgatatattcaaaaacgatcctacctacaaagacctttatcaaaagatccaagagcaaggagcgtagctgtgatgaaaatgattttaaacaaggtattagagatcctgggagctgttttgcttgttgggatggtcgctgttgttttatggcaagtattttccagaacggttttaggaaatccaaatacggtcacggaagagcttgttcgattcggtcttgtctggtttgccatgttgtcttccgcgtatgttgtgggacaaaaagcacatttagccgtaacggttttaagtgaaaaattaactggcaaaaaaagtaaaattttagaagttgttgttcaaagtttatttctggtatttgctgcgatgatcatggtgtatggcggatggaatgctgtcacattgacaatggggcagatctcgccttctttaagtattcctatgggatatgtttatctgtcagtacctgtatcgggggtactcatcattatctatagcctgatcaatctaatcgatacattaagcaacaagccagcaattcaagaaaaaatataaaaatggaggaataaaatggcaatagaagccggattagtgttattttttgtatttgttgtgttgcttgtattagggatgccgattgctataagtattgcattctcatcgatgatgactttattgttagttataccgtttgatgtttctgcttttagttcagctcaaaaaatggtgggaagtatcaatagtttttcgctgatcgctattccgtttttcgttctctcgggcattatcatgaataatggagggatagctaagaaactagtggattttgcgatgttgttcgtcgggcgcgtgccgggggctttggctcatacgaatgtgttagggaatgctttatttggttccatctctagctcggccattgccgcttctaccgcgattggtggagtgttgatccctcagcaagtggaagaaggatatgaccggaagtttgcgacagcggtcaatatcgcgtcagctccgacaggtatggtcattcctccaagtactgcttttatcatgtattcacttgttgctggtggtgcttcgatctctgctttgtttatgggaggttatctcgtaggcgctttgtgggcgctaggaatcatgctagtagcattcatcgttgctaaaaagaataaataccctgttgtcgaaaaaggacagatggctcatgctggaaaaataataaaagaggcgattcctagccttctattgattgtcatcattatcggtggtatcttgacggggatatttacagcagtagaagcttcagcgatagctgtcatttactccctgttgattgctatgttttactataaaacggtaaaactaaaagatatacctaatatgttgtttcaatcagtagcaatgtcagggacgatcatgttcttattggctacttcttccatgatgtctttcgccatggcgtttaccggtattcctcaggcaattagttcgttgattatgggcgtaacggataataaatttattattctgttattagtcaatcttgtgttattactggtgggtatgtttatggatgtggcgcctgctatcttgatttttacaccaatatttttaccaatcgtcacaagtgtaggggttgatcctgtacattacgggttgttttcaatcatgaatctgtgtgtaggctccatcacgccgccagtaggtacaggactatatgtcggtgcaagtgtaggaggcgtaaaagcagaggcaatgctgaaaccgcttcttcctttttatggggttatcttagtcgtcttgtttttgattacttacttcccgcaaatcgtcatgtggctacccaatatgctgagttaggagaatagttatgctgaacattacaattagaggacatgatctttccgaagtccaaacgatagaagatcttgcagaaaaaacaaaagaacaagggattcatacactgcagctcgccttaggtctttcgtttcctgaaataccttctggcgcaaatgagatcaattctgggatgggaaattatgtcaaacgagttttagaaaagcaagaagtgaccgtaggaattttaagttgctatatcaatatgattcatccagatttaacgatacgagaagagttgctgacaaagttcgagcagtatcttcgctatgcttcttcctttggtgcgtcgatggttgcttcggaaactggatgtgttttgccggaaatccaatatacggaagaaaatttcacagatgaagcatttgctgaagcagtgtccgttatccgtcgcttggtaaaagctggagaaaaataccaaatgatggtggggatagaaccaggtttgaatcatccggtgtattctttagcaagggtagagcagctgatccaagcagtagattcggactatctaggaatcattttagatccgaccaatttgatcacaagtagtgattatcaagaacaagtccaattggtagaagaagcttttgaacgttttggtgaaaagatatgtgcggttcatttgaaagattttcgtgtcgaacaggaaaaaatcgtgccggtaaatttgggagacggtgtgatcgagtacacaaaaatcaaagaaatcatcatgaagaatcgtccgtacctgtatgtggttcttgaagaaacaaaagatgatgggattcgttatggaagaagtcttcttgaataatgtaaagaagacgttggttaactaatatttagaatggagggggcggggctagaagatgccacgtctcttcttttttataagagtatataaaagcagctctttttgattacaaaaaacgtggtataataaaattgtgcataagtgaacaaaaggaggtgcggcacatgctccaaaagaaaatcagcggtgaacaagtcaatacgatggtttctgatcagtatgaaatctatcatgtcaaagatgtcgtcagccaaaataaaacgatctatcatcatcatgatttctatgagatccatgctacattaaagggagaagcgactttttatttgaacggacgacaatttacgatcaaagcaggaagtgtgctgctcatccattccaatgatttgcatcgtatcgtccgccaatcttcagatgtattcgagcgtgtctatatctttgtcaccccttcttttctagaaagtcgttccacgccatggtctaatctatcggcttgttttcaaccaatgggagagaagaggagtcgtgtattgcaaatagaacaggaagtattgaagcaaaaattatcatttatcgaccatcctcctgataaaaaaatttacggtgaagacataaaatatgaacaagctctggtagaatacttgatttttctcaatcaagttgtacaaaaagaagagagtgcgcaagaacagaatgctgtagttcctaatgagcgtgtggaacaaatgttacaatatatctcaaaaaatttatctcatccgctttctttagaggaaatggaaaagcagttttttgtcagcaaataccatatcacacgagaatttaaaaagtacactggatttacgtttcatcagtatgtaatgaagaaaaagctgatctatgccaagcacttgttgcgagaataccgcagctctagtgctgtatatagtaaaagtggtttttcttcttatccgcattttctgaaagcattcaagagagagttcggcataacgcctaaagaatttttgaaacgtgatacacagaaacagttggttcattatgaacattttgaagatgaacaatgagaatgatcactaaaaaataaccgcagtagctgctgttgtttacatagaagcagaaactgcggttattttatttttatctatatatttcaaaatattttgaaaaaatgacgtacatattatatgaatcagctgaatttacgaaagtctctcggcgatagtcctgtttttgctttgaacaggcggctaaagtaagcaaaattctcaatccctatttcttcggaaatcattcgaaccgtaaattctgtataccgaagaaggtctttagcgtaagaaagttttttgctgatcaaataatcgattggtggagaaccgataaatttggaaaaatctttgctcagctgatatttattcaataagaattgttgttctaattgatcaagtgtaatcgtttctttgaaatgttcgtctaagtattgcttcagtttgtaaacgtaggcgggaatatcctcttcttcgaaatctagctgatacttttgcaaaatcagttcattcagcaactcgtggatagctacagaggactggaaatcggtacgggcattcgtgccttgttgcatgtggatcaattctgtgatcaaatggtggatcttgttttctgatggatcccctgttgaatggaaggtgttatggccgtcttttgtgaactcctgataaaatgattggacgttctgaccattcaaatggatccaatccatttcccatggttcttcgctgatcgtttgataacgctgatattcttggcagtcaataaaaaataagtctccagcttttagctgttgctgattatcattatatgtaagcgaaccttcgccagacaaagtaaactttatcaagtaagaaggtaaatgtgctcgttcagtatagtaagggattggtgctttgaagtaaccgatttcttggatataaaaaaataaattcctgcttctttgtgtaggcgtcaagatcactctttttgagtcttccgaccatgagtggttggctttttcccagtaatccatgtaaacactcccaacttgtcaagataatgcaattatataccaaaatagtgtgaagcaaaatataagattctgtattatgatagcattgttaataaatgataacgctttattaataaagtgctaatcaacaataaagtaaaagaggtggagaaatgaatccaacatttgttgccatcgatatcggtgcatcaagcggacgactaatgaaaagtacgagggatgcaaaaggttctttgatcttggaagaagtgcaccggttcaaaaacggctttcggaacaaagacggtcacgatcgctggaagatcgattatcttatcaaagagattttgattggatttgaaaaattaaagcagacagggattgatcgtctttttgcggggatcgatacatgggcagtcgattactgtctgattgacgaacaaggggatcggataaatgatccgattgcttatcgggacaagcgtaccaatggagcagtagaacagttttctgaaatctattctctagataagttgtatgagcagacagggattcagatccagcctttcaataccttgttccaattgtttgctgaagaaaaagaaaatttggcaaaagcacataaattgttactgatacctgattatttagggtatgtctttactggtaacatggtgacggagaaaactaatgcatctactatgcagctgctgaatgcagggacaaaagaatgggaaatagaacttcttgaaaaaatcggtgtctcgaaggaattatttccaccattgacagagccgggaacgatactaggagatctgcaaaaagaacaattttcaaaatatgatttgccagatgtgacctttatcacagtagcaagtcatgatacggcgtcagctgtattaggaacgccaggtcaaggagaacgttggggttatatcagcagtgggacatggtcgcttttagggattgaaacaaagatcgccaatgtttctcgcaatgctttttctgaaaattatacgaatgaatggggtgcccataacacggtgcgttttttgaaaaacatcatggggatgtggttgatccaggaagttgcccgaatgcaagagtacgagtacagttatgcggaattggcagagcttgctgcaaaagaaaaaccgctgcagcaagtgatggaaatcaatgaccctcgatttttgaatccccaaaatatgatagaagagattcagcaatactgttttgaaacagagcagccagtccctgtctcaccgggagctatcgctcgttgtgtgtatgataatcttgctctttgttacgcacaagagctgatcaaagtagaacacttaactggaacgaaattggaaaagctgcacatcgtagggggcggatcgaataatcgtctactgaatcaattgacagcagattatgccggaatcattgtagaagcaggtcctagtgaagccacagcaatcgggaatgttgccatgcaaatgctcagtacaggtcagttttcgaatatagaacaagcaagaaatgtaatcaaacagtcgtttccatgtgaaactttttacccagatgaaaataagcaaaacacgatggaatggtacgtgaataaaatcaaaggagtaatcgtatgaacacgattgaaagaaattacgaacaagcaaaagaaaaatatgcaactatcggtgtagatacagatgctgtactagaaaagatacaggacatcaaaatttctatgcattgctggcaaggagacgatgtcaaaggtttcttgacaccggatggcgaattgaccggtggaatcatggcgacagggaattttccaggagccgcacgaacacctgaagagcttagacaagatctggagaaagcttattcgttgataccgggcaaacacaaattgaatcttcatgctatctatttggatacagaagaatctgtcgatctaaatgaaattgagccgaaacattttgaaaaatgggtagagtgggcaaaaaaagaagaaatcggtcttgacttcaatccgactttcttttcgcatccaatgatgaaagacggctttacattggctcatccagataaagaagttcgtgaatactggatcgaacacgggaaaagaagccgcaaaatcgcggagtactttgggaaagaaactggacaaacaagtatcaataacttttgggtacctgatgggatgaaagataatccgattgatcgttttaccccacggaaacgtttaatggaatcactcgatgaaatttttacagaagagttagatgaacggtatgtacaagatgcagtagaaagcaaactatttggtttaggcgctgaagcttatacagtcggttcccatgaattttatatgggttacgggttgactcgtgacaaacttgtttgtctagatgctggacattttcatccaacagaagtgatttccaataaattatcttcattagctttattcagcaaaggaatcatgctgcatgtttcccgtccagtgcgttgggattcagaccatgtggttttgatggatgatgaattgcaggaaatcgctaaagaattagtccgtaacgaattgttggaaaaaacaaatatcggtctggatttctttgatgcaacgatcaaccgtatcgctgcttgggtcatcggtacgagaaatacacaaaaagcactgctgaaagctatgctggaaccagttgagcgattgaaagaaatggagctggcttttgactttacttcaagaatggcttatacggaagaattgaaagatttcccgtatgccgatgtatggaattatttctgttacaaaaatcaagttccagttggtttggattggctggaagaagtccaggaatatcaaaaagacgtgttggaattaagaaaataggagtgtggctatattgaaaaaaatagatattttacaagcgccttatgtgaaagaaatgatcgaaacgacgtcgaatctttatcgcttgggatgggatgaaagaaatggcgggaatatttcttatttactaaaagaagaagagatcacaccgttcttggatcctgaaaaagtgatccgccgcatctcgatgatttttgatgccagccgtttagcaggatgctattttattgtaactggttcaggaagatattttaaaaatgtagcgagcgaacctgccgagaatcttggaatcgttcgagttgctgaagatggcaaaacactggaacttttgtgggggctggaaaacgaatgccttcctacaagcgagttgccaagtcatttcatgagtcatatcgcccgtttagaagtagacccagataatcggatcgttatgcattgccatgctagtcatctattagcgatgagttttacgcatgaattagacgaacgttcctttagtcgtatgctatggcaaatgtgtacggaatgcttagttgtttttccagaaggaatttccatcattccgtggatggttccgggaacaaatgagattggggaagcaacagctgaaaaaatgaaagaaactcgattggttttatggccacaacatggaatctacgggtcaggaaaagacatggatgaagtctttggtttgatcgagacagcagaaaaagcagcagaagtctatacgtacgtcaaagcgcaaggaccaatcttgcaaacaatcacggacgaaaacctgtggcatttagcagatgcgtttggtgtcactccaaaagcaggttatttggaggaagttcatacgaaagcaggtgtctgacatggtgaaaaaagctttttgcatgaaagtttacccagaaaaacaagaagaatacaaaaaaagacatgatgaactttggccagagatgcgtacagcacttcgtgaacacggggtcatcgactattcgatctatcttgatccgagtataagtttgttatttggttacttagtgatcgaagatgaaaagttatgggaaaaaatggcaaatacatctatcaatcaaaaatggtggaagtacatggaagatatcatggagacaaatccagatgcctctccagtcagttgggaattgatgccagtctttgaactgtagtaacaagcaactgggcaaccggttgtttggggttctttcgtttttattgtgaaaaataatacaaattaggaggaataaaaaatgagtaatcgaatgattttaaatgaaacatcgtattttggaaaaggagcgattgagtcgatcgtccctgaatttcagcagcgaggattcagcaaagcagctgtcattactgacaaaggattgatcgagcacggtatagcaacaaaagtaacagaacttctagataaagcagcaatcgattatgctttatacgacgggatcgtacctaatccaacgatccaaaatgtaaaagatggagtggcttttgttaaagaggcagaggcagactgtttgatcgcaatcggtggaggttcgccaatcgatacggcaaaagccattgggattattttgacgaatccagagttttcagacgtcattagtttagaaggtgttgctgatacgaaaaatccatgtttacctatattagctataccaacgacttctggaacagcagcagaagtaacgatcaactacgtcatcacagatgaagtaaatcaccgaaaatttgtttgtgttgatcctcatgatatcccaatcgtcgcgttcatcgacagcgatatgatgatgggaatgccgaaaaaattggctgcatcaacaggtatggatgctatgacgcatgctattgaagggtttatcacaaaaggcgcttgggaaatgactgatatgctgcatttaaaagcaatcgaaatcatcggtcattctttggaagcttctgtagatggcgatcaaaatgggcgagaaaaaatggcattaggacagtatattgcgggaatgggcttctcaaatgtcggtttaggactggtacacgggatggctcacccgttaagtgcatggtacaacattcctcatggcgtagcgtgtgcagcacttttgccaactgtcatgaaatataacaaagaatatactggagaaaagtaccgtgagatcgctcttgttctagggattaaaggagcagctgaaatgtctttagaagatgtaagagaagcggcttgtggtgagatcgatcggttgagcaaagcggttggaatcccagaaaccatttctgaattaggtgtaaaagaagcagatatcccagcaattgcagaagatgctttgcgagatgtatgcacaccaggaaatccaagagaaacgacagtagaagaaatcattgctttatatcaaagtttgatgtaaaaacgaagcggatcttcaacattaaattgcctgtaaagagaaatggtagtttatatctggatatctcttttaaattgatggtatttccgctataatttttcttataaagaaataggagaatattatatggaaaataaaaagccttatggaactgtattgatcaaagcctctaaaatactagactatttagcggaaaaccaagatgtctctttgcagacgatcgcaaagggtgtgggaatgacctcttctacagtcttgaaaatactagatactttgctgatgatcggctacgtaaataaaaattcagagaaaaactatcgtttaggtgcaaagcttattcgctacgcgaataaaaacattgaacaaatcgatttggtagagttgactttaccgtttttagaacagctgcagcaaaagatcgatgagactatccacttaggagtattggacaacaatgagatcttgtacgtgaacaaactagatccaaaacatcaaacgatccgcatgtcttcaaaaatcggaatcacccgaccattatacaattctgcgatgggcaaagccgtattagcagaattcagtgaagagcagtacactgattatcttgaaaagcatccgttgatcccttacacagaatatacgatcaccaatgcattacggttgaaaaaggaaatccaaacggtaaaagaaacccacatcgcatttgacgatgaagaaatcgaacgtgatattttttgtataggagcctcaatcgtgaaaaacgaacaaatcattggtgcatttagtgtaagtatgccgaaatatcgtttaacagatgagacaaaagaacaaataatcagtgccctcaagcaaacaaaaagcgaaatcgagcaaagaattcaaaaataatgaaaaaagcgtttgcaatttttcttttctgccgtataatatgggtatagatttccaagttataaaataaaatttctaaataggaaataggtggagaagatgaaaaaaattgatattttatctcgattgaaaaacgccggagtgattgcggtggtacgcggaaaaagcaaagaagaagctttgaatgcttgccacgcaatcatcaaaggtggtctaactggtattgagttgacttttacagtccctcaagcagatcaagtaatcaaagaacttttgtcattctacaaagaccaaccagaaatagtgattggcgcaggcacagtattagacgctgtcacagctcgcttggctatcttagctggcgcagagtatattgttagcccttcctttgatcaagaaacggcagagatgtgcaatctgtatcaaattccttacttaccaggatgtatgactattaccgagatcaaaacagcgctgaaaagcggggtagatatcgtcaaactatttcctggaagcgcttatggaccaagtatcatttctgccttcaaggcgccgatgcctcaagttaatatcatgccaactggcggtgtgagtctggacaatatgaaagagtggttcgatgctggtgtcgtaacagtcggagtaggtgggaaccttttagcacccgcagctacaggagatttcgacaaagtaacggaagtcgcgcaacagtatgcagcaaaaatgaaagaaatcaagaggtagctgcttatgggaaaagtagtgacactcggagaaatcatgttgcgattgtccacagaacagggaacccgtattgattcaagtaaacgattcgctgcccattatggcggaggggaagcaaatgtagcaatttctttagctaattacggacatgaagcgatttttgctacaaaagtacctgataacgcattgggaaaagcagtcaaaaagcacttgcaatgttatggagtagatacgaaacaggtattatctggtggaccaagactaggtacttattatatggaaactggtagtggcgaacgcgccgcctcagtgatctatgatcgtgccggatcaagctttgctgaaatggatcatttggaatggtcgctagaggagttattccaaggaatagatatatttcatgtttcgggaatcaccccagctttgtctaaaaaatggcaaaaaatgacgaaacaggtgatagaagctgcaaaaagagctggctgcctgatcagcttcgatatcaactatcgtggaaaattatggacacagcaagaagccagcgaagtaatccatcagcttttacctttagtagatatctgctcagctggaaaaatggatgctctttatttgttaggtatcgagaaagcgccagaagcagaagaacaacctctaatttattattatcaaaaaatgcaggaaaagttcccgaatattcaggtgttttattcgaccaagcgtaccgttcattcagcaagtgaaaatgaactgaaggggacattgtggatgaaccatgaatatgtggaatcccaagtccatagaattaccccaatcgtggatcgagtaggtggcggagatgcttttgcaggtggcgtgctccatgggattttatccaatatgtctccgcaagaaatcattgattttgctacggcagcttctgccttgaagcatacgatccatggggactgcaaccaattcagtcaagaagaagtcgcacaatttttagcatgcggctctggaaaaatcattcgatagaaggagtagaagaaaatgcaagaaatggaaacacgttatacacacagtccagaagatatccgtcattattcaacggaacaattgagaaaagaatttttagtagaaaaggtatttgaaccagggaaaatcagtttgacttatacgcacaacgatcgaatgatctttggtggagtgacacctactgaaaaagaattagaaatcacattagacaaagaactaggtgttgattacttcttagagcgtcgtgaactaggtgtgatcaatatcggtggaccaggattcatcgagatcgatgggcaaaaagaagaaatgaaaaaacaagacggatactatattggaaaagaaacacgacatgttgtattttcttctcaagatgctgaaaacccagctaaattctatattagttctgttccagctcatcataaatatccaaatgtaaaaatcagtatcgaccaagtaaaaccaatggaaactggtgaaggcctgacactgaatgaacgtaaaatctatcaatacatccatccaaatgtatgcgaaagctgtcaattacaaatgggttatacgattttagaaccaggaagtgcttggaatacgatgccttgtcatacacatgaacgtcgtatggaagcttatgtctactttgattatgccaatgaagatacacgtgtgttccacatgatgggcaaaccagatgaaacaaaacatttagttgtagacaatgaacaagccattatttcgccaagctggtcgatccattcaggtgtaggtacaagcaattactcattcatctgggcaatgtgcggagaaaatatcacctatacagacatggatatggtgcaaatggatcaattaaaataagcataagggagagaaaatgatggaatttagtatggatatgtttcgtttagatggaaaagtagcattagtcaccggtgctgtctatggtattggatttgagattgcacgctctttagctacagcaggagcaaaaatcgtatttaataacttgaatcaagaatcagttgatgaaggtatagcgcattataaagaagcaggcatcgatgcaaaaggttatgtctgcgatgtgaccgatgaagaagcggttcaagcgatggttcaacagatcaaagaagatgtaggttcagttgatattctagtcaacaatgcagggatcatcaaacggacaccgatgatcgaaatggatgcggcagacttccgccaagtaatcgacgtggatttaaatgccccattcatcgtttcaaaagcagttattccggatatgatcgaaaaaggcggcggtaaaatcatcaatatctgctccatgatgagtgaattaggacgcgaaacggtcagtgcttatgctgcggcaaaaggcggattaaaaatgctgacgaaaaacatcgcttctgaatacggtcaatacaatatccaatgtaatggaattggaccaggttatattgctacaccgcaaactgctccattacgcgaaacacaagaaaacggtgaacgtcatccattcgatcaatttatcgttggacgtacgccagcagcacgctggggcgagccaatcgatttggctggaccatctgtcttcttggcttctagcgcatctgatttcgttaacggtcatgtcttgtatgtggacggaggcatacttgcctatatcggaaaacaaccttaaaatagctttagtacactgtttagtggagaggttgtgaaatcagcggattgaacgaataccgaaggacagctgattaaacatcatttattcgaaaaaagaggctgggacagaagcatttaactccaagaaataagaaggaattcacgaaaattgcttttcaaatttttgtgaatttcagcttatttccgaaggagttgcttttgcttccgccgtttatacgtgtttagagcgtgagacaaaagtgttctttacttttgtcccacgctcttttctgtgcgtcttccatacttcactaagtcgatccctcttgcttcgcaccaatccttcactggtccggaaaagatcagagattgttggtgtagggccgcggtattcgttgcgccgaccatagtataaagcagacgaagctcttcttgccattgcttcatcagtataatagtttcttctacgccatgattcatcagatgcgtcagtacggttcctgaagtacccactgcatttgcgccgagacaaagggctttaaatatgtcataggcattgcggatacctccggaggctaggatttccatagaagtgtctgcttcatttgcttcaagtaatgaagaggctgtcgattgcccccagtcagctaaataactcagttcccgcttggagcgacgggcgttttcgatctgggtaaagcttgttccgcttcgaccgctgatatcaactgtatgaactcctaaagaagctagatcattgagcgtttctcttgtcatgccaaaaccgacttcttttacgatgagggggacgtcaatggctgtttgagtctcttgaataagtactttccaattggtaaaatcacggtctccctcaggcataaccaactcttgaggtgcattcaaatgaatttgtaaggcatctgcgtgaaacaatcggatagcttctttggctctttcgacagaagtccctgcaccgatgttggcaatgattttcccgtgaggatattcttgtcgcataatcgtataagtatcagctaaagaagggtctttcaaggcagcgctgactgaaccagtggcaatcatcaaatctgcttctcttgcgacgattgcaagatcttggttgattttttttgttttttcgcttccgccagtcatcgcattgatataaaacgggctacttagtgtaaaaccagctgtctgtgtgcttagatcaacatcagaaactgctatttgcggcaaagggttatggatgatccgtacgaagtcaaattcgtttttttgtttatcatgaaaggctttagctagtgaaacatgttcgtcttttcgattcatcggttttcctttctttgatcgctatagacatgtaacggcagtggagtgatttctgctttttcccatgcactcattaaaggaagaatgccagatttctggtcaacaattacgattccgcaatcgcccccacctgcaccagaagattttgcggctccttcatactgttcagctaaattacacaatttgttcaaagcaggcgtttcgatgacgaccccagtgattgcagataaatcatgcagtaattgtcggttttttcgaatcatctgttggatcaacgttacattattttctttaaaccctttgatcatttcgttgacacattctgtactgttttttaagaaaagctgataagccaccattttatcttctctcgaacggtgaacttgatcgaccaaatcagaagtagaggcagggctacccgtccaaccaatcaataaacgtaaatcttcaggagcaatcaatggctcaatggatagacctggccaatccagggcaagtaactcactgatagaatgctgagtttcttgttcttggagccaaggatggtcgaaggttgagaaagcgatccagccaccataacagctagcagcgatgtcgccgcaggaaccattatcttgaactgctaaattggctagtgctgcaatcttgaaaatctccaactgagataaattcaacgcgtaaaaaacattcaaggctttgactgttgcaacggtcacggcaccgctagaacccaatccatatttccggccatttgaactgtctaactcacttgttactttcagatcataaaaggataaaagaatgtttttttcttgtgcatacttttcagtcaagcgaatagcagcaaggatataatgaaaaggattttcccgaatatctaaaactaattctccgttgcgtcttgtccaacgtacaggcatcccactatattgtgcagattggatacttccgacttttcgtgcagattctacagtgactgtcacgaattgatcgactgcagcgataactgctggatggcctgtttcaacaactgcatattctccggcaatatagagtttgcctggtgcagatacttcaatcataaaaatctccctttattcaataatcgcaattcctggaccagcatgggcagtaattacttgttctttgctaaataatttggtaaatgtttcttgtacctcagataaatggctgttttccactaaaactttgacattagggccagcatccatcgtaaagtagcatggaatgcctttttttctcaattgccgcaccgcatccatcgcttttaagctgtcaggagaccagtaagtgaatggaggctgggcagctaaagtcgttccatgcatttttagtccgtttctttccatcgtttctccgagaagttggaaatcttttgttttgattgcttgtttcaattgatatagatccccttcaacggaatctaaccagccttgataaaaactggatgtttcgactgtccgacgcatcccatttctgctggacacttcttttttctggtcgttgatcaaaacgaaaaccattgctaaatcgtcttcgaaagaatcggaagggactggcttagcgtaagaacttaagtcgtcatggcctttttcccattcgacgaaaccaccgaaaatacttcggcaagctgaaccagacccgcgtcgagcaaatcttgaaagagagagatcgtctaatccaagcttaagagcagtattgcaagctcctgctaaagcagctagcccgctggcagaggaggctaatccagctgcggtaggaacgaaattctgactgattactgaagcttttagtgagaggccggcttctttacgaaaaaggtcaagaaactgactgactttttttgttgctttttcgtcttgcaaggtgccatctagataaaattcatctaccatatagctatcagaaaagatgacttctgtctctgtataaaatgcatccaatgttaacgaaaggctgttgttcattggaaggatgagttcttcatttttcttaccccaatatttgattagagcaatgttggtatatgcgcgtgctttgcctttaaacataggtatgtactcctaatccttgtatccaagtttcagcagcacccgcatcttcaagtgcttgactgatttcttgggcttttgtttttgtttgtgctaatgcaatcatacagccaccgcgtccaccgccagttaatttggcacccaatgccccggtatcttttgctgtttggatcaatagattaagaaaatcattgctgattgtcagcttttccagaagtgattgtgattcatccattgtctgtgccaacgtttctggtgaattttcaatgattgcttgttttgcttgcttcgtcaagtatcctaatttttggatcatttgtccagtttcatgaggctgggtttcaaagaggtgagcgacatctttgacggcttctcttgtttgtcctttgattcctgtatcagcgacaatcaaaaaagcatcgatgttcaaagaaaagtagtcaaaaggatgcccttttgtaaaataaatcggctgcaagctgctagtagcggctgcatcgattccactaggattaccgtgggcgattttttccgaaagctggacattttctaatagtatttcacgagacaaaggaaatgctaagtaatcataaaaagcacgagtgactgctgtggcgactgcagcgcttgatcccattccacgttcagcaggaatcgtgctttcaatagtcagttgcaagtttttttggatgtcatgctgtttttttaagtgaatgaataattttttgatattttttaatgcatgaggagcttcggctaaatttcctgaatagtaggaagaaaccagttgatcgtccattgcatccagctcttcaaggaatgcggtgacttttgttgcatagaaaggaaaggcaatcgctggttctccataaacaaccgcgtgctcgcccatcaatatgatttttccgcttgattctccttggccatagtttgccataatctaactccttctcacgtaaaagtgatttttaagcaaaaaataaagcgcccaaaacgagttgcgctgcttcacgaatttttttgtccactaagggtctcaaaaaacattcctcctttattttactaaaaccatctcagaagtaaaactaagaatacgttttctaaagaaaaaacacttttttcttaagaattttttgactttttttcttctttgactagaaaaaaatacaattgacactactagatattgggggtatatttaaaaaggttggagttaaacacaatatttagtgatgaagtgagctggaggtaaatgagcgtgatcgttttagcaggtacaattggtgccggaaaatcaagtttaacagaaatgatggctgaacactttgatagtcaggcattttatgaatcgattgatgataatgaagtcttgcccttattttatgcaaaccccgaacagtatgcttttttgctgcaaatttattttttgaataaacgttttgcaagcatcaaacaagcaatgaaagatgacaataatgtattggaccgttcgatttatgaagattcgctgcttttccatctaaatgcagatctaggaagagcgacggaaacggaagttcgtgtgtatgatgaactgctggaaaacatgatggaagaactgccctatgctgcccataaaaaacacccggatttattagttcatattcgtgtatcttttgatacgatgttggagcgtatcgaaaaacgtggtcgttcgtatgaacaattgtcctttgatccaagtctatacgattattacaaagaattgaacagacgttacgatcaatggtatgaagaatacaaagaaagtccaaaaatccaaatcgatggagaccgctataattttgtggaagatcctcaagcaaaagaagaagtcttgaaaatgatcgaagaaaaattagcagagattcgccaaaccaaagtagccatttgatttacagttgctcaaataaagggtaaacctttatttgagcgacttttttctttatactggaaacaaatgtcaggaggatagagtatgcgggaaaaacactattttaatcaagaccgtaatttttggatcaatgtacagcaaaacgatgtgctagctgttaaaaacttaaaagaagaatatggcattagtgacgagatgctgacttattctctagataaaaatgaacgggcgcgcgtagagtacgattcttttgatgaagcgttactgcttgtatcaaatgttccgcaccagcaaaaagtcgataatcattatgaaactagtcctatcgcttttattttaaaagaagacggtttgtttacatttaccacgccgaataccgagtacgtgattcgactaattcgatcgcttttggaacgaatgccagacatgagtgtatacagtttattgtttcgtacattgtttttgatttctgattccttttttcctttaatcgaggaagtgaatagtgaacgtcagcggcttaatctgaaattaagagaaaaaacaacgaacaagaatctgctgcaactttcagatttagagatcggtttggtttacttagttacaggaacaaaacaaaatgtagtacttttagaacaaatcaaggcattggctatttatcgcaagttgtcagaaaaggaaaaagaagagttggacgatgcactgatcgaagcacgacaagcagttgaaatgacgaacttagcttcgcagattttagaccagctctctggcacttataataatttgctgaataacaacttgaatgacacgatgaaatttttgacggtctggtcgctgatcttgaccgttccaactattgtgacaggattcttcggaatgaatctccagttaccctttacccattccgttttcggatggggaattgccttgatcatcagtttggtcttatctatttggatgcttattgcactgtggcggcggattcgttgatctagtctttgatctgcaaaccaagtgcttgggcgatcacaagtgcttgctcttggttgacgattagtcccgccaaagaatcttgagataaagcgattgctgtgaagaaattagtcgtaaagtctaatcccttcagagaagttcgaaaccagttcgaaccggttaactgattgtcagacaaaaaaaggtttttccaagtgacctcataaaattcgctgtcttctaattgacaatgatcgaaggagacagctttcaagtttgtactactaaaggaagccatcgaagcaatacaatcagtgaaagtacagtctcgaagataactttcggcaaaattcgtacctgttaatttacattgatgaaacacgacttggtggaaactgccaccaatccactccagattggaaaaatcacatttttcaaaaatgacattactgcattcaaaatgacgtaaaactgttttttgcatcgtaagtttttggatatgactctctcttaataccatatttttggcatcgagatagctttggtcacccccgttgatcagaagaccagagaagatctcctcatcttctaaataaaactctccctttgtaagaagaggaagagaaggtggaataggttcgatttttttcatgtgggttcacctcgtttttctttagtatagcaaagaaacgggaatcactgctagaaagtctgctaatctaatcattttcagaaaaggaagacaaactgtatgaaaaacattgacaaaaagattagtttttgctatactatgatagttgagaaataaaagcagaagcacccgcttctcgccttagttgataatgtcactgggctagatagttttcactggttctattaggtgaagtacgcgcgggttctgtaagagaactcgtttttttattgccgtttattcggtaagcttttctttctctcataatatttggaggtgaatgaccatagcaaaggatatgatggttaacgacggcattcgtgcacgagagttacgattgatcggttcagatggtgagcaattaggagttaagacaaaagcagaagcattgaatattgcagaacaagcaaacttggatcttgtgttagttgcccctggtgcgaaaccaccagttgcgcgaatcatggactacggtaaataccgtttcgaacaacaaaagaaagaccgcgaagcgcgtaaaaaacaaaaagtgatcaatgtaaaagaagttcgcttaagtcctacgatcgacttgaatgacttcaatacaaaacttcgtaatgcacgtaagttcttggaaaagggcgataaagtgaaagcttctatccgtttcaaaggccgtgccattacccataaagaaattggtcaaaaagtcttgaatcgcttagctgaagaaactgcggatattgcaacagtggaacaaaaagcgaaaatggacggacgcagcatgttcttgacgctggcaccgaaaaacgacagtaagtaatttgaatgactaactggctgttggacagccgatagtcggataacgaaagattttgaggaggaaatatagtcatgccaaaacaaaaaacacaccgcggatcagcaaaacgtttcaaacgtactggtaaaggcggattgaaacgcttccgcgcgtttacaagtcaccgtttccacggcaaaacaaaaaaacaacgccgtcaattgcgtaaagcaagcatggtttctagtggcgacttcaaacgtattcgccaacaactagcaaaaatgaaataagaagtacaaataacagaatctgaagatttatttttattaggaggaattatacatggcacgtgttaaaggtggaacagtaactcgtaaacgtcgtaaaagagtgctaaaattagcaaaaggttactacggttcaaaacacactttatttaaaacagcaaaagaacaagtaatgaattcatacaactacgcatatcgcgatcgtcgtcaaaagaaacgcgacttccgtaaattgtggattgctcgtatcaacgcagcagctcgtatgaatggcttgagctactcaaaattaatgcacggtttgaaagttgctgaaatcgacatcaaccgtaaaatgttagctgacttggctgttaacgatgcagcagcatttactgcattggctgaccaagcaaaagaagctttggctaaataagctaaacaattataaagaggaaagaagataacgaaaagttatgttctttcctctttttttatttacaatcctccatcaaatgaaacaggacaataacgtataagtctaaaatagcataattaaggttttttaattgaaatccgaacatttatggtcatcctttaatgaaagcgctaactacataagttagaatgagtttgactgatatattagtttgtttatcagaaaaacaaaatggacggaggaataacatgagtgatattattattggtattttgttagttatctcattctttttcatggtctggtactgtgtaaaaggctacaacttgatggtcggctttgccatcatggctactgtatggatgggattagcgctagtcggaaacacgttttcaccaaacccggcgatggaagggcaaggagtaattgatgtgttgacgcatatctatacgacggggccagctgagtacgccaaatcgatcttggtaaatgtcttctttggtgcctttttcgggcgtgttctagtagatagcggaatcgcagctaccctgattcgaaaggtagttgaacttggaggggacaagccaagaatcacgatgagcttactatgtattgtaaccgctgttatattcatgtcgatgacaggaatcggaccagtgatttctattgcagttattgtgttgccgatcttgatgtcattaggtatttcagtaccggttgcactgttctcatttatgggctcgattatggctggaatctttgctaatatcgtcaatttcaaacaatatcaaacgatttatgctggtttcaatccagcggctgaaagctatacttataatgactatttccaaattggtatgattgggatgattgtaagcttagttgtggtactaacggtcgctaatatatcaatgaacaaaaagaaacgctatgcaatggcagcaaacgtaccagctgaaggtggcgacgcaccaatgatctcatggttagccgtattattaccagttttaggggtcgttcttttagatcttccaatcatcttaggttttattctagcaggtatctgggcattgctgtttactggaaaattgcgcggaggttataaagaaatctgtcgtcagtttgcgaaattatttacagatggcgcagtcgatgttgcaccaatggttggtttcttgatgaccttagcgatgttcaataattcagctgcgtatgcttctccttatttttcagctatttttggagattggataccgcaatcaccattagtcttggcaatcgtatttgctatattgacaccactaggatttttccgcggtccaatgaatctagtcggttcaggctcagctattttagctgtcgtgttagctgttaatccaacgatgtcgccagcctttttgttcccgttatttgcaatcacaacgattgctcctcagcatttagatattacacaatcttgggttgcttggggattaggttatacaaaagtaacttctcgagaatatatgaagaaatccatcccaactggttggatcatcggagcgatcttatgcctgatcacgttcttattgtacgggaacgcctagtaaacaaaacgtcgataaaaacgattagatgaatggaggaaaagaaaatgaaacgttttgtgcgaatgggaattgatgttggcggtacacatacgaaagcagtcgcaatcgataatgcgacgcacgaaatcatcggaaaatcttcagtgaaaacaacccacgatgatgtccgtggagtagccgcaggtgtcgttcagtcttttcaaaattgtttgcgggaaaataatatcagtccagaagatgttgtgtttgttgcacattctaccacacaagcgactaatgcactgattgaaggagacgtagcaaaagtcggcgtaatcgggatggcaaaaggtggattagaaggttttttagcaaaacgacaaactagattgaacgatatcgatttagggaataagaaaaaaatagagattgtcaatgcattcttacctgtcaaacacttaaatgtagaccgtgtttcagaaacgatttcttctttagaaagagaaagagcggaggtcttggtttcttctatggcatttggagtagataatggagaaccagaacgagttgtttatgaagcagcatcggtaaaagcgatccctacaacgatggcttctgacatcacaaaattatatggattgacaagaagaactcggacagcagcaatcaacgcatctattttaccaaaaatgctagatacggcaacctcgacagaagactctgtacgagaagcaggggtcaatgtttctttgatgattatgcgcggagacggtggagtaatggaaatcaatgaaatgaaaaaacgacctgttttaaccatgctttccggtcctgctgcatcagtcatgggctctttgatgtacttgagagcgtctaatggtgtttattttgaagtaggcggaacaacaaccaatatcggggtcattaaaaatggacgtccagcaatcgattattcaattgtaggtggccacccaacatatatctcttcattagatgttcgggttctaggtgtggcaggcggttcgatggtacgggctaatcagtcaggaatcatcgatgtcggtccacgttctgcacatattgccggtctagattatgcagtatttacggagacagaaaaaatcaaaggtcctaaggttgaatttttctctcctaaagaaggagaccctgctgattacgtcaaggtagtgatggaagacggagaagaagtgactattacaaatacatgtgcagccaatgttcttggattagtgcaagaagaacatttttcttatggaaatgtcccatctgcacgaaaagccatacaggcattagcagactattgtcatacgacggttgaagacatcgcagagcagatcatggaaaaatcctatgctaagattgaaccggtgattttagaattggcagacaagtatcacttggagaaagatcagatttctcttgtaggtgtagggggcggcgctgcctcattgattacttactttagtaataaaatgggtgtgaaatattcgattcctgaaaacgccgaagtgatttcttctattggtgtagcacttgcaatggtccgagatgttgtagaacgtatcatcccttcgccaagtaaagaagatatacgatcgttgaaaaatgaagcgatgaataaagcgattgaatcaggcgctacaccagaatcgatcgaagtccacgtagaaatcgatccacagacttcaaaagtaacggctatcgctactggttctacggaagtgaaagcaaccgatctaaccaaggagatcacaacagaagaagcactagagcttgctgcagaggatatgcgattaaataaaaatgaagtttgcttattggaaaatacacctttcttttatgtatgcggcgaacagaatcgttcaaaaaatgctggaagtcttcggatcatcgatcaaaaaggatttatcaaggtccaacgtggacatgcttcatgtatgaaaacaactgcagccaattatatgacagctgtcgaacaactttgggaagatatggcagtttatcaaactgaattgattgcccgaccagaattttatctctgcttaggagcaagagtctctgattttacagcgacggatctggaacaactacagcttttgatggatctggaagtatctactatggaaccggaggaagaagtgatcgtcgttgccggaaatatcaaacaaacataagttagaagagttactaaacgaattacaacagatccccgaagaaatttggggattctaccagtttcggcgagatttattttggaaaaagattcctttgtccaagcagaaaattcttatacaaaaatcaatcgattgtggtatcgaaacggcatgtagcatcaaaaaaaagtacccttttgccgatgtaggagaaatttgtgaacaaatggctgttccaatcgtttcctgtgaatcagagcaaataaacgaacgaatcacttttgcaacttatgcagaagatgaagggatccgattgatgacggagccgttagaaaaattaaaatgttcaggactagcttcgatctctaaagaaacagcgcaagctttgattattggacatgaactatttcaccacatcgaagcttctgttaagggaatttatacgcaaagcgaaaaaattgtgctgtggcggttgcctttttatacacatcaatcaaacattcgtgcattgagcgagatagcagcgatgagtttttcaaaagagatgaatcaaagcgatttttcgccttatgtattagaggcagtcttactttggccatataatgaaattcgtagccaagggatcttagaagaaataaaaaaaatagaaaaaagatgtacggagtatgatttagattacaaataaagagactgtgacaaaagtcgtgtcacagtcctttttttccgaataaacggtgttctcctgtcaactcctcggtcacaagtcaaaatattcaacaaacatgagaagctgttttttgaaattgttccttgtgactcggagatgaacggcaggctcacgacctcttggaaaacggtgttcaaaagcttgcatctgcggtaataagtccagccaagttaaaaacataagaagctatttttacttggctgttcttattacttgatgcagggcagctttttcacaacctctcaataaacggtgtgcaatcagctgaccctcggtattagctcaaaaaaaaacggcaaaatatgaggaactattttgccgtttctttctctaatgctcaggtcaaaacgctgattccaaaacctcttatttgatgggtctgtcctgaatatcttcaaaataatcggggtaattatgaatcacgtattcttgctcctcgataatcatatgtaaatgcatcgtgcaaagaaatccgacttcatcaaagttatgatcaatcattgattgaagcattgtctgatgttcatctaatactcgaccccagtctaattctgaaatcgtcaaacgtaaccatctgaaacggttcaagtgcgtactataactttctagccaatcccaaatttctcgttttccagcaatttcataacaagttcggtgaaaatcagtatccaaatcaaaaaaagcttttttattttgagcgattactgcctgatcggtttgttctagtattttttctagtttagcttgatcttgcttggtcattttcgcactgcattcttgcaggatcggtttttccaacttttcccgcgtataacgggctaatgaagcagatcggatatcgatttttgaaacataagtgccggactgtggaatggtttttacaagctcttgattgcgcagttggatcagtgcttctcgaatcggtgtacgcccgatagctagttgttcttctaacactttatcggagattttacttccaggtgctaactcggaataaatgatttgtttacgtatagattcataagcttgctgttgcaaattattgataaccatttaaccttcctttctatgcagatataatctattataacataaatcgcttacaaatcgtgtgggcataaaaacacagtctgcaaaaaaagccctgataggcatgcctattagagcctcgaaaagaaaaatattgaatcaatctggtcgtacctcttggatcgatttgacacgaccgccgattcttttagcaaaagcttcggattcttttttgtctttgaaaatgagcagattgtctaagtttttttcccgagtgcgacagccagttttatcgatgtaaccgtgcattactttaacgacatacatggggatcacctgcttttttcttttcattatacgaactactcgacacaatacaagaaaaatgcttagacggtctttattaagaatttacatcattcaaagaagcgtacgcttggaataactgatctaactccggattgactttgctcagcttcactaatcgctgcgaatcagaaagtaaaaaacagtgtttactactgccagtagtttttaattttttgtcttcagttcccacaatttcgtagctaaaatccaaccgtgtccccgtatacttttggatagttggatggatgctcactttttctccgtaatggatcatttctttatagctgcaatttacttccagaacggggatgatgatcccagattcttcgatttttttatagggaaaccctagatgtaccaataaggctacccgagcctcttcaaaccagcggatataattgctgtgatgaataatccccatttgatctgtttcataataaaaaggttctcgcacataacctgtaaatttctccatgactcatgcctcgttttccattgattttttacaaaaataattcatccatttcggaagtgcttcgctgatttgtgtcggcaaaacaatatattgttcttttgccagctggtctccaatgaaactatgaagataaacagctgctgcaatcgtttggtcattttgaggaaactgggctaaaaatcctgtgatcatcccagctaaagtgtcacccatgccgcctgttgccatagcagcagaacctaaaggattggtgtagaagtgctggtgaccataaatttttgtctcgtgacttttcaaaacgagcacagcaccgatttcctgttgcttctttttgttttcttcatcccgttgttcttgtatcggtagagaactcaaccgttgccactccatttgatgaggtgtaagtacagtttgttcgggatagggtagcaaaagatgattagcagcaagtaaacttaaagcagagccatcaatcaccagccattgttcttttgattggttttctagtacttgtttgaaacgttccaaactcttagaagaagtacccaatccgggaccaatcaagagtacatctgcttgctttattacggaaagaaactggtcagtatccgtccaatctacaatcattgcttctggcagatgactgtgaagagcactccgatttttttcatcagttactacagtcgtgagacccgctccagtgtgtacggcagctaaagcactcataatgattgctccgccatattgttcattgccgccaatcaaaacgatacgtccaaatgttcctttatgtgaaatttttggacgaggtgtgatgactcttttcactagttgttcgtttatcagcatcgaaaaacctccttttactcattatagcgtatattttttttagagaaaaacagataagaaaaggaattgtcagattttttgaactatttttttctgtaatttgtggtatcatgaacacgaagacttaaataagtggaggattaactttatgacaattgattggcaaaaagaagtagaagcacgtaaagaagacttgcttgaagacttgaaaaatcttttacgtgtcaacagcgagcgcgatgactcaaaagtaacaccagatgcaccatttggacctggacctcgcgacgcattgaaacatatgttagcttatggcgaacgtgatggatttaaagtaaaaaatgtcgataactatgcagggcatattgatcttggcgaaggagacgaaacgctagggatatttggacacatggatgtcgttcctgcaggagatggctgggacacagatccttatgaaccagtaattaaggatggaaagatctttgcacgcggatcaagcgatgacaaaggtccaagtatggcagcttactatgcgatgaagatcattaaagaacttgacttgaaactatcgaaaaaagttcgcttcgtagtcggcagcgatgaagaaagcggctggggcgatatggcttattatttcgaacatgaagaagaaccagattttggtttctcaccagatgctgaattcccgatcatcaatggtgaaaaaggaaatgtttctttagctttacgattcaaaggcgacaatgcaggagattatgtcttgaaatcttttgtttccggacttcgcgaaaatatggtgccaggaacagcaactgcagcacttcaagtaccaagtgcagatgcagctatcgcgatggaagaagcattttaccaattcatcgaagcaaatccagtaagcggaacgattgaagcagacaatacgtatgtaaaaatcgaattagttggtaaaggcgcacatggtgcaagcccacaatctggtatcaatgcaggttctttcttggcattgttcttagataactatgaattcctaggatctgctaaacaatttatccatgtagcagctgcttatgtccatgaagatttttatggagaaaaactaggagtcgcttatgaagatgaaaaaatgggcaaattgacaatgaatgctggactatttgcttttgaagaaaatggtacagaggaagcgaacttcatcaatatgaatttccgttttccaaaaggtgtaacagtagacggattgcaaagtgacatcgaacaaacagtggggcaagaaggcgcaacagttactcgaggtgctcgcgtaatggaaccacattacgtaccaatggatgatccattggtggctacattattgcaagtctatgaagaccacactggagaaaaaggctacgaacaaatcatcggtggcggaacttacggacgtttgttgaaacgtggcgttgcttatggagcgatgttcccaggatatactgatacaatgcatcaagcaaacgaatttatgagtcttgatgacttgttcagagcaacagcaatctatgcagatgccatctatcgtttggcgaaataaaaatactaaaaaactccggctatctctgacagctggagtttttatgtttaaaaatgaattagtacatcggtattcttaaaagtaatttagttcgtcttttgatttctcaggagggatcaaaaaggcgaaagcactaagtatagcaaaacttgtgatgatttgcgtacgatacgtaaaccaataatgaatctgtgagtgattagctaaaatattgtaccaaatatacggcgttacagcagctaaaacaaacaaaactagaagttggaacggacgccagctatttcgtttacgataagcaaaatagagaaaaacaagacaagtaatcaatagcaataatattgctacttttggatacatcaatctaatattgcttttcagcatctctaatcgatgcaacgggtatttgtcgtttccttccgttcgaaagaggatttggttgattgcatcttttacaatgtttttgttcaatatgatcgatgataggatccatttagccacccatgtcaaaccatagcctaatccccaaaagataccggtaaaaacaaaactgcctacttgtttgctcaatgaactgcgtttatccattaaatacttatttgttacataataaataatgatcacaggtatcccccaagagatgaccggtgttgtcaacaagtcaaaaaagttagctaaagaaccaatgacaaagaaatacaagaataattgttggttggtgttggagagttgtggttttgttaaaaatagtaatacagacaataaagtcaaaatccaaatatttgaaaattgcatactgaagaaaaaggttgcagcatttcctatagcaagcgaaatcaacaaggctgtcgttaaatagatgtcgctacacttggttaaaaagtagctcgtcaatccaatcagcagaaaaagaatagctgcgtaaatcattcgaatactccccaaactcatccctagcagtaaaggtcgtaaaaaaagctgataaccatgccaataacggggataatccgccatagacatcgcgttctccaaggagttcaattcaggatctgcttttgtttttcgtatcatcaaatgatcagtaaaattatctaaccgagtgcctagcatatttccttgattgatagaaggatacattccttctttttcaaccatctgtagagatttttctgcattcgattcaatagagtgctgcggaatgaaaaaagtaattgtcagtagtacgcaatagctagcgatcaagagaacaaaagcaaaaaatatctttttaaatagtttcatgagtatctcctatatctgttttcattttttctcttttatctagtaaaaaaggagagaggatataaacaggtagacctaatgctaaaacaaacacataccgtaaactaaaagccacaggagtagcaatcataatagtagcaaaaacaagcataccgggaagaaaaaggagtaaataccgatattttttcttaaagattgctaaaagtgcactgccgatagctaaccacagtaatgtgccggaaccaaagaaatcacgagcatcgatgatttttttcattcctgacaatccagtaagatgttcaatcaaatctacttgcttcatcccataattattcgtgtttacacgagtatctaaaaagccgtaactattttttgtaccaggtacccagaacccgaacgtttctaaaatataagcatctgtatagatttttatattacttggtaaatttcttgcccatagtgatagaaattcttttttatgtgtattcaaaaactcattgttaaaatttttatgccacttgattgagtctgcaagactaggagaatacgcttcataatcttttatcgggagtagctgattcatgaatgctttatctttcttagacaagtcaccatccataacaatagttctagaaatttgctgcaaaggaacacctaattgttcagcagtttctgtaggaatagcataacgagccatcaacgggtggatgagtagtccagcaatcactgtataacccagcaccacttgaaagaatgcttgataccttttttgtttcaaaataatcaagccgcaaatcaaacctgtgccggttactacataaatcccattatttcttagataggtggtcagtaaagcaaggatgattacgtaaatctgattgagaatcgttggcttttctcgttgaaaaataaagtcaaaaaccgctaaggaaaataaaaagcaagcgatagaaaacaaagtatctttttgcatgttcaaggcgtagattggaaaaaccggtgcaaatgcaaaatagcataaactaatgagtaccggaaaaaaatggatgtttctttttaacagccagcaaagagaataacttatcgctgaagctgttatcaatgtttgaaaaatcgaaaataaaaatacaccgtgattgatcgtatcagttggtaaatcatgaacaaatagcttgaccagtaaggtgaataagactggatgatgattgcttataggaacatcacccatagattgggcgaccgaacttaacgaatcaggcaaaaccactccaggatacaatgccaacagataaggaagccaacacagaactaaaaagacagtaaagaataaaaaatattttcttgaagagaaagcctgtgtgttttgagcagtaaaaaatgtttccagttttggcattgataaataaatcgattgtaaaaataaaaaagaatacacaaaaatggagaaataaacaagaaagtaaaaaatacttccatcagcaatcgttgtctttgtatagtttgctgagacatactgaaattgtatctgtctgccaatagaaagtgtaagagcaaaagctgcagaaaaaaacaatcgggcaatagctgcaactttgttttttattgaaaacaactctattccatattgcttaaaagcaagtagcaaaaccatggctaaaccaatgattactgttggattcaaagttcctagaccataagaagtaaaaaaagcaaaacctgacgcaaataaagttgcaaaaaaagtaggaaatagattctcctttttcttatgcataaaaaaggcctcctacttcatttctttattttgatattcgtggtagacatggtataaattcaattcatattctttcttggcatttgtgacgaccgtatccaaaatcaaccctgttactaatgaaagaagggctaaagtcatcaatccagtacttaaaatcgcagaagggatgcgtgtaataaagcttgtcagcatatattcacgaatcacaggaatccccatgaccaatccaaataaaaagaagaagatggtccagatcccaaagaaaagcaaaggtttataatctttgcacattttgatgatcatcatgatcactttgaatccgtcagagaatgtattcaattttgattcgctaccttcaggacgatcgcgataatcgattggaatctcaacgaacttgaattttttatctaaagcatgaatcgtcaattctgtttcgatttgaaaaccagaactcataatagggaagcttttgacaaaaattcgattgaatcctcgatagccggtcatgacatcgcgaatttttgttttatataagtaagtaattgtatttttaaccagattattcccaaaatcatgaaaaggacgcttattttcatcaaaataggttccatttgatagacgatcgccaatgaccatatctgcttcgccagaacgtaatttctcaagcaaaccatgtgcagcttctgcaggataagtatcatcaccatctaccatcaaataataatcggcatcaatatcaaaaaacatttgacggattacatttccttttccttgacgtggttctttctttacgattgctccaccttgaacggccaattcgtatgttcgatcggtcgaattattatcatagacataaatatctgcttctggtaattcccttttaaaatcttcaataacagttgaaattgtcgcctcttcgttataacaaggaatgagcacggcaattttttcacgtgattccatttgtcactctccttatataataaaactaatcttatttcaagaataccgtataataactataaatactagctattccaagaggaaatagccctatttttataaaaatcacccactacaaaagaaggacatgatacctctcttttgaatagtgggtgcgtattcgttctctcacttttttgacgtattaatctgttgcacctttttttcttgaaatttctaatacggttcctgtatgagcatctgctaaaaattcataataaacagtttcgccatcttctattcgagaaagacctccccgataagcactcgaccgaacggcgaatttcctaataggttccttttcaaaagagatccaagaaccttcgattgcaccttcttttagaaaagatgacttgatattttcaagtacttggtctgctgacaatacttttttgcgatgataccaaatcgttgaagctaccccgctcaataatcctagaccgattccaactgctaacccgcctttaaaatagcttaattcgctttcttcatacatgtggatatacctccttcttctcacttgctactccttgtgcttattttaccacactctcatattttctttgaaataaataaccgctaccagaaaaaataagctataataaatacaatcggtctgcagaaaaaatcatattttatccgcagatcaatataagtctgagaggagtttagtctgaaatttagacgaatagcatatggaagaaaaaacatttcaacgaatcaaagagttaacagaattacaaggaacaagcggttttgaacaagacgttcgcgcttatatggaaagtcatatggaaccgctggtagatgagttacagttagatggtttgggcggcatttttgggctgcgccaccatgaagaagcggatgcacctcgtgtaatggtcgcagcacatatggatgaagtcggattcatgctgacacaaatccaagaaaacgggctttttaaagtcgtacctctaggcggctggaatccttacgttgtttctgctcagcgttttacacttaaaacctctactggtaagaattatccatgtatttcttcttccgttcccccacatttattgcgaggaacaagcggacaaaaatcagtagaagtaacagatattttgttcgatgctgggtttgaatcaagagaagaggcaatgagttacggtgtccttccaggagacacaatcgttccttacgctgaaacgatcaaaacagccaacggaaagaatattatcagtaaatcatgggacaaccgctatggctgtacaatggtattagaagctttagaagcgttacaaaatgaaacattaggtcatacattgattgcaggcgcgaatgtccaggaagaagtaggcttgcgtggttctaaagcttctgtcaataaattcaagccagatctgttctttgcagtagactgctctgcagcagatgacacagtgacgaaaaatggcacattcggacatttaggagaaggtacattgatgcgtatccaagatccaggtttgatcatgcttcctcgtttgcgcgagtacttgctggatatcgctgaaacaaacaatatcccttatcaatactttgtttcaaaaggcggtacagatgcaggtgctgctcatacacaaaacgaaggaatcccaagtacagtgattggcgtagtgggacgttatatccatacgcatcaaacgatgttcagtattcgcgattttgaagctgcacgagaaatgttgattcaaacactgaaaggtttggataaaccaacagtgaatacgatcgtatacggaaaataatgcgatagtgaaactataaaatctggcaaaagattgcttttgccagattttttttataaaaagaggatcaatgtttgttagttcgaaagaaaggtgtataatttaattgaaaaatacataaacagaaagtagaggacaaagaatgattatcccaaatagtttagaagaattagcaggctacgtagaaactggaaagagtgtatttttctttactgccggctggtgcggagactgccgttttatcaaaccgcaaatgcctgaaattgaaaatgacttttctgattggcaatttattgaagtagaccgtgacaagtacatagatgtagccgctgaatggaacatttttggtatcccaagttttgtcgtgatccaagacgggaaagaattaggtcgtctagtgaataaagatcgtaaaacaaaacaggaaatcgaatcgttcctagaaagtgtaacaaaaggctgacatctgttaggaggggtcaagatgaatcaagaatataagaatattttagtaggtatcgacggtagtgaacaagcacttgctgctttcaaaaaagcggtagaagtggctcgccgtaataatgggaaagtatatgtagcaaacgtaatcgatcagcaattttataactttatgggctatgcacctattgatcaaaatctagtcgatcagcaaactgaaacagccaaggaaatgatcgaagaatgtaaagaatatgggaaatctgttgattacacaaatatagaaggaattattgcatatggctctgttcgtgaatccatggcagtcaaattgccaaaaaaatatgcaatcgatctaatcatggttgggcagtctggactaaatgcagtcgaacgctttatgacaggaagtgtagccagctacgtcatacgtcattcaccttgtgatgtcttgatcgtttctgacgaagaagaacagccaagtaattaagcaagtggaacttgtataacctttttaatcaattaactaaaacagtaaagggactgtgacaaaagtcttgtcacagtcccttgttacgaataaatggtgttccagaagaggcttcttcggaaataaagcatgaaaaaaatctcatgcagtgaatgcaattttttgttaagataaatctcagcaaaggataatggaggaaagaacatgatttttgcttataacaaagcacacgtcggagacaccttgatggttatcatagccgacgataaaggaacagaaaacaccgttgaacgcaaatggaatgttgctcggatcaaagatgaacaaggtcaagttgttgcttggaactttttccatatctccgatcatctaacaatcgaagggaacggccaagtaagcttaacagatgaagaattagcgaaattgaatcgattgatcaaagaagcaggattcgaagaacagcttgaagctgatcatgaaccgaagatcgttgtcgggtacgtaaaaacatgcgtcccacatcctgattctgaccatttatcgattactgagacagaagtagacaatggtgcagtattgcaaatcgtttgcggtgcacccaatatcgaagctggacaaaaagttgtcgttgcaaaaccagaagctatgatgccagatggaatgatgatctggccaggaactttgcgaggggtagatagctatggaatgatctgttccgctcgtgaattgcatttgccaaatgctccagcaaaaaaaggaatcttagtattgcctgaggatgccgtagtcggagaagcatttccaaaataaagaggttgtgagtctgccgtttcactctgagtcacaaggagcaatttcaaaaaacagcttctcatgtttgttggatcttgtgacttgtgaccgaggagttggcaagaaaaatatagtttataaaaagaggttgtgacaagtctttgtcacaacctcttttttattaattttcactattttgattttgttttaatgccgattgatcgatcgtcaattcaacagtagttgttttttctttcgagccttcatagtaagtgattttgacagaatctcccacttttttcttatacaaagcagattgaagttctacaccagaagaaacttctttgtcatcgatcttagtaatgacgtcgtattgtttcaatccagctttttcagccggtgtagctgtttggacatttgtcacgatgacaccgttagttacagatgaaggaatcttcaagatttgttcttgttgctgagtagaaacggcagataagtcgaccattgtgatacctagagctggacgtgtcacttttccgtctttttccagttgattgatgatattcactacatcgttacttggaatagcaaatcccattccttctacgcttacattagaagtagattcagaagtacttgcgatcttacttgagttgataccgataacttgtccttcgatattaactaaaggaccaccagaatttccagggttgattgctgcatctgtttggatcgcattgatattgactgtttcgttcgattcatttgtacttgttacttgtcggttcaaggaagaaatgattcctgaagtgacagaattcgcatattcagatcctaatggggaaccaatcgcaatcgcaggttcaccaaccttcagagcacttgagtcaccaaaagaggcaaccgtttcgactttatctgaattgatcttcaacaccgctaaatctgaataagcatctgttccaactaattcagcttttaccttcgtaccgtctttcatcaagacttctagaccttgctgtccatctactacgtggttgtttgtgactacataagcagtatttccatcttttttgtagatcacgccgcttccttcactataagcttccaaattactatcatctgagctgctactttcttcttgctgcccgaatagtccgccaaaaccgcttgattggttttggctttgtaagttgataacagaaacgacagcgtcttgaactttatctaccgctttggtgatatcagaatctacattgactttgacgttttccacaactgtttcaccagcagaattttgattgccacttgtagtagaactattgttgccagtgcccatcgctgcataaaaaatgccagctgtcagtagtcctccaacgatccctccaacaagccccagacctaacttacgccagaggctattatttttattttttttcatctttggtgtcacattttttctatccatgtgttcctcctccaattacattcatttatctactgttagtatagtcttatttgttgactttagtctactttgagactgtgaactttttatgaaaaactttaggaaaaatcattgttttcagatgaaaatatttgattttctttttccacagatactgtgtaaaactacgcggataggattggaaaaataagggataaaacatatccacagcctgtgtataaagtggataaattcttataaaacgtatgtttgcctaatgaatgtgatgaaataaggtaaaataacactgttttctgtggataaacctgtggatgttgtgcataactgttggggaaatctttttaacaaaaatagccaaaataaacatatagacgaaaaaattgattataataaacaaagtgagcgtgaagaccaaaggagagaaaacatgaatatcaaaattatctcagtaggaaaattaaaagaaaaatacctgatccaaggtatcaatgagtatgtcaaacggctgaatgcctatgcaaaaatcgaattgatcgaagttcctgacgaaaaagccccggagaatttaagcgaagcgcaaatgagacaagtaaaagaaaaagaaggggaacggatcttagcaaaaatcaaagaacaagaatacgtttatgccttagcaattgaagggaaaaatcctacaagtgaatcttttgctaaacaaatcgaccaattaggtatccaaggaaaaagccaccttgtttttgttatcggcggctctttaggactcagcgaagccgtcatgaaaagaagcaatgctcagatctcttttggcaaaatgacgtatccacatcaattgatgcgtctgatccttgtcgagcaaatctaccgtgccttccggatcaatgcgggggctccgtatcataaatgacattactttagataaaaatatttacaacaataggaataaaagagctaaagaaaggagtgtagtgactctcaaagattaaactaaaaatctatttttgggagttacggcacttcttttttacgtatatgagcttgaggagattcatttattctttctacagaaatcatatttaaatttttataatttttttgatagaagatcaaaaaaagaaagaataaaacgtctatatcaagaaaaataagcagattatttatagtaaagtaaaattagagaaaatgcgtaacagctataggagttattagataatcaacgctgtcgcaagaaaaaaggagaagttaatatgtataatgaatggttaaaactgataggcggcaagaagaatgaagaagaaatcgtcacagagcgatttttcattaaggaaaatatactacattttgataaattaacgatacagttaagtaatatatcgaaattatatgttggcacaagaaaaataaaaatcccgcctcttgctatggtgattgttttactgggacttattttattgtttaccgacttttttagagaagttggattagtattaactgtattatcaggaatttatttttattctatctatcaatcctatcaaagtactaaagaatatcttgtatttgaattgaattctggcgacaattattacctttattttaaagagagtacatttttgaaacaggttagaaatgcattggaaacagcttttaatcataaaattatatactctgagatcaatatcgctgaacagaaaatcattcatggagaccatcatattatctacggcgataaggcaaacctaaatatgggaatccaacaaggaaatataataaattccaataaccacgacgaacattctagtacaacgattggagaaattaaagatagtacattccacgattctataattggcaatgaaaataaacaagagaacactctaaaagatgattatgattggtcaatgatcgaagctagtttagtagcctctctcgcatctttacatgctaatgattcagtgaagaaagccgttgccgaaggattacaagcagcacaagaaaaaaacaaagaaaaatttgaacagaccgtcagaaaaaatagaaaagaatttctatcagatatttttattaacaccactagcaatgtattttcacaagtgattttcaatctgctaggtgtcgttatgtaaagttattaatacagagaataaaggcagtagatgtaatattatataaatatatggtattgatttacaaagtgcatattatattaagaaacagattttagcaaaaaataaagttgttatttttagtataaataacaataatatgttcgaagggaaagtacacaaaaaaacaaaattatttttacggttaaaaattctaaatatttgaaattatcaaaaaatcattgacaaattttagcattggtgggatattgttaatcaaataacaaagcgctgaagagaagagtagctgatgaatagcaagcaaagagaacccggatggtgaaaaaggggattgtaaaaatcagtgaatatgagctccgagctttctgatttgttcacgcaactcagacggtagtgaccgatatttcaccgggtatcaacaggtaccgttgaggtattgtctgtaaggataatataaacgagggtggtaacacgaagcattcgtccctttatttgtcgtaagttcggcaaataaagggacgaatgcttttttatatgattctcaataagcagcgctggatgatttgtttactaggaggaatgcaaaatgacaactatacgcacaacatcaccatttcgctttgatatcgtagggagctttttacgtcctgaacgtttaaaacaagcaagagcagattttgaaaatggaacgatcacacaagaagaattacgtcatgtagaagatgaagccatcatcgaattgatcaggaaacaagagaaagctgggttaaaagctgtaacagatggtgaatttcggcgaagctggtggcacttggatttcttctggggattaaatgggattattcgccgaaaaccagcacacgggtatcgttttaatggaatcgagactcgagcagataccgtgcaaatcacagggccaatctctggaacacatcatccattcgttgaacactttaaatttacgcaaaaacatactagccaaggagtccaagtcaaacaaacgattcccgctcctgcgcaattcttaaaagaactctaccgtgaagacaatcttttggaggtacgcaactattatgcaatggaagaagaattgatccaaacgattgctaaagcgtaccgtgaagtcttgttagaactctatcaagcaggtgcaagagtcatacaactagatgactgttcatgggggatgttagtaggaaaactacccgagggtttccaaaaaacaggacaagaccctcaagtggtgaaggaacagctgaaagaactttatttgaacgtcaataatgccgctttagttgatcttcctgaagatttaacgatcaatacacatgtatgtcgcggaaactatcattctcactggtctgcttcaggtggttatgatgacgtcgcagaaccgctatttacttcagaaaacgttactacctattatttggagtatgataccgatcgttcaggcggatttgagcctttagcaaaagtcagtgaagataagctagtggttttaggcttgatcactacaaaaactggagaattagaggatcgtcaacggatcatcgatcgtattcatgaagcaagtcgctacgttccactcgatcgattggctttaagtccgcaatgcggatttgcttcgacagaagaaggcaatgtattgagtgaagaagagcagtgggaaaagattgctttagtaaaaagcatcgctgaagaagtttgggaaggggagaaatagatgacagaaaaaatcattgagttgaaggacgtcgtagtcgacttttatcataatcgtcagctgagacgagcactcgatcatattgatttaacagtttgtacaggagagatctttggcatcgtcggttattctggtgcaggtaaaagtacgttggtccgtctgatcaattatttgcagcagcctagcagcggggaaatcatcgtgaatgatcaaaatttagctacgctaaataatcaaggattacaaaaagctcgtcaaaaaatagggatgatttttcaacactttaatttgatgaaatctcgtacagtaatcaataatgtcgaattcccgcttttaagcaaaaaaatcagtgcgaatgaacgcagagaaaaagcaatggaattactggatctagtaggtctttctgactacgcagaagtttatccggatcagttatcaggcggacaaaaacagcgagtggcaattgccagagcattggcgaatgaaccggatattttgattagtgatgagtccacaagtgcgttagacccaaaaacaaccgtctcgattttaaaattattgcaagaactgaatcgtaaattaaacttgacgattgtgttgattacgcatgaaatgcaagtgatccaaacgatttgccacaaagtagcagtgatggaaaaaggtaagatcattgaacaaggcagtgtgtctgagatcttcacacaaccaaagcaatcgttgacacaggaattcattgatacggcaagtaatgtacgtgaagcattgagtaggattcgctcgacatatgatgagaggaataaacagcctctttatctattgaaatttgtaggagagaccaccaatcaagcagtagtgaccgatatggcacaacaatttcatttatctgcaagtattttatttgcaaatgtggaccaaatcaatcaattgaccatcggggtattggtgctagcattggcaggagaaaaagatcaaatcctcagcggcattggatttttagaaaaacaaggcgtccaagtaaccagagtttttcaggaacaggaggtggtggcatgagtcactggtttgtgcatgtagtagcagtcaaacagcaaatgattcaagcaactcttgagaccatttatatgacaggggtcacttctttgattgcaggattcttagggttagctactggtttgttattagtcgtcacacaaaatggaggaatcagttaggaccgaattttttatgtagtcttggataaaatcgtcaatcttttgcggagtgttccttttattattttgttagcagtaatctctccgctgaccagttttttgttaggtacaacggtaggtacaacagcagcattaattcctttgatcgcagggatttttcctttctatgctcgacaaatccaaaacgctttacatgaaatcgaccctggagtaatcgaagcggctcaggcaatgggaaccagtcatttagccatcatctttcgtgtgtatcttagagaaggattagctgatgtgattcgtgtttctgtcttgacgatcatcagtttgattggattaacaacaatggcaggcgctgtcggtgggggcggcttaggtgatattgctatcaatatcggctacgcacgttttcaaaatgatgtaaccattgtttgtatggtcattttattagcgcttgtttttttgatccaatttattggagataagttagccgaacattttgttcgattttgagataagtcagggaggatgagagaatgaaaaagttgctaggtctttttattgtcattctagttgcagtaggaggtgcatttggcatccacactattacacatgcaaaagaaaaagaacgttcaacgatcattattggttcccatggatcagataagcaagtttgggaatatatcgccaaaagcaaagaagccaaaaatttaggacttaaaataaaagtaaaagaaatcagcgatggggtacagctaaacaatgcaacacaagatggcagtgtcgacgtcaatgcgtttcaatcgtattcctattttctggcctataataagcagcatcctaagaaacagttagctgcattaggaacgacttatttagaaccgatggggatttattctgaaaaatacaaaaaggtagcagatattccaaatggtgctacgatcgcaatagcgaataatccggcggaagaatcaagaggtttattattattgcaggatgcaggtttgatcaaattagcttcagattttgatgcattgagtggcacagagaaggtcagtgaaaatccgagaaatctccaatttaaaacgatcgatgatatgacaggccctcgtgtcttgaaatcagtcgatggggtgttgatctccaattcagtcgctttggatggtggattgaatgttttggaagattccttgtatcatgaagcagtcaataaagaaacaaaaaacaatatcaatatcttagcgacggctgaagcgaacaaaaacaacgaaaagtacaagaaattagtggagttatatcatgagtcagctattcaagaatatgtaaccaatgaatttaatggaacaaaagtagaggtcaatagaccaataagctatttaaaataataaaggaatggtgttagatatggcaaaagtagaaagtttcacactagatcatacaaaagtaaaggcgccttatgtacgcctgatcaccgaagaaacaggaccaaaaggcgacaagatcacgaactttgatttgcggtttgttcaaccaaataagagctcgatcgagacggcaggactacacacacttgaacatttattagctgacttattacgtgatcgggtagaaggaatcatagattgttcgccatttggttgccgcacggggttccacttgattgtttggggggagccgactgctcatgagatagctcgtgcattgaaatcttctttagaggaaattgctgaaaagacaacttgggaagatgtgcaaggagtcagtgaaatcagttgcggaaattatcgcgatcattcccttttttcagcaaaagaatgggcaagtaaaatagtaagtgaaggaataagtgacgatcctttcgaacgtcatttagtataaattgaggacatcatatattttgctatgatcatcctgaggttgtgacagaagtagtcagcttcaagaaatttcggcttatttccgaagaagatacttttgtcacagcctttttttattcaaggcatgattttctctatgtgatcattcagtttctgtaagagttctaataatttttttttggagtacttgtaattgctttctacccatcgattgagaacagatagacatccttggacgtggtacgtagtgaagaatctcatttcttctgtgataatcgttttcttgtcttcatatagccatatgttcagatagttttcttcaataacttgtttaactttcttctgaaacgaaatatcaccatggttgaggataaataagcgatataaaaaagtatttgcgtaaacatagtcaatcaagcgagtgtatagttcctcatagctatgggctggatcataagagagaatttcatttagatcccgaaaaaagttgctttctaattgatcatatagatcatagatatccttataatgtgtataaaaagtcgaacgatgtacatctgccgtttctgttagttcgcgtatagtgattgcttgaatctttttatttactaataatgtggatagtgcttcagccaaagctttttctgtttttttgacgcgtctgtctgtctttttcatttacctatctccttatccgacatatcaaagcaaagctgtcgcttaatcgacaatcttatagatgattgattatagatagtagacactgtgtctattataatgtaagtataacacaatcattgaagttgaggaggcgaaatgatgaaactaacttttaaacccttagaaaagaaagattacaaaaaagctatctattttgctgttgaaggaatgaactttgagagatatatggaaaatgaacttctgctgaatctttacggaagatattttttgtatatggagttgaatcgagctactcaaattcttgctttgtatgcagaggacgagttggcaggtgttttgctggcggagataaaaggagaaaaaaagaaacatcgttcttttggacagcaaatatatgttaagatattcgattttttacaaaatatatttgttaaagaaagtaaaggagcttacgagacagcaaatgaacaaatgcttgcagcatatttaaaaaagcattcgccagatggagagatcatttttttagctgcaaatcctgatttgaaaataaaaggcatcggcacccagttgctaacagaatttgaaaagagagagaaaggaaaagaaatattcctttttacagatagcggctgtacgtatcaattctatgaacgacgtggatttgaaagactaaaggaaaaaattagcaagataaaaatcttagataaagaaatagatctccgatgtatgctgtacaggaaaatcattcaatgaaaattttgatagaaacgacaatagttggcaagatcacttttagtgagtcttcttgctaactattttttgtagtgtattctaccaaaagaaaaccgcctttttgactaaacttgatagtggtcaattttttatgatggataagtatctatacttagtctcgtaagaacgaaaaggaaaagagggagaaagatgaaatttcaaaagtggatccaagagcatcgaaatcatatcaccgccttatcagctgtgttgattatttttggttttatcggaaaatttactggatttgtcttgttctataacattgctctagccatagcttctattattgcggtcatacctattatgatccatgcgtatcaggcagtaaaagtcaaagttatctcaattgatttactcgttactattgctgtgcttggtgcctttatgatcggagaatacaaggagtcagctatcgttacattcttgtttttgtttggtagttatctggaacaaaaaacattgaccaaaacgcgggaatcaatcaaggctttgaccgagatggccccatcgactgctagtgttgtccaagaagatggaacgactgaagaagtggaaatcgatgacgtggaagaaggcgatatcgtcttagtaaaaactggtggagctattcctgtggacggacgagtcattgacggaaaagggtatgcggatgaagccgcagtgacgggtgaatcacgacaagtcgtcaaaatcagtggagatgaagtcttctctggaacgattttagcagatggctatatgacgatcgaagcaactaaggtcggagatgatacgacctttgccaaaattatcgaattagtagaagaagcacaagataccaaatcccatgcggaaaaattcattgatcgattttctcagtattatactccaaccgttttacttgttgcgttgcttgttggtctgatcagtcgtgattttcgtttagcaatcactgttttggttcttggttgtcctggcgctttagtcattggtgcgcctgtttcgaatgtagcaggaatcggtaatggagcgaaacggggcatcttagtcaaaggcggtgaagcaatggatactttttccaaaatcgatacttttgtctttgataaaaccggtacattgaccaaaggaactactgctgtatccactatcaagaactatacagagaatgaaggggacagcttagctttagtggctcgattagaaacgttatccgaccatcctctggggcgcgccgtgatccattatgttcaggagaaagacattgattttcaacaattagcagtcaaagataatcagacgatcaagggacaaggcatcacagctgagattgatggtcatacagtttgtgcgggcaacaccaaattgattgccgctcacaaactttctctcacaccaaagcaagtacaagatttacatcaattacaacaaacaggtagctcagtcattattgtagcaatcgacaaaaaaatcactcaaatcattggtgtgtcagatgtgattcgaccagaagtcgctgaacaattagctaagttgaaacaagcaggagcaaaacagttagtgatgctgacaggtgataatcagatgactgctgattatgtagctgatatgttaggcattgatgaagtccatgctgaattattaccagacgaaaaggttcaatttgtgaaaaaataccaagaacaaggattgcgcgttgctttcattggagatggaatcaatgattctccctctttggctgcggctgatatcgggattgctatgggatcaggaacggatgtcgctatcgaaacgagtgacgttgtcttgatgcaatctaattttgaatcgttggttcatgcctaccgtttggctaagaaaactgttttgaatacccgtgaaaatgtagtgattgccattggtgtcgtcttatttttactcatcggcttatttgccgggtttatttacatggctagtgggatgttcgttcacgaagctagtatcttgatcgttatctttaacgcgatgcgcttattgtattttggacacgaaagcaaagaagaaaaatcgtaaaacttgataagaatcaatttttttatggaagctgtaatctagaataagactatcaagaaaaaggaaggaagaactacgatgaaaaaaatgattatgcaattagatacactagcttgtccaagctgtatgcaaaaaatcgaacatgcggtttctcaacagcctggggtaagcaatacgaaagttttgtttaatgcgagcaaaatcaaagcaaactttgatccagatgaagtccaccctgaacaattagctgcagttgtggaaaaattaggttatgaagtccaatcaacaaaagtaaaagaggcgtaaatcagtgaatatagtggaagaaaaatttgctcaagaaacaaaacaagcagatatcgatcatcataaaccaactgctggcgccatggtggggcatgtattggcaaattttaaattagaagaaatgaaattgatccaagcacaattgtatgttttgggtacatcttcgcaagaattaagtacccttttttcagaatatgctgatcaagaagcgagatggttcaataaaatctctcatgagttagtgattgaaaatgaaatcgttccgtctactttagaagaagtcatgcgttatggaaaaatttacgaacatggtcaaaacaaatatttaccagcctcaacaatgttggaaaactttgcaaaagattttgatttccaaaatgtctttatcacacgggtaatcaaattagctgaaaaagaagaaaaatatggcttgcaacaattgcttgttgaacttttaagtttcaataaagaaatcatctaccaagtacaaagactccaaggaaaaactgtccgacaagatttggatgaggaagacgatgatgactaaaagtctatgtttcttcaaatacaaatataaagcgtgaggtaaattggaaaatcacgaagattaaaataaaaaaagcacccgctgatgttgtctgtaagacatcagcgggtgcttctcagtttttagaagatttgaaagattgatgagaaaatacgaaaaaacaataaaattacattgcttatttgatagaataaagaagtgtggggagtaatcgaaaggagttttttaattgaaaaaaaggattttagtaacaattggtctagcttttttgttagctggttgtaccaacgggaatgaatcgaaaaaagaatcaacaaaagaaacagcgaaagcaacaattgcaactactacaacaactagcacagagagcaagccaactgcagcaagtacggaaacagcagatacctctacttcgtcagagtcttccaaaacgactgaaacaactcaaacatctacttcaagttcttctgtagaggcttcatcttcctcttcagaaagcagcgaacaagttgaacaaacactgtggaatgcagacaaatccgcacaattagaggcatttatggctacatggggccaaacaatgggacaacaatacaaaagttatacgaatcaaatgagtgtggacttatatggtcttaaagtccctcaagctattttgaacggggagtggaagatggctattggtggagtgcctgtttctgcagaatggtcagaaagtgggacaggtcaagcagactatcaaatcacagccgtctattccgatgcagagacagaaccatatctgaaaaagcacgtctatctattcgggtttcagcaaaatcagccaaaagtattggtgacacaacaaaatcagggaaatcccgataattatctttactttaacgagacagcgaataatgaattgaaaaatggctttaatcaaatcgtttatgggtaagtaaaccagtgagagtgagagaaagaagagactcagtggaaaatattaattgattgctatgtctaagaattaagatgaaggatgaaatttctagtttcgtccttcatcttagttacgttttacttggataactataataataacgataaatagttttctctcgacttctttagagattgaataaaccctccaatactaaaattgaatgttgcaagagcatgaattgccaattgtattattagaatttttagaaaattgcacctttagtttctttagataaaatgatacaatgattgttaaaattgtgaaagggtggtcatttgttagagaagtttttggatatgtcgttagttcaacgtattgttgttggtattttagtcggaatattgtttggtatctttttccccacgtggacatttatttcaatattggggacgttgtttgtcagttgcttgaaggcaattgcgcctcttctagtttttttcttgacgatggcgtcaattgccaagcataaaattgggaataagacatttgtgaagcctattttgatcttatatttagtgggaacattgctttctgcacttgtagcagttattgtaagttcaatttttactgttcctattactttacaagaaacagtatctgaacaagcaccgcaaagtttggaaagtgttttatctactatgttgacgaatgtcacacaaaatcctgttcaatctcttattgatgcgaattaccttggcgttttattctgggctgtattgttgggactagcttttcgagcacgttcagaatcgacaaaagagttggtggatcagatatctatagcgttgtcacaagtcgtacaagtgattattgcatttgctccgatagggattttaggattggtttatcaatcaattgctacgactggaatcgctggattggcagagtatctgcagcttttacttgtgttgattggcacgatgctgtttgtcgcattagttgtgtacccgttcctcacgtttttgtttattaaagaaaacccctatccattgattcttttttgtttgaaagaaagtgcgcttcccgctttctttacccgaagttctgccgcaaatatcccgataaacatgatgctggctgaaaaattgaaattgacgaaagagtcttattccatatcgatcccattaggtgctacgatcaatatgggcggtgctgcgattaccatttccgtgatgtcattgacggctgtacattccttagggattgaagcaccatttgttttgaaagtccttttatgtattttgtctgctttagctgcttgtggggcttcaggtgttgcgggcggttcactgttattgattccattagcatgtagtttgtttggtatctctaatgatgttgcgatgcaaatcgtcggtatcggatttattatcggtgttatccaagattcaatggaaactgccttaaattcgtcaagtgatctgttgtttactgcaataggagaattaggcgcgcgtaaaagaagtggagaaaaaatcaaattgaaagatcgattagatgggttaaatgaacgttgaatattagatatttagggatgaaccttaagacgattcaaatttttaatgagttatatagatgttcgtgtaaaatagaggttcctgttaaatcgagataaagtcgtttataataacaattaaaagcataggtaattgttattggaggcgcatcatggattttttacgtaaatttggtttcttctttttattattaggcgtgttgagtgattttttgactccgtacgtattaggattgtattatcctgaattaaatcaaatgaagagtgtgatcagtgtatttggagaggtttccagtcctgtaagaaaggcgtttcttatttggtcagtggtttcagggattttattcatcctgtcatcgcctgcattgtatgctgcatttgtaagtacatctcgtgtgttagctaccctagttacagcagccatcgcgttctatggtataggtgattgtatctttacaggtttgttcagtatcaatacccatgaatcttcgtggaatgtctcgacatgggtccataatatcggatcaggtttaggttacagtggttttttattgtttccagttcttcttttcttgatctatcgaaaaaatgggcaaatggacgtaagccacttataccttggactgtctgtgatcagtttgctttttgcggcgatttatggactggcaagaattccttctataaattcttggccattattgaataaaataggtttttgccaaagaatcagttttttctttaattatgtgcccattgcctggttgagtatcttgcatctcaaacagtaaaacttgagccgtcaaattgaacagtcagcggatacttcatccggtggctgttttttgtttttctgaaatatatatttccacagttttcttgtatagcttctgtcttagagaagcaaggagctatattttgtgctacaatcttaaaaaggtagagagaagaccaaatggaagacagaggagccactaaaatatgagaaacatcaagttgacaatcgaatatgacggaaaaagatattcaggatggcaaagacttggagatgacgataaaaccattcaaggaaaaatcgaaaaagtattgcatcagatgacaaatgaagagatagaaattattggatcaggaagaacagatgctggcacccatgcgcgaggacaagtagcaaatttcaaaacaaacacagaaattggactggcagaaatgatcgactttatgaatcgttaccttccgcgggatattgtcatcaaaagaatcgaagaaatgcctgagcgcttccattcaagatataatgcggtgggcaaaaaatacagctattatgtttggaacaacgtgattccttcagcatttgagcgaaaccacagcttttatttccctcaagagttggatatggacaagctgaatgcagcttgcgaaaaattagtgggtacacatgatttcattggtttttctgcattgaaaaaatcaaaaaaatccacagtgcgtacgattgatgaattatctatcgaacgaaagggagaaatgcttcattttacttttgtcggagacggattcttatataaaatggtgcggattatcatggggacattactagaaatcggcacaggtgccatgccgatagaaacaatcgatgaaatatttgaaagcaaagtgcggcaacatgcaggagaaaccgtccctgcacaaggtctgtttttggatgaagtttattatcgttcataaaaaaagaatcatctttactcgacttctgagaacgggagaacatcccttttttcagaggtcgttttttagttaaaccaaaccatagagtatgctttttaagataaagatcatcttatatcatctgaagctgcttatcttctttgaataaatacgattcaatcgcttatttcctcactttatgataaattacagctaaagtcactagcttgtcttcttcggaaaggaggagaatctatggatgaggaacaaatattcattcaaacactttataatctgattttgaatccgaatacacgagattgggaacgaaaagtattgattcagacaaagaatgacacaagagaaaatatatccgttaaagaacagttatcaaaactagaagcaacactacgtccattagctatccgaatgaatctgacgcctgatgtaatggacttttatttattgattacggaaggatttgataaggagcaaaaatatgacttttccaagcatgccatgcaagatgctgactatcaagaacgtgcagtatttgcagggggatgtttctggtgtatggtcgagccgtttgaatcgaaaaaagggatcctatctgttttgtcaggatacacgggcggacatgttgaaaaaccaaattatgatcaagtaagtggtggttacacaggtcatgtggaagctgtggagatcatttatgacacaagagaaataagttatagcgagttgctgacaatctattggcaaattactgatcccacagatacatttggacaatttcaagatagagggaagcaatatcgtccagtgattttttatcaagacgaacgacaaaaagaattagcggaacaatcaaaacagaaactagacagttcaggaactttccaccaaccaatcgtcacaaaaatcgaaccagccggtacgttttggccagcagaaaactatcatcagcaattttacaaaaaacaaccgaaacgttataaaaaaatccagcaagcacgtaatcaatttctgatctatcaacgagtaaaaaacaaatggcaaaaaaaaatacgaaaaaatcattttgagtaactccttttctttaaaatgtagtaaactaaaaatagaaaacaagaaagcgttttaaaaaggtttgatgaggaggagaaaaattgtatattgcagatagtgcacgttatgaaaaaatggaatatcgtaaatccggtcattcaggtttgaaattaccgattttatctctcggattatggcaaaattttggtgattatgatcctatccataaccaaagagagattttaagaggcgcattcgacatgggaattacccatttcgaccttgcgaataattatggaggccctgctggagctgcagagaaaaactttgggcgtatttttagagaagattttcaagcctaccgtgatgaactgattatttctagcaaagcaggttatcatatgtgggaagggccatatggggaatggggctctcgtaaatccatcatttcaagttgtgaccaaagtctccaaagaatggggctagattatgttgacatcttctatcatcatcgcccagaccctgatacacctttggaagaaacagcagaagctttgatgcaacttgtaagacaaggaaaagcattatatattggtatatccaactataatggagaagatacaaaaaaatgactgaaattttaaaaagaaaggaagcaccgttcattattcatcagatgcgctacaatatgttttctcgtgcactactagaagacgatctatctccagtattagaagaagaagggctaggggcaatcacgttcagttcgcttgctcaagggttgctgacaaatcgttatctacatggtattcctgaagattctagagcacatcgtaaggaaataccattcctttcagaagaacaagttggatcaactctggaaaaaatcaaagcactgcaaacaatcgccgtatcacgaggacaatcattagcgcaaatggcccttgcatggaatttgcgacaaaaatctgttacaagtgtactggtcggagcaagtcggttaagtcagttacaagaaagtgttcgaatgatggataatttagatttctcaccagaagaagaattgagaatcgaccaaattctagaatagaaacgatgtaatcaaactttttatctatatattaaaaaaaacaaaagatgacatcaagaatcgaatgaagatcgtctgttattgaacatcatattttttgtcgttcaaaataaaaatgatcgaaggctaggagtgaattttatcctagtcttttttatggtaaatatcttcttcgtttgtatgtctatgaacggattaatcaattttgtatacaaaaaatcatcagatgattcaaacgtgttataataattacgaaaaaatacatcagatgaaaaggaggtatgtggtttggaagaaaataaaaccctagtagaagtaactactgacaagatccttagatatttaaaggaaatgcagttgcaagtaggagataaactaccgaatgaatatgaattgtccgattatttagaggtggggcgaagcacggtgcgagaagctgtgcgggctctagcttccaggaatatccttgaagttcggcaaggagcggggacatttgtcagtgataagcgagggattgccaatgacccactcggtttttctttgattgaagatcaggatcggatgatacgagacttatttgaactgagatatttattggagcctaagatggcaggtttggcagcggaatatgcaacgaagaatcaaatcgtccaaatgaaaaaattaacgcaaaagattgaaacttcttttcgagaaggcacacaagaacatgttcaattagacatcgattttcatacgatgattgcagaagctagcggaaacgtagccttgttgcatattatcccaatcattaatgaatcaattgctttgtttaataaaaattatgatatccagcatctgaaaatcgagacgatcgatattcatacagagatcgttcaggccatcgaaaggcggaatgcacttgctgcgtttgatgcaatgactgtccatatggcaataaatcggagagaattacagaaaataataggagaaaaagaaactaattgacagttcatctgatgtattttatgataaatacatcagatgaatttttgttttatatttggtaaaaaagaggagtaaatagtttctgttcaccaaaatgtaagcgctaactaatagtcaaaaagagatgacgtcaaggagaagaagcaggaatgaggggatctggaatgagttttatggataaattagccaatgttttagggaacgtggcaacgagaatcaataatttaagatatatcatggtgataaaaaacgcatttgctgcattgattccggtaattattacgggtgcttttggcacattgttttcagcaatggtctttgactcggaaaatggcttagcacagataagtttcttgcgttttttagaagaattaaagcctatcgcatctgccatcagctatgtcacactaagtttcttgaccatctatgctgtttttctgatagggatcgaattagccaagctgaataaagtggatggtgtattccctggtatcatcgcagtgatgtcttatttatctgttaatccaactgtttatgaattagtgaatgaaaatcagactgttatagtagaaaacgtattggctaaacaatatacagatacgaaagggttatttttgggaatgttggtctccatcctttctattgaactttattgctggttgaggaaacagaagaaactacagctgagaatgcctgataccgtgccaacgaatgtttctgctagtttttctgctttattcccgacgattctgactgtatcgggtatcgcggctgcgggatttatcatcaaagaacttacaggaatgtacctttatgatatcatttacaatgtcgtacaacgcccattagaaggtgtcgtacaagggttaccgggtattttgctattgatgtttattgcgcaagtcttttgggtgattggtatccatggaaatcaaatggtgaagccgatacgggaaccgttgcttttagcggcaattgctgtaaatacggaagcttttgaagctggaaaagaagtaccgaacattattactatgccattttgggatatgtatatgagtatgggcgggtctggagtcacgatcggtttactgattgcagtattgttagttggaaaacgggaagatatgaaacaaatcaccaagttatcccttgctcctgggatcttcaacatcaatgaaccagttatttttggtatgccgatcatgctgaatccaattttagctattccgtttatcttaacgcctcttatcaccggaacgattggttattttgcaaccgctttaggatttgcggcgaaagcagttgtaatggtcccttggccgatgccgccgatcgtcaatgcttatctggcaacagcaggaaatatcggtgcagttattacgcaacttgtttgtattattgtttctattttgatctatctgccattcgtaaaagtagcaaatcgtgtggaaaatgatggggtctaaaaaacaggaggaaatcatgaaaattactattccaaaaaattttattcttggtgctgcatcttctgcttggcaaacggaaggttggaaaggaaaaaaagaaggacaggattcgtttatagatagctggtataaaaatgaacattttgtttggcataatgggtatggcccagccgtagcaactaattttatggaacaataccagcaggatgtggatctgatgaaatccatccatctgacacattatcggacttctatcaattgggctcgtttttttactgattatgagaactgtatagtagatgaagaatatgctcagcatataagtgaaatgatcgactctttgatcgaagcagacgtagaaccgatgatttgtttggaacattatgaagtcccagcttttcttttggaaaaatatgatggctggtcttcaagaaaagtagttgatttttatgctaagtatgctcaaattgcctttgatcgttacggtgatagggtaaaaaactggtttacattcaacgaaccaatcgttccccaaacgcgttgctatttggatgctgttcgctggccgcatgaacaaaacacaaaaaagtggatgatgtggaattatcataaagttttagcaacggctaaagcagtagagatttaccgcagcggaaattacggtggaaggattggctgtattttaaatcctgaaatggtctatgctcgatctaattctccagaagatcaaaaagctgcttatatgtatgatttgttttataatcgagtattttttgatccgatggtaaaagggtattacacagaagagttcctggagttgtgtcaaaaacaatcgatttatttcgatcctgcaacagaggatttagaaacgattcagcatcatacagtagatttccttggaatcaatcaatattatcctaaacgcgttcgcgctcctcgttatcaatggaatgaagagacacctttccatccagaacgatattatgaagtctttgatttacctgggaagaaaatgaataattccaggggatgggaaatctatccgaaaatcatgtatgatatagccatgtatctaaaagaaaattatcataatatcccttggctgataacagaaaacggtatgggaagagaacatgaagaacggtatatggatgagaaaggaatcgtgcaagatgattaccgtatcgaatttatcggacagcatttgcgttatttgatcaaagcaacagaagaaggcgcaaattgcgaaggctatatgttatgggcattcactgactgtgtgtcaccaatgaatgcatttaagaatcgatatggattagttcgaatcgaattgaacgatgaacgaagcagaacattgaaaaaatctgcttcgtggtatcagactttgattgataagagagaattggatttgcctgacgaaatctataaataaatagaagttttttgtagatgttcattgtatttactggttatttgaaataaaagaggttgtgaatccagcgttttgagctaatacccagggtcagctgattgaacaccgtttattgagaggttgtgaaaaagctgtcctgcatcaagtaataagaacagcaaagtaaaaacaacatcttatgtttttaacttggttggacttattaccgcagatgcaagcttttgaataccgtttattcgaaaaaagttgtgacaagttttgtgtcacaactttttttgtgcacgttaaaagaaaaaaggtaataaaaattaatttgtgtgtttagtgtgcgctttctttttttagtgtgtatgcaacttggtatagaccttaaatgtgatgatatcaactttttaaagcgcttttaaagttggcacgctacttgcttatatacaagtgtaagtatagaaaggaacgtgtttaaaatggaaaagaaaacaatcatgcttgtatgttcagctggaatgagtacaagtctcctagtcacaaaaatgcaaaaggcagcagaagcaaaaggaatggaagcagacatctttgctgtatctgcttcagatgcggataatcaactagaatctaaaaatgtagacgttttacttttaggaccgcaagtacgctttatgcaaaatcaatttgctgaaaagctagcacctaaaggcattcctttagatgtaatcaatatggctgactatggcatgatgaatggtgaaaaagtactcgaccaagcagaaaaactaataaacaaataataaaaattatcggaggatacaataaatggaagatcaaaaaaatctagaagccatcatgggtctgatcatgtttggcggaaatgcaaaaagcgatgcaatggaagcgattgctgctgcgaaaaaaggtgatttcactttagcagatgaaaaaatcaaagatgcagaggaatctttagtccaagcacatcactctcaaacagagatgctgacacaagaagcacaaggaaatcacgttgaagtcacgcttttgacggtccacagtcaagatcatctgatgacatccatagcttttacagatttagcaaaagagatcattgatctgtatcgtcgattgaacgcgtaatctacagtaaagaaaagagggaagatttatggataaatttgttgcatttatggagaaacattttatacctgtagcatcaaaaattggtgcacagcggcatttagttgcgattcgggactcatttatggtgagtatgccgttaatgatcttaggagcattagcagtaatgatcaataacttaccgattcccgggttccaagaattgatgaactcaatttttggtggtgaatcatggaaaggattcggggctgctgcttggaacggtacatttgccattctttctgtcttgattgctttcttgcttgcttatcatttagctaacggctaccgaaaagacggtgtttccgcaggtgtgatttctttaggctctttcttcgctttaggcggagcattaggtatgagctcaaacggtttgtttattgctattattgttgggattatttcaacagaaatctttgtacgtttaagcggaaatgaaaaattgatcatcaaaatgcctgatggtgtgccaccggcagttgcaaaagcatttgcttcattactaccagcaatgatcactatctctgcgtttgctttagttgctgcaatttttgctgcattcggtgttgatgatatcgtaggttctttctatacagtggtccaagaaccatttatgggacttgcaaactcttatccatctgccttactgcttgcatttatcacaccattcttatggttctttggtttacacggagcgaatatggtcgatcctttgatgcaaacaatcaatgcgccagccattgaagcaaacgttaatgcaatcgcagctggacatagcgcaccgtttatcgtgaacaaacctttctttgacagctttgtcaacttaggaggaacaggtgcaactttaggtttactgttagctatttatttagtaggacgtaaaaacaaaccatatatggttgtaacaaacttgtcgattgcgccaggtgtcttcaatattaatgaaccaacgatgtttgggttacctatcgtgttgaacccgatcatgttcattccatttattttgacaccaatggtcttagttagtgttgcttactttgcgacttctacaggtttagtgccagcagctaccgttatgcctccatgggtaactccaccaattattggcggtgtattggcaacaaaaagtattgcaggtggtgtactagccgctgtcaatttggttctttctattttgatctatctaccgttcgtcaaggtagctacgatccaagaaagaagaaaagaagctttagatgcttgattaatcaaaaaacggagaacaagtgattgttttccgttttttttacatcactattgttgtcattgctaattttcataaagacttgtataatttttgtaaacgttttattttagtcggaggtttaaacattggttacatataactggatcaaattaagagaacacccagaattagtaaaacaaagtgcgaagtggttttcatcaaaatggggagttcctgctgttgtgtatgaggaaagtattcgtactggaatcgctaataaggaaagtattcctcaatggtatgtggtcttagatgaaaaagaaaccatcgtcggaggagcgggcgttattgaaaacgacttccataaccgccctgatttgacaccaaatctttgtgccctgtttgttgaaccggaaaagcgtaagcaggggatagccaagcggatattagcggaaatcagaaaagaaatgcatcaacttgggtacgaaaaactttacttaattacagatcataccacgttttatgaacgatacgagtggacatttttgacaatggtcaaggaagaaagtgggacgaccgctcgtctgtatcaaagtgatacgatagggtgaaaaaagaggcatgagattttttcaaatctcatgcctctttttttttgcttgttctcttcattgcttttttttcgtcgtaaataaaaatgttccttacgattctgagaataggacgaatcgtcaagaaaatagcaccagccaaataaaaataggtgccatatcgatcggggattttagttaaggaagcaaggcttccaaaaatatagaaaatcccggttaataaatcgacagccagtgagatcaatgtgtaacgattttggaaatagaagcggaagcgacgtcctcgtatttcgatatcttcttcttttcctatttcgatctcatgggtatttcgtttgattttgggcataaagaaaatcacctgtattttttactgaattcaaggtttcaaaacaacttttatatttttatcttcttttttgtcaaagatctcatatgcttgtgctgcttctgatagtggcagcgaatgagtaatgatttgtgtaggatcgaatagtccttctgcaatcatttcgtaaatttttggcattagatggataattggtgcctgtccatgcttgacagcgatatcccgcataaaaaattcttgcagcgggtaagaagaagctggagtcatataaacaccagttacttggactgttccgaattttttgacagcttgcgatgccatctgtaatggagagattgtgccgctttgtaagcttactaaatttttcgctttttctttgacaggctctaatccgtccattcctacacaatcgataatgacatctgcgccacctttagccagttcatacaattctgttccagcttgtgccgtgtcttctaagaaataagtttcaaccccattgtaattagccgctttatctagacggtgctgtactggatctactgcgattacgcgctctgctccagccataacagcgaatttttgagcgaatagaccgactggaccagaacctagaatcacaactgtatcgcctttttttactcctgcgttttcaacgctccaataagctgtgggcaaaatatctgatagaaataaaactttttcatcaggaagatcattatctggtacaacaaatgaagtagagtctgcataaggaactcttagatattccgcttgaccaccccaatgattaccgttcaacttgccaaatccgaaaagcccgccatataactgatctggatttgattcatcacattggctttccatgtgattcaggcagaaatgacaatgaccacaactaatattaaaagggataaccacacgttgcccttttttcaatgtttgaacttgagatcccacttcttcaacgattcccattggttcgtgtcctacaacataccctttttccaaaactgcttcaccatgatggtaaagatgcagatcggagccgcaaatggctgttgctgtgatacggatgattgcatctgttggttctaatatttttggatcatctacgtttctgatttccattttctgttttccttgccaagtgactgctttcattggagatgctcctttcagattcataaaattgtctgcattattagtactacagataatttcattttaaaggagatcttacctttttgataatgaaacgctttttttcttaaatgaaacattctatagtcttatgtatttgtgttcggagaggtgtgtttccgattttttagtgtaatggtaatcattgaaatagttgtatccgttagatgatgttggattggcaagagagtaaacgttgaaaaaatagttgttttcaaaaagaaacagacataaataaaaagaggttatgacagaagggatcagtttctcggtattaagtcaaatttatgcaaaaacgtgaggaaccattttcacaaaatttttcttcatactcgaaactaaacgactttttcataacctcttggtaaacggtgttcaaaagcttgcatctgcggtaataagtccaaccaagtcaaaaacataagaagcagttttagcttgggtgttcttattacttgatgcagggcagctttttcacaacctcttggttattcaaacattttttttgcggcacgagctagagtaggaatatctttgtcgtaacgcggtgttttgacaagacgggacatagggatacccgcaaaatggaaagcagcgatttctccagaacgtacagcactttgttcagtaaagatcatctgataaggctgctcgacaaattctcctgtaaaggccagattggtcgaatgtttaggaatgacttttggtcgatcgcttttggcacgattattgaacaacgcggaagcataaggcatatagacagggatattatttattacgctgtcgaaaatttctgtttctttttcacgaatattcactggtccaggatctacttttgaaagttgtccaatcagttcttctagcatttcttttccattcattttaatatactgtttatccacaaattcgccacgtcgtcttggataaaggaaataaccccaaataactgtttcatttggtttctgagacgtaaaatgcggttgatgatgcacgacgatagacatattgacatctttttggcctaacggcgtgatcggtgtggttgaaataaatgaattcaaggcatttcctggttcttgagtcgtgatacgggtgatttcattcaacaacaaatggtttttcgtcgtcagggtaaagctgacccattcgcttgcatctcgatcagcaaagaatttgtcaggatttcccaagttgtagaaacgttcactggcttttttccagagactagaagctgcaccataatccatattttctacagctggtgtttcgtaatctcctaaagtagctgaatctgtaatggacccattagtgaaaataactgctgtatcttcatcgaccacaacgtgttcttcttcttgagtcagtgtattggtcattttcaaaccagtcacagtgatttcatcttgcatcggtgtttctttgaattcccagtcagtgacacggcggttcaaaatgattttgcatccttgttctttcaagtactcgatcaaaggaagcataatactttcgtattgattgtaacgtgttcgattgacgcccactagatgttcgatttgagtgaattcataaatcatttgatgcatatagcgacgcaattcttgagcagaactacgtgttctgaaagcaaatgttgtttcccacataaaccagaagtttgtttcaaaaaagtgtggatcatctttgaaatattcttcgatagtgatattgtctagtttttcttcttctgaatcaggcatagcaatcagtttagtcagaagaatacggtctttattattgaatcccagttttccgccatcaatgattcctttgccaccttccatcaaacgtgctttgtcaaaggttcggtgttttgcatcaaaatctctcgtatcttcttcagcagtcatccctggctcagtaacagaaggtattcgacttaacagatccatcaaatctacataggtacggtaattaagcatgcgaccgcctcgagcaatatagcctttttggttttctaatggatggtttttattccaatattcatccactacagtgtcggtcggtgcaccatcatttgaaccgtgatcatccaatgaataaaaggtgatctgatcccctttccatttgccttcttgaatcaaataaacagccgctgccatattggcaataccggcaccaatcattattgctttactttttctcattgtgattcctccaatgtcttccaagtatgtccgtagtgattcaacgaaataggatgctagattgattcgaattcatcatataaatgactgtcatcttcgaatagtcctgtcttttttcctagatatgcagcgccaagggcaagcaaacctaaaccgatgccgactttgattaattttttactcatgaaaaacgcctccttgttttctctttctatatccaaggatagttcgtttttattagaatgccaaatgataggacgagaagaaaaaggaaattttgacaaaaaagaagaagtgtctgattttcctgtaaataaaaatagggtaggtaagaagaaaagatttgaggaggtgtatggttctatttttagaaatttgggtacaaaaaaagcaccgagacagtgcttctttgaaaagctgatgacggactaagccttattttaacttgctacgttgttttggatacttccacgatttatggatggagggagaaaaatgggagagtgaaaaagaaaaatttaagcgaaccgttatcattagaacaacttttaaatagacgaacaaggtaactttcttttacaataaaagaataggaacaaattaaaagaaagtaggtagcgtatatgtttcgctcaaatttaattgaatttctagaatggatcattgctattttaaatatttgttctatcggtatcttaattgtcgggatcgttcttgttctattcaaactttttgattggtctcatgtcaagaaaaactatgcagaacgtaatactcgtaatgcagatacaagaaaactgctagcaagttatattttgttaagcttggaagtactagtcgttgctgatatcatcgagtcagttatcaagccgacttggatagatattttgaagcttgcacttattattatcattcgaacagtcatttcttatttcttgaatcaggaaatagaagacaaagaaaaacaaagaagaggagaggtaggatgacgacagagttgatgcagtttcttcttccatattttgaaaaacttgtactgggacttgatatctttgctatctgtttattggtttggggtgtttgtctatcaatcaaggattttttgaaatatttatttgtccatacaaaagtgcaaaacgaccgagtcagcgagaacaatgctattaaaaagatgttgggaggctatatacttctaagcttggaaattcttgtttcagctgggatcatcgaatcgattatcaaacctaccttgcaggatattttccaactagcggcgttggtagttatccgaaccatcatttcttattttttaaataaagagatcggacccgtagatgtccaaaataagtgaggttgtgagcctgacgtgtatcaagagattgttacagaaatgggcatcttcaacaaataagaggctgtgacatgatttttgtcacagccccttatttgttttgcacagctgaaatgatagctcgatcgatcgtattgatcgaaataggaataatattttcatattggaccgcatctggtgtatataatgtacgttcacataatacccggtttgaggactgctgcgcatacttctttatatcagatatacttgaataaattgttggtgcaacttgaaaatcgaaagtagttacagcttccaaggcttcccgataaatcagataatgaacatccgaatttgtgacgatatagatagtcagatgttcttttgtcagacggagaattccgctcaattcgatcacaaaagcccgcatgcaattaggattcaaccgtagatcataaggtaactggctggaccagctggaaaaaattgtctggacttctttatataaatttgtctgttcctcatttaaaagataaaatttttctggcatgaataattgatagttatcccaagccgaacgcatcagatgaatcagcgcacgttcgaatggttggtttccgaataattcttgattgaagtgagattcaaaggtagcaactagttcttttatttcgggagtattgtcaataaacacttggtgtagctgttgaaagtcttccgcaatcaactgataagaatggaaaccataattacaaagattgaatagtgtcaaaataaaggcgaattcttcttttttataataggtttggaaatcagtgttttcccatgctgattcgacataattgtaaataggacgttttttgatttcttcgataaattttgaatctattgtcacagcacacacttgctggcgtaggaaactgatagcaaaaccaatcgataagatttctttattttctttatcataaaatctgccactattttccgttacggattcaatgaaacaatcggcacgttcaaaaaacgattcaggtagctcccaagaattaaaaccgcctaaacgatacgacacattaagaagcagcagacgtctttccatttcagtgaatcgaggggagtagcggtcgatttcgatcccgcagtcattaaaataagctaatacttgtttttttaatgaataagctttgctgacagagatgaattcacattcagttaattgaagataatcaggttcatcttcttccaaataaagcagacaagtttttaaaaacaacgaattttgagacaattgctgcatgatcttgcatcgaggtatatgttctgaaaaatataaagtgtaacggtccttttcccgatgtgtataagcgatctgttcttcaaattctttttttatgttattgatatcattgagcaaagtggttttgcaaacatgcaggagattggagagcttttctagattgacttctttatttacatagaattgcccacataaaaacagctgtcttaaaatatttttctcaatatattcttcaatcatagtagagcctccaccttgtattttttttgcacaatatgggaaatattatgacatgttttctttttgaaatcatcagttaatttctgaaaaagcatataaatgccgttaaaaaaggttttttatgttataaaatttggaaaacagataattctattaaaaaataaattgtgaatttttaacaatataaaaaaataaaaatatgtttagtgaatgaaggacagtcattttatttgtttgttcgctttttttaggttatctattttagatcactgatttattgaaaaattgttcgcttttttgcgttgaattatcagaaaaatccgactttatttatttttgtttgtaaaaatctacgtggatttgatgttataaaaaaaaatttctcatttttggcgctatagtgaagaggtgttacagataaacacatgtatctgcgagacattgaccaacaaaatatggagggaagaaaaatgaaagatatggatatcaaggccgtctttataggcgacaaagctgaaaatggaccagtttataaaatgttgttgaacaagatggtagatgaacatcttggatggagagaaaattatattccttcagatatgcctgcaattagcgaaggagataagctcactccagattatctagccacccgcgaccatatgatagaggtcttggatgaagtcagtcagcgattacgcgcaggatcgatcccatggcattcagcaggccgttactggggacaaatgaatgctgaaacattgatgcctgctttattagcttacaactatgcgatgctgtggaacccaaataatgttgcattggaatcttctatggcaacttcgcaaatggaagcagaagtaggacaggattttgcttcattattcaatatgacagacggatggggacacattgcagcagatggttctattgctaatcttgaaggattatggtacgcccgctgcatcaaatcgattcctttagctgtcaaggaagtgctgcctgaaaaagtgaaaaaaatgtctgagtgggaacttttgaatttatctgttgaagaaattttggaaatgaccgaaagctttacggacgaagaaatggatgaggtcaaagcagcttcttcccgtagcggaaaaaatatccaaagattagggaaatggctggtccctcaaacaaaacactattcttggatgaaggcgttagatatttgcggagtcggcttagatcagatggttgctatcccagttcaagaggattatcgaatggatattaatgctttggaaaaaacaattcgtgaattagctgaacaaaaaatcccaattctaggtgtggttgctgtcgtaggaacgacagaagaaggtcaagtagacagtgtagataaaatcgtccaattaagagaaaggttaaaagatgaagggatctatttctatttacatgttgatgccgcatatggcggctatgcgcgttcactgtttctaaacgaagcaggagaatttgtgccgtatgcttccttagctgaattctttgaagaacatcatgttttccaccactgcgtaacgattgacaaagaggtatatgaagggttcagagctatttcagaagcggattctgtcacgatagatcctcataagatgggctatgtcccttatgctgctggaggaatcgtaatcaaacataaaaatatgagaaatatcatttcttatttcgcgccatatgtgtttgaaaaatcagtaaaggctccagatatgttaggagcttatattttggaaggatcaaaagctggagcaaccgccgccgccgtctggacagcacatcgtgtattgccattgaatgtgaccggatatggtcaattgattggggcttcaatcgaggcagctcaaagattcagagaatttctcgatcatctgacttttactgttaaaggaaaaacaatcgaagtctatccattgaatcatcctgattttaatatggtcaattgggtattcaaagaacaaggctgtacagatttgaacgctatcaatgaattaaatgaaaaaatgttcgatcggtcttcttatatggatggcgatgtttatggtgaacggtttattacttctcatactacatttacacaaggagattacggtgattctccgattcgttttgttgaaagaatgggtctaacgaaagaagaatggaaaaaagaacagaaaatcactctgctacgtgcggctatcatgactccttatttgaatgatgatcgaattttcaatttttatacaaaagaaatcgccaaagcaatggaaaagaaactaaacgaaatcatccaatagaactgatttttgtgtgaaagaataacaagagacatatgaagaacagacaattatttgcttcatcaaaacaattgtatttccccctgtttttcatatattcctcgccaagatattcttttttataaaacgttctataagttggatcgttcgtttcatgtatcaaacccagttcactaagatcgttcaatggatatttcggtgatactgggttttgtactgaatcgatgaaaccttgtcatttctgttcttgaacaaaaataaaagaaaacaaaaacatatgtcgctattgaaagaaggaataaagatgaaagatactggttcatcaaagcaaatcacgaccatgacctttatcggaatgacctgcgcccttgtagcaagtgtacgaaatattccagatgtagcagcaacgagctggacgatgattttttacatgctggttgcagtattattgtacgcttttccaatctcattgatctctggtgaatttgccggaatgtttccccaaaaaggtggtccagaactttgggtatcgaatgctctaggaaaaaaatgggggttcgttgtctcatggctgttatgggtccaaatgtttcctgggatggtgatggtcgcttcagcacttgctccgttgtttggtaatattatcgataatgtgccgcttggtttgaacagcaaatttacattagttgttattttagtcgtttattggatcatcacttttttgaatttgaaatttgatatggcaaaaatcggcggaaaagtaggtgtttggttaggattgtacgtgcctttgacgatgatgctcttattagggtttgctgcgtggatcaaagttgggatcgtaccaaccggaacattaggcagtttttcatgggacaaattaataccagatactacgactgcatcctcatttgtttattttgcgccgatcatgtttatttttactggtatcgaaatgtcctctgtgtatatcactcgattgaaaaatccagttaaaacgtatattcgcggagtatttgccgcgttaatttttatatttttcgtcaatattttgaatgctttagttgtagcaaatgtcgtaccaaaaggacaaatggaattgaataatatcgcgcaatctatttcgatttattgccaaattcttggtttgccacatcttattgtgaatctgtttagtttacttgtcttcattggtgtagcagtccaattatctgcttgggcctcaggaccagcaaagacagtgacagaaagtgctagaaaaggtgcgtatccaccaaaattcaatttttggaagacgaatcaatttgacgtatccaaatccgttattttgactcagtctgtcattatctcaatctttgcacttttttatttgctgattcctggcgtcaatcaagcatttttgatgctcgtaaattcaactactgttatctactgtatcgtctatgtcatcatggggatcgcagttttgagattgcgttatacacatgcaaagttgaatcgaccatttagaattggaaaaaaagagaaaaagagcaatcttggagtttggactgtcgttattgttttatttgcggcaatcggattttctgtcggactgacgatgaaagctggaacatggatcaatctaattgcagtcacagccatcagtgtcattttgtttgtagtaccactctgtattgaaaaaataaagaaaccttcttgggaacaggaagtcgccatgctgcttgaaaaagaaaaaggtgaacttgatagaaaaaccggcaatgaaacggactctaactaatcgaaatatccagttaatcgcattaggtggcgcaattggaacaggattatttttaggttcagcaaaggcaattgcatcagcagggccagctgttattctcgtttatttgatatgcggtttggctatttatggtttgatgcgggccatgggtgatttatttttagcaaatagtacatttaactctatcagtgatttcgttgactattatttaggcaaaaagtgggcattttttgtcaattggacttattggctttgctggcttggagctggacttgcggaattaacagcaataggattgtatatccatttctggtttgtacatgtaccagctttgataagcggaggtagcgcactaatgatcttaatggcagtcaaccttgttgcagtcaagtggtttggtgaattggaatcttttttctcaatcatcaagatcttggggattttcctttttatcttattgggtataggattgagtgtctcagattttcatacccagtctatcggaatcaaagaaaattttggacagatcgatgaattactaccgtttggctttgctggaatggtagtctcatttcctatggttttattcagttttgctggaattgaaatgatcggcttaaccgttggcgagacaagtgatccgcaaaagaatttgaaaaaagcaatcaactgtctgccttggcgtattctctttttctatataggaacgattttgtcgattttatttgttgttccatggcattgtttagatttaaaagaaagtcctttagtgactatgctgcaagtgatccattgccaaagcggagcagcaattgtcaatctaatgattttggttgcttctttgtcctcagcaaatagtgcagtctacagtactagcaggattttatatcaaacagcaaaagagaaaagtttgccccattggttttgtgcgctttctaagaaaggcgtacctttacacggtattttaattacaggaatgttattttttgccggtctttgtctacatttttttgtagctgatagtcgattgttttttcagcttttagcaggcatgacaacgagttgttttctatttgtgtggtcttcgatcttgtgtgcacatgttcaatttattaaagaaaagaaacggaacactacacaaagatataaagatcttgctttgttggtgttttttacttcaattgctttcagcttgttattcgaaagcacgacacgctttattccttttttattggttatctggtttgtattcttaaattttgtatataaaagaataagcaatagaaatatcagttaggcccagatacattctgcaaaacgaattatttcagacccccctgaaataatcgatacgcctgaaaaaacttccctgcgtataataacagtatcaattaaacaggaggggataggatgaactggtacagattgacggtagaagatgtattgaaaaactatcaaacatcaacagaaggcttgtcgcaagaagaacgacagaaacgcctgactgatcaaggatataatgaaataaaagcaaggcagcagacaaaacgatggaaaaaaatagcaaagcactttactgatctgctgatgatcgtgttgatcattgcctcttttttgaaatttgcttctagtgaatatattgaaggaagtattattttattcgtagtgatcgtcaatggactcgttagttactggcaagaaagaaaagcggaagaatcattgaatggtttgaagcagctgatgggacaagaagcgatagtactatcaaacgggatgcaagaaaaaatccctgcgaaagaactggtaaaaggagatgtcattgtcttacgtgccggagatgtcgttccagcagatatccgattaatcgaagcacatgatttattagtggaagaatcgattttgacgggagaatcagaagcatctgaaaaaagtcatgccgttttgacagaagaagaatcgatcggcgaccagaaaaatatggctttttcagaaacgcttgtacaatctggttctgcagtcggtgtcgttgtagaaacaggaaacacgacagaaatcggtaaaatcaatcaagcattgcaatcggtcgaacaacaaacaacgcctctgattaagaaaatcaaccgattaaacaaacaaatttttcaaggcattctttgtttgagcctattcttagttatttttacgacatttcgctatggtatggattggcatatccttctttcggctatgattgctttggtggtgtcaatggtacccgaaggattgccagctgttttgaccatgatcctatccgttggagtacatgaaatggcaaaagaaaaggcgatcatcaaaggacttccttcggtagaaacattaggttctatgacagtgatctgttcagataagacaggaacattgacaaaaaatgaaatgacagttgtggatgtagctgcaaaagaagaagcctgcgtgttgtccattatgaaaaactgtcaggaattaaaaacaaaagaagaacagaaaacagaaaatttaagtggcaatccgacagaagttgcgctgattcgacacacagaaacagccaatctgcctttgaaaaaaatagaagcaaagattccgttcagttctgaatacaaatatatggcaacgatgcatgcggaggaaaaaggagcggtgatttacgtcaaaggtgcgccagaagtattattggctaaatcaactctttcttctgcagaacaagaagcatggggtcaaacagccacagcgtttgcgaaaaaaggtcagcgtgttttaggatttgcttacaaaaaagtagattcgaaacaggaactcacgcatgagtctttaacccaattaacttttgcagggattgccgggttgatcgatccgccaaaagaaagtgcagtcaaagctgtaaaggaatgccaacaagcaggaatctcagtgaaaatgattacgggggatcacaaagatacagcaaaagcgattgcggaacaaattggcttaaaacatactgctaaagttttagaagggatcgatttggatcttatgtctgaaggagagttgatacgacaagtaccaaaagtcgatgtctttgctcgaacgacgccagaacacaaactgcgaatcgtgaaagctttgcagaaaaatggagaaatcgtcggaatgaccggagacggcgtaaatgatgcacctgctttgaaaagagccgatataggaatcgctatgggaatcaaaggtagtgaagtaagcaaacaggcagctgatatggttttaggagatgataatttccatacgatcgcaaaagccgtaaaagagggccggcggattttggataatttgcaaaaaaccatcaatttcttcttgccaactgcattagctcaaggattgatcttgatttgggcgctgatactgaatcggccgctacctttgtccccagtacagattttatgggtcaatatggtaacgacaattactttatcttatgcattagggttcgagtcgccagatccagaaatcatgaagcgtccaccaagagatccaaagcaaggaatcctatcaggttatcatttgtttcggatcatctatgtcgcactactgatcatggttcctgcctatttattggctatgcaatttgaagggcaaagcttacagcaaaccattcttctgcaaaatatcgtcttagctcaagctgtttacatgatcaattgcagagagttgtccaagccgtcattgaaccaaggtcttttgcaaaacaaatcgctttttctttcattgggtatccttgctttactgcaggggatggttatttttctgccaatcggccagcagctaatcggtacagtaagtttaacgatgacacaacagttattgattggggcaaatgtgattcttctattcttagttgtagaaatagaaaaagggatcatgaataaactgtttcgtaaaaaagaaaaaacagctagagaattcagtcgctagccgttactataaaaaagttttgaaagtgagttcagtcaaacgattgagctcatttttcgttggaatagaagaaatgtatacaatagggatatctagagaatccagcgggaaattggaaatcaagatatctgttttttcgaaagaagtagtggaaagatcggttagttcgataggtaagaagcagacacgttttcccaagtaatcttttaattcctgctgcaagaacgccttccatgaaggttctccttggaaaataaaatagacattgaacaaattcggtttgatagaaaaaattgtttgttggatcagtaaagacaagagttgaagaaagtaatttggttcattgatttccatttctttttttagatcgttcagtaaattctctttctgctgatacaagtgtgcatattgctgatcatacgtctctaaaaaacgatggtattggcgttccaaaggttcaatcaatatcggcgattcatgatattttaatacgaggagagccaagttatcagtcagagatgttttttttagttgatcaagagacagctctgaagctagttcctctacaaacgtttcgaggacctctaaaaatggagaatgatgcaggcagcgagcggtttcttgtccatagttattgttgtaattccaactttccagaaagcagaaagaagcaaaagaaagctcagtgtctttaagataaataccttctgttaaatacaattttttcaatgcagagtcatacagggaggagagtgtgctgttgatatggatagaagaatctaatcggcaattcgcttttatacggatcgtattgataaagaaccaacatgttccgaaaatctcttctgtttcaacagctagttcagtttgactgaggtttcttaaaaattgaaaataatgggattcatggatcgaataatcctcgaaaaaatagttgttatgagtgaaaggaatcagcaatcgatgatagaaagtacgaatcgcacgctcttttccaagaatacaagctgtatatttcgtcaaatcgatctgcaagtcgtaacttgctaaacgctgattgattttagtcacatgtcttttcaatgtcccataagaaagcccatggtcggctagaaaatcatggacagcaactttttttgtaaaaagcagacttttcaatagttcgacactgactgattgtttgaaaaaaatctcccaaaggtcatttgctaataaattttgctggttttgcaaactaatccctgcttgatcgctgatgatgtcccagccttcgggcagctgagagcgaatagattgaaggtcagaataaatcgttcgttcggttgtccctatgatttcagctaattcatttacggttatctttgtatgattcagcaattgttctactaaagaaacatgacgtcgaatatctttttcggtaatgatttttttcattagtgaatacatcaatcagactcccttctattctaagaatacggagaaaataaacggtggtcaagtttcaactgatttttcaatcagtgtttatttttctggagcatttactgatgataagaatttcatcatgaatttgaaaaatgataccactaaaataaaaaaataggtgggcaaacaataatcaacattttaatagtagatgatagcaagaccaacacaggcggattgaacatttaagagttgataaaaaagaaaaatatcgaagtatttgattagcagctacttgtattcatttttctattcttacgtggtatctttgaataaagcgaatcaataagaaagagatggaagcagatgctaacgaaaaaagaactaatcgatcacatcaatgaaacatacaatttgtctccagaatatatttttaaaaaatttcctgattattgcgtattcagacatcaaaaaagcaaaaaatggtttggggtcctgatgtctgttccagaagaaaaaatctatgatgatgcaagtgaccataggatcatcaatattcttgatttgaaggtcgatcctgaacttggcggaattttgcgaggaaaagaggggtattttccagcctatcacatgaataaagaacattggatctctattgatctacgtaaaatagaaaagctagatgaactagcagatttgattgatggaagttttaaatcaacgcaatgaatgtctaggacaatagagaagaggttgtgacagaagtgtttagcttcaagaaataagaaggaatttacgaaaattgcttctcaaatttttgggaaatttcggcttattttctaagaaattacttctggaacaccgtttgttcgaaaaaagagctgcgacaagaattttgtcccagctctttttttttattttcctaaataaaattcccgcatcgtttttgcaatcattttgatcaaaggatgatcttctgtgaagctagaagataaataaattgttcgtgtcaagggcaaatctttgatttcccgcaagacgaaaggatcatttttatcgtaagaccaagaaacttttgggaaaaagctaacagctaatccttgcttgacaatagaacgtaatgtcgcaggatcatctgtcgtcgaactgatcgtcaattcgatacttttcgcttcaagtgctgcatccagtgtatgacggaaggcgttgctctttgacagcatcaagatgggggtgcgctggatatcttctaattgcagatgttcttttttcgcaagaggatgtttcttaggaatggcgacataaacaggttctttcatgataggaatattggtcatgccaggcttcatctccgaagtgatgtacagtacagggtcggtaatatcatctggtaaatgatgttgcatgatcgttaattggatatcaggatgcttttccataaaaattcggactaagttcggaatagaaacagaagctacctctaaatacaatatgacggaagtaacgatcttctcattgaccgaagacaataatttgattccttcttctaatgtgtctaatgtcttgactgcatatggataaaattcttctgcataaacggtcgtctcaatgtttctgccgctatggtaaaacaaagggacccctaattcgttttccaaatgtttgatcgcacggctcaaggcaggttgagaaataaataattctttggctgcttgggtaacattttttgtttcgaatacttttttaaaatactgcagatgaagcaatttcataattatccatcccatccatacctttttgttatggttttttctttttttggcattttttattatagcagaaattgactaagatagcagtggaaaaagtaagtgctgaggaggcgaggctcatgagtacaggtttcttatttcctggacaaggcagtcagaagttagggatgttagcggatatccctgaagcgtatatggaacgtttagaaaatgtgacggggtatcggttagttgataaagaagaaaactatcaagatacggtttttatccagctagcattactgacaaaagcagtattttatttagatgaaatggaaaaaaacggtattcagcctgatattgcagcaggacattcgatcggtgctttttgtgcagctgttgcttgtcgatctttgacatttgagcatgcagcggaactagtctatcaccgcgcagtcttgatgaaagaagcttatccaagcggttatgcaatgggcgtagtagtaggtgtgacgagaagcgaagcagaggaaatggtagccaaaacatttgatcctgaccatccagtttatctgtcaaatgaaaattgtccgatgcaacatacgttatctgggagtatcgaaggtttatccgttacgttggcagaagccaaacggcaccaagcgcaaacagcgaagctgctgaaagtccctgtgccatctcactgtctcttgatgaatgatacggtcaagaaattcaagccgtatatgcagtctgtccatctatctgatgctagatgtttgtatataaaaaatacggatggaagagccactcaggacgcagaagagattcgtaaagatttgttggaaagtctagctttccctgtgcagtggaaccaaatgatggacttggcaaaagaattaggaatggatctgacgattgaatttccccccggcaatactttgacaaagctgattcatacaaaatttggtgtagataaagggatccgtacgatcaatctagaccaacatggtattgatgacgccacgtttctatatcaaaaatggagatgactaattatggaaaaaccaaaccgcaactgggcttctaaacgcgaaaaaaaagcgcagcgattggaaaaaatcagcaacttgctcaatggcaagtatgtagaaactgaaaaaatcgtagaagtaatggaaaaactgattgctcccggcgacaaagttgtattagaaggcgacaatcaaaaacaagcaagttttctttcagaaagtcttgaaaaagtagatgcagaaaaagtgaatgatctgcatttgatcatgtctagtatctcacgaccagaacatttgaatatttttgaaaaaggaatcgcaagcaagatcgatttctcttatgctggtgcacaaagcttgcgtgtcgcccaaatgattgaagacggcacaatgaaattaggtgatatccatacttatttggaactttatggacgcttattcatcgatttgattccaaatgttgttttagtagctgcagataaagcagataaagacggcaacttgtacacaggtttcaatacggaagaaacaccaacaatcatcgaagctgcagctttcaaagatggtatcgtgatcgttcaagtcaacgaagttgtcgattctttaccacgtgtagatatccctggtgactgggtagacgttgtcgtgaaagcagataaaccttatcaattagaagctttattcacacgagatcctcaaaacatcacagaattgcaaattctaatggcaatgatggcaatcaaaggaatctacgcagaacacggcgtacaatctttgaatcacggtattggattcaatacagcagctatcgaattgttactgccaacttatggcgaatcactagggttgaaagggaaaatcgcgaagaactgggtattgaacccacatccaacgatgattccagccatcgaatcaggttgggttgaaagcatccatagttttggtggcgaagttggtatggaaaaatatattgctgctcgcccagatgtctttttcgtcggtaaagacggcacgatgcgcagtaaccgaacattatcacaagcagctggacaatatgcaatcgatatgtttatcggttcaaccttgcaattagattacgaaggaaattcttctaccgtaacaaaaggacgtttatctggttttggtggagcgcctaacatgggacataatcctggcggtcgtcgtcattctacaccagcatggcaatcacttcgcgacaatgatgatccattaggtaaaggacaaaaattagttgttcaaatggttgaaacatatggttcaaataaaaaaccagtctttgtcgaagaattagatgcattagctgttcaaaaacaggcaggcttagccaatgcaccagtgatgatctatagcgaagatactacccatatcgtgacagaagaaggaattgcttatttgtacaaagcaaaaacaaaagaagaacgtcaagcagcaattgcagcaattggcggtgttacacctcttggaatgactagcacgaaagaatcactagatagcttgcgtgaagccggcatcgtgaaattaccagaagatctaggtatcaaacgcagtgaagcgaaacgttcattattagctgcacaaacaatcgatgatttgatcgaatggtcagatggcctgtatgaaccaccaatgaaattcagaacttggtcataaaattggcgagaaaaaccttttgtcgccatttacccagatggaagaagaaagacgaataagcagaacgtgtatgctctgttttacaaaaaggggagagatccatggaacaattagcttataaatatccaacgaaacagccgatcaataagaaaatccatgtaggagtggtcggttcaggagatttggaaatcttgatgtttccaacagaaaaaacagaatctactgtaaaaatctgtacaggaagcgatggcttcggcgaagtatggaacaatgtattaacgagattttttgatcgttatccaatttcagcagatatcgtgatcaatgacttcggtgctacaccaggagttgtgtacctgcgattgacgcaagcaatggaggaactttcagatgaaaaatagttttgtagaattaaacgccagagaacgagtgaacgctctacttgacaatggacgtgaattgattgatccattcgatcaaatcatcgcgccaagtttaccagcacaaggaatcgtccctgaaagtgatgacgggatcgttgtcagccgtggcacgatcaatggcaaacaagcagtagtaatcgctatggaaggaaaattccaaggtggcggtatcggtgaagtttccggtgcaaaaatcgttgctgcacttgaacatgtgttagaagaaaataaaaaaggaaatgagatctttccagtcattgtactagatacaggtggtgttcgtttgcaagaagcaaactacggactgttatctatttcagaaatcggaaatgtaatcattgctctaaaacaatatgtaccagtcatcggtttgattccaggacgtgtaggatcatttggcggtatgtcgattacttcagcattaatgagttatttaatcgcaacaaaaaaagcgagagtcggtttgaatggaccagaagttattgaacaagaagcaggcgttcgagaatttgattctagtgacaaagacttgatttggaatacattaggatctcgtcaacgggtagaatcaaaaatcattgatgaattagtgactgatagtgtagaagcaatcaaagctgctgtcatcgcagcaatggacgaacgaaaagacacgcatcgcagtgaaagctcagcattttatttatcattacttgattctttagatctttcaaaaccaatggccattgacgattacaatgaagcaattgctaaccatcaagcaaaatcaattgacttaccagaagtagcagaaggaaatgaaccagctgcagcaagtgttggttacgattggtttgcggcactaactggcatgaaaaatccaacttcttctattagtactgtgtattatggtaaatcaagtaaattcatagaagaagccatcgtgacatcaatcgtacctgatcctaaaaacccgatgtaccgtgtacgaaacggtgaagttggtttagttgaaggtttccgcatgggacaaattttggatcacgtttacgaagaagataaagacaaaaaagtgaaacggccaatcatagttgtgatcgatgtaccaagccaagcatacggctataacgaagaattgatcggtatccatgtggctttggctaatagtgctgctgcttatgcaaaactccgtcaagctggacatccagttattggattgattgcaggaaatgctatttcaggtgcatttttagcacatggattacaatcaagccgcttgattgctttaaacaataaagaaattaccgtccaagcgatgtctaaagaaagtgctgcacgtgtgacaaaacgttcggttgctgaaatcgaagcagctgctgaaaaagttccagctatcgcttacgatatcaataattatacaaaactaggagcgatctatcatttcctagaagatatcaccgaccaagctgcttcagaacaaaatgtcagcaaagtcatcgaagcaatcaatgaagccattcaagatgtccgcaatacaaatgacacgatgctgacaaatcgatacacaaacgaaacagccaaaacattcggacgtgtcgaaacaaataaagtccgtgccaaaatggacgaagaatgggatgcataaaaaatgattcaagcacatgatattgtcctttttgataaacatgaaatagaagggttcaccttgcctgaatgggtcgttctaactgaaaagatgttcggaacagttcatcgtgcgtcgacggatcacgcagaaatactaccgattggtttacgtggacctgcccgcaatcagagatgggcaacagaaatctcaaaacatgccgtcaaacaagtcattcatccgtgggacatcatcgaacaagaatcgtatagacaagagaaaatcatggattatcctgtttatcagcaatttcatgctgctagaaacatattatcaggatgtaaatggggaatcggcggcagcttaggatttgaattatcgactgggattccggcagtaaaagaaaccagtgattttgatttgctactgtacgcagattcaccgattgaattgccaattcaggtaattcaatcgcatcctgctttttttgagcaattcgatacccaagtagtgactcggcaaggcggtttttcactaaaagagtatttgagagagccagagaaaaaaattctattgaaaacagtcgaaggacctaaattaaccaaagaactttggtaataaagaaaaagagagagaaagagatgtttgaaaacaaaaaaatcaaaatcaacgtaagtgacttccagaaagtatcagctgtaacggctgttatgatgcaaacgatattgagctttgctttggcaaacagccacagcgcaacaaatacagcttttcttggtaccttttacgtcatcgttaaatacacagcaccaatgtttatttttgcaattgtttataatatggtaaaaacaagccagcatttgtcttattgggaatttttgaaagaaaagttttttgaactagtcgttccgtatcttctatggacgacggcttatctttggctatttccagcagtccaacaacaaactccgtatacggatactgcaagctttttactgaaatatgtcacaggtgatggagcgcctcatttatggtataccgttatgatgctgcagatccaattgttcatgccgttttttgtttggctcggttacaaagtatttgctaataaaaaatatgtatggccagtattgattggttcaacgattttatatgtcgcatggtatctgttctatcaaacacaagtattgactgggccttatcatgacagctggtacttgttagatcggtttgttgctagtttcatgatttacgggatttatggggtagccgcatttgtttatcatgaaaaagtttatcaatatttggacagagtacgttatcttttcttacctgttgccttagttatcgcgttcttttctgtccgttcattgctcgcacatccaggagacttgagctttgcgaatgcgccttacttgaatacgatccaaagtttatacagtttagtcatcatctttgctgtcttcataggcgcttccaaaatgattgtaaacgattcgccaaaattgccattgttcaaatggttgtctgtttatgcttatcgtacgtatttagccaatgtatttgttttccaagtactgttattattgtttaaagatagttggctgcagttaccttcaggagtcatgattcttgtagcttatctaatgacggcaagttgtgcatttgctttaagctggttacttcatatcatttgggtagctatcaaaaaaggtttcagcaagtaatagtagaaagaaggagtgagtgtcatgataaatgacgaacgaaaaaaagcagtgactcagcaactcgctgcgttggtagaggaagcattgatcgcagaagtaacattaagtccaaaacctggattagtggatgcactggatgcgggtgcacattccgatatggactatgctttatttcttaagtctgctaagacgctaactcctttttttgaagaaatggctcaaatagcatggcatcatgctattgatcagaagttaagagaaagaattgctgagattgggcgaaaagcggaaaaggcaatgctgattgctacaaatggcatcaatacccataaaggagcgatttgggcaatggggctattgatcagtgtcattgcacaaaaaatcagtatggaacagcctttttctttatcgaaaatacttgatgatgtcagcaagcttgctgcttttcctgatacaaaatatcgtcataaaaaaaccactcatggtcatacggtgaagcaaaaatatggcgtaaatggtgcatatgaagaagcgatattagggtatccgcatatcaggcttgcaatccaagcagctaaggagctagataatgattcatatgtacagaaacaaatgcatatgttgttagttttgatgagttcgctagatgacacatgcgtattgcatcgcagtgatcagaaaacgttagtggaaatgcaaaaacttgctcatgctgctagtcaaagtgctttaccaaatcgtccatttacagcactgttgcacttttgtcaggaaaaccaaatctctcctggaggaagcgcagatctcttgtctgcaagcttgttcatgctgaagatagaggaattatggactgccgaaacatacatctgtccgatgttactcaatgactaaataagacaaaattgctaaaaaaacagtttatgcatctggttattgactcttccttttagcaaggctatgataaaaatagttttttgtaataaaagataacgaggaagacaatgaaaaaaatcaattatttagcaatcattttgttagtgggcctatgtttgtttgctctgccgacccaaggattcgctgtcgcgggtggtcatggtggaggtacatctagcggtcgaagttcgggcagaagttcatttggcggtcgttcatatgggggcagttattttggcagtcgttcttacgggtattatggtccaagtacaggtccttctagttatgagcaaacgggatttcttgcattagctgttttgtcagtaggaggggtttctgctttttctatcgtcaagaataaaagacaaaagaaaaggctgaaagcggagatattgtctcgcatgtcaggaacggctaaagaaaagaaagcacagtttctggaaatccaaaagatattcatgaagatccaatccgcttgggaagaagaaactcctgaaaaagccagaagctgttatacagacaagctgtttgccgaacatcagaaagttctgcaaaaaaacaaagcagacggtgtaagaaatcatactaaaaaaataactattcaggaagtaggaaattatcgacagatccacgaaaatagttttgccatccgaattgatttcagatgctgtgattattcagtcgatcgaaaagatgggcgattgatctcaggaagtaagacacaacgacagtatttttctcagatatggtattttgatttttctgagaaagaaaaaagatggcaagccgattttattcagccgattatgctggattgaaaaatacaacagctcactaaaaacatactagggaagggactgtgacacgacttttgtcacagcctctttttttcattgctctatagatagcttgcttaaaagttcttgggctttgttttcatcaacgctgctcatgtcaaacgaatttttcttagcaagaattttattagctagatcattcaattgttgctcgttcagattgtttttatctgaccaccaatagatattgacaggataattggtcatatcatttccatcaactgagacaacaatctggttagtaacaccagtagtttcaccatatattagatatacattttctggataaactacagatgtgttatcgattacaggcgttcctgctggtaacatgcttacgtgaagcatactttcgtttgtttgaggtctaagagttagccaagctttggccagcgacaaactagtatttgttccgtcagtatatttttttccttcttcataactagggatattagaaacatccatgaatttcttggaaacaattacccattcattaggcacaccgtaataatagcccgcttcgactaactcgccctgatcattcactctaaagcttcccatagaatcaacctgcgcatctgtatttgttactgttgcaagcgggtaaccttcccaatctgttgatagatcaacccgaaagttattagttaaaccatgtgcttttataactgcactaacccattgtttgagttggtcagcagtcagattcttggtatccacttcattctcagtttgaacggtagagctttctgaggaagaggtcacgctgttagaggtgctggagagacttgtttgtgtggtagaggcatcttttacagatgatgtgatgctcgtttgagttgaattagaagatgttgcggcgctctcgttgtgacttcctagatatttgaaagcaatgcctcctgctgtaaaagagatagctaaaagaccaataaataaaactgtttttattctatttttcattttataaccttctttattttctttttactgtttaagtatagatgaaaatgaagtataaatcgactgtgtcagaagaaatgggcaaggaaacgacattcagagcgcaagaaaagtgatttttgtatagtcttttaacaaaaggtaatcattagttactattcttctccttcttcttaaccagctaccacaactataaatactatattttgcagtgtttatattattggtacattaaagtggaaaagaaaagcttttatgtagtttaatttgcaaaaaaaagaataaatttatatctaatagatcaaaacaaaaaaataaacacacggtatttacttttttctgtttatataattactttagtaaggaagccttattatgaaatcaaggcgtcaggaaaatgctattgttttaaccgtacaactaagctggatatggaagaatatatggactatttagctgtgaaagggaaaaaatttgcttggaaattgtggtaagtacaataattatagtttaattactggctgggttgacgtttggttaattataaatataaaaaaacgcaattcatacctttaggtgaagtcaccaaaataaagggtacatcaatgcgttataagtaaaacctttaggctacaaagcacatcaatggaaaaaagtagaaaaagtaatgttaacaaaacttggaaaagttgcttagattgttaacatgatttttaaatttgataatttgttaggtgaacaaaaaagaaacaactaaattgaaatctcccccctaaaaagttagatttttggagggcatttcaaaatggatgagaaaacaaacattctcattgagtctgactattgaaaaagatgacaggccggttttattcagccaattatgttttatttattgatataattatttctgtaaagaaacaagccgaattattttgttttaccttttactacatttactccagctggtattttatacgtaccatctctttttttataagcagaaaaatgattaattaaagcttgttcatcttgtgaagtattaatagctccctttaaatgtaacgttttaaaataatcaagcaaatgtttatcattttttatatatacgtaaccatttaaatgagtatttgaatattcgctagcaaaagataatgcttttttaaatactttaaatgtatatcctctgtcgttgtgaggaaaaggtaactgttgctcaagtactgtagtaacgtaagactgttcaacagaataggcatcaaaatagaaaaataaaaaatcagttccaggatttaaaagtgaaagcaaccttacgatttgatcaatcgcttgtttttctgccaaatttaaatcttcacagggaattaaagtgttagtgttaaaatttttacgttcaaaatgagcaagcacagaataattaaatgcccaaaaactacataaaaaatcaacattatctaaagaagaggtactcctaataaattcattaatatcataaacaaaaaaatcagctttgttgttggctagttttctagttattttgtctatcatactttcactgatatctaagccaatatagttttcagaaaaaggaatgattttttcagtgattctcccggtccctactccaagttctagtatagtgttatatatcttactgtcgaggttagaaataataatatcaatttcctctttgtagctttttgtataattatcaaagaaaaaatattctggcaaataaagatcataatttgttgcggtatctttagacaagtatttggaatttttataatacatttcttttatccctttctttaatgatatagggagtcaaaataataagaccgatgaatacgaacactgccgatataaggaacatcatatgaagtgaaataaaattcatcagtaatttattgaaaaacaagagtaagatgacacctatttctgtaatgaatgacataacagaaagtatagaagacttattcttttttcctgagatgatttcattatctaaagttaatagagaactgctgataacaccgatacaaagttccaggattaaaaacaagaacaaagatatccatctgtaattagtaagagagataccaataagcgaaacggaaagaagcaacaaaaaactaagtaaaactttgttattggaattgatcttactaataatttgagcatataattcacttcctgcaattacaaatacaatgctaagcgtaaagacaaaggatagatgaaagccatattgattaacatagaatatagaccaataaactaacacgaattgcgttgcgccttcgaaacacagagaaaggatggtagcaaatacaactttcgaatcacgtaaaatcccaaagttccaatggaattgagatttgtgtttagaagacataggttggatattggggagatgcatatactttgtccagataaaaacaaacagtggataaaatagtaggcctgatatagaaaaatataaagggtaagtatcatttaaagtaaaaagtgtcgttccaatatttccgcctactagagtagcaatattttggatagcagttcttctacccattacttttctgtctaacttgattctataagcgctttctaaatcgttagcataagctaagacagcacctgaattcatagcaagtcctataccataaaaaaattctgcaaaggcaaagcctattaaatgttgagaaaataaaatgatacaaaaactaatagctattactaaagaggatccaataataatttttactctgccaattttatctgccaggataccagatggaattaatcctagtaaaattcctatattttgaaaactctttactaaactgatattactgtcgcgtatcccgttttgtgaatagtaaatcgaaaataccccggacatagaactccgaaataatgtgaacaacaaagtaaagatgataaatgtcaaagcaacgctttttattcgattcataaaatcattccttataaagactagtcatatcaaatttgtttcctaactgttcgttagctgcgtagaagtctagataatctattaacttatcaggatagtttctaccgtgtatttcatctaattgattgataatagaatcgaaatcagtaattgataaagtggatatgtttaaatactctaataactttagatagatttgataaagaatatctttaggtacttcatttaaaaataagacattaaaacgtctctccaaagctgtgtccttcataattattttatactcatctttagtagtagcgccaaataaaataatttcagggtttgtaatatagggtttaataatatccgccccagaaaaacctccgtctacttttccagcacctagtagaatgtgtatctcatcaataaaaataataaaatttaaatctaaagcagcttcaattaacatagtaaattttgattcaaattcacctcgatatttagtatcagaaataatcttattcatttctactacaaaaatagggttgtcagattgtttactaaattgatggattaaagtggtttttccagtaccgggttctcctactattaataaattattttttatttttctttttgtagtaagattaacaaaatctaattcatgaattctacctgaaaaaacagaaagtggcttattactgaaaaaatatcccatactttttatttcagaaggtaagttcggctctttccttttttttgtagaggtgtttatgattttttgagtaaaatctagtagatcagaatcagttgtctttagatgtattaagaaatcttctagagttttttctagtgaaaaaccatttgtaaaattttttatcttagcaattaataagtgaatattattagtctcatcagagtgaggtaagggaaatgtattatttaattgttgtacataattttcatttaaaattacatgtttataagtcatatttttctatttcccaagtttcagtatctaaaacaatacgttgatctatgacactcgacttagtatatccagttataaattttaccacttcaataagcgccattttagcggcaataccattgtaagggtccatgatagttggagaaaagttattatttatacgttttactacagaactattattttttgaaatattaggaatcatttctgacaaagttctagttacattaggaataataagaggtccgagaaaaatttttgagaaagcgtaaggagcaaaggtaagccaaggaacatttgatttttctgatatttcatctattaaatattcaattgaatctctgggtgtatctgcacattggataattaaatctgattctcctacgaattggacaatttgatctaggttatctttagaaacaaattcattaaatttattaatttttatagaagagctaatttctagaagctttttttctgcaatatttatttttggaaaacctatatctttttctaaataaagtatttgccttgaagtattactcaattccactatatctccttcaattaagtttagttgttttatacctatggcagcaagtccataagcgacataagagccgactccaccgattccaacaattgtaattgtgcaatctgctaatttgtcttggtattttataccattcatggcagttaggtttggtaatgtagcgaagtttttgatttgtctatcgtatttctgatagtttttatttttgatgatttgatcaatctccgcttcttcactttttataatataatacgactgttcgttgatttgtgctgctcgtctaaatttttttccaaattttctaagtagtccacattgtcattgaatgtttctttccactcgttggaaattcggttattcttcaatttttctaattccaactaaatcactcctttcttcgccatttcagcgagtatcgacgtcattgttttctttgtgttgctcaatgtgatttctggtggcttatttggtatcgctggatacgtcttgattcctactacttgaatataggtattgacacctaacggctcatagacaaacgccacgtaatcgcccttattaggctctacacgccatttcatagtaactgtgccagtgattgttggatagtcttgcaagtcttgtttcaaacgttctagcatgttccctgaaacggtgtaacgatcatcactaactggactttggacacgtataccccatttttccgactgcttacttgtatatgtgattggcgtgaagtagtaagtatcgtcttcttttttcttgccaaatccttttatctgtgttttcaaattaaaagtatcaatatcaaatttcacggaatcggtattgtatttgtagcgtatttgttcttcagtttttttaccatattctgaacgagggaagaaagtaaggtttttgttgtccggaatcactatcgcatcgtagtctttcaaaatttcttcaaccagtttcaaatagttcccattcccgaagttttcttgttcaactgtaagaaatttcttatttggatcaatgacttcccatgtaaagccgcgattatcaggtttgaaaacatgcgctagcagttggttgatagagcgtgttcctgtgattgtgtcgtactgaaagccatcttgcatggtgtagtaaatgtgcgtggctgtaactgtttttgtgattgctgccccttcggcagaaacgctcatttgttttacgataaactcttgtccattgaaaaatactgaattttcataatcgactaaatcaaaagccaattcattgaattttgttttgacaatagtgaacgaaatttcccacgtttcgttctcttgccaattttcagtaaatgtacttttatcgtattcagtcaatatttctttttttgttttctcgtagtcttggataaaaatatctttcaaattcccacctacttatacaaaaaattgaagtcccattttgactccactctagtaacattttgtatttcaatttcattcgttccaaccgctaacgttatcaaacctaaattcgtgtcaattccgcaatttacaccgttcaacttcggataaacacggtctaaagtcaaagtttggcctagcaacgtagaaaactccggatagtagatgaatcgttcccctgtcgttttgttgaaaatagtcacgttgccttctgattcaccttccaaagtgatttttagaacatgttcacgtggatcaatagcaaaatcgccagcattataaatgataaaattactggttcggtgcgtatacttataatcttccgcaactagaccttgtgaaaattgccattcattagacagtgaaaactccgataacgtggaagccatcgattcagaacaacctctaaaaacagtgaaagtcgccttgtaagttgcgtatcttagaccaacttcattcacttctactgagttaggacgaacaaagtattttttgcccggttctctatctgtaaaaacataatatccttcgtcatcgaatagaaacgcatataattcagtttcttttagttgatagtcatacatatttttgaattcagcataaaattccacttcgatagtgaacgatttgaaacttttttcgacttctctcgaaccgtttgatcctgaaaattcttggtattctacatttagttgtggtgcttttcgtacaaaagaaatacactctatgcccaatttttcttttaaagatactatctcttgattttttatgaagcgaaaatcgattaaatagccattcactttatccctcctaacctgttgtatatagcgaacgtttcaactggttacctaagtatccatttgtattgtctgcaattggtttaccatcaagtttgacacttgtgtcttttgctaaaagtttagatagcaagttattctgctgaatcatcagtgaaactaatgtttctaacgttccgctcgaatcgctactattatttacactttttggttttactcctaacttatcttgagcaatcgcaagcaactgcatcgctcttgatcgtttagccttatctaacggaataataatttctggcttgtttccttctgcgatttccgcaatttgatgttggtttacaattccaccgtttgcgtaaccatgaccacgcccaatcacacctaacatatccgaaccatagcgttttttagcgtagttgatagctgctaagatattatcgaaaccgctcattatattgccgtatcctggaaaagcattcgcagcaaatgttcccggttttgtttggagcaatccagtagcattgccgtctgctaagccgtcatttccaccaatggcaagcggattgccacctgattctgtttggatttgtcgcatccacgcatcaacataagcggatgaggttggtaagttattcattttcaaagcacgttttacgtatggtcgccagcgttctacgccactcccaccaacgctatcgccaccgctaacaagtccgccctgcggatctcttacaccgtttaaatgcacgtggtcgtagtggtcaccatcaggccatgtccgccaatcatcatgcacacctgtacctgattgtcctgaacggtcacgaaccttaccatttgtgataacatagccgattttgtttgcaaacttctcaaatgcgtaattggctgcttctgtgtatctaggggaaccattcacgactcccgatagcgcaatatcaattgcgttgtgctttccgtgtgagtatggatcgccttcacgataacctgatgttacttgaaagcctggaaacttcttcattactgcaactgcaacgtccgccaagtatttgtaaacgccttgcatgcccattgaagtgtctaaactgccaccgctaaatagttctgtgattttgttcgtcaatgcttcggtagccttgcttagaatacctttaccaacatctaaaggatatttgacaagcccttccagtacgccaagaccatttaacactttcctagccaacgctcccgggtctgttacaaaatcccatacatcgccgactacgttttttagtgtgtttcctacattaccagccacatttttcacactattccacagattaccaaagaagttagtaccttttttgtaacggtattttggtgcttttgaaccttggagttgggctgtttcttctgctgtcaagacatgtgttccttttggtgcattcaatactacgttacgtcctttaggtatgaatgcttgtccgttaggtgtgattaccgcttcagcacctctaccgtcatttaccatcataggcccgcccggatgacctccgtttggtgttccttttgcgtattgtggtacttcccattctttgagtttgtcagcacccagtttttctagtacccatgaagctccattgatgatcgcgttaactggtttacctatcgctttaagtgctgcgttgaaaatacttttgaacgcatcaacaagggcatctttaccaccaataatggcatccttcatcttgttgggtagttctgaaaaccaattgaataccgtatcaatacctctacggaatgtgtctttgatacctttccataggttaccgattgcatcagaaacattgttcttcaattcaattgctttgttgaaaatgttttttacccagccaactaccttattccaagtgtctccaacgccattgctgaagaagtttttcacgctgttccacatgttttggatgaaattgccaaacgtggttttcaggttgccaactttgcccaacaaattcattacccaattgactagcttattccaagttttggaaataccttcagtaaagaaagttttagtgctttcccatagcccttttattgaacctgaaaaaccagtccacaaaccttttactccttctaaaatccgtttgaagaatagtatttgaatccagttccatactgcttggatagaaccccaaaacaattgttttactccttcccacatcttagaaaaatcgcctgtaaataaaccagtgaagattttgatagcaccttgaatgacgttcataatcccttcgactaaacctattatgttgtcaatgaaccccatgactaaatccataacgatttttacaacgggttgtataaacgtaaaaaagttcttgattgcttcaataatctgtttaccattttcattccaaaatgtggtcatcgattttccaattttagaaaaagctccgcctatcttttctataatgggcactatatatggcgacaaagtatcgaaaattccttttgcaatttgccatgcaacttctatgccgtttttaatgtttgacatagcaccatcaaagtatgttttgatattgtcgaaaacatcctttatcttagaaattgtttctggagaaaatcctaatttagctagaacatcttccatgtctgcgttacctttgaatacgtcaaacaatgtcttaaccgcgttctttattttttctatggtatcttgtgcgaaagtaaccatttctggtgggaaaattttagttagaatatcaaagccttgctttgcttgatctccatctaacgttccaaacagcgtcccaaaagcaagtgtcgctatgtcagccccttttttcaacatgtcaaatacaggttgagcaacgttttttatgctctccattgctggcttgattttggttgttaagtcgtcaattcctttgcctatgtcactgatcaaagaagtgatattgcctttgccgaaagcattaattatttcattaatcatatttacggcgctggcttgcagatttccaaccgccccctcaatcgtagctgtggaacctgctgcctttttagctacatcagtcatacctaattgcatgaatgcttcattcaattcttcggcagagatttctccgtttgccatagcctcgcggaagtctccgtcagtataagcgcccatttctttcaatgcttgttgaattttccctgaagcgcccggaatggcatccgcaatctgattaaagttttcagttgttaatttgccagcaccgacagtttgtgtcattgccattgctaccgatttgaacgtatctgcgttaccacctgaaacggcattgacattaccaattgcctgcgttagaccatcaaagtctttcacaccgttagctgccaactgtgcagtcgtattcattacgtcgcctagttcataaaccgtttggtcggcgtaatctttcatcactgttttagattcttcaatttttgaattatctataccagcaaattgcattgtttgaacaaacttgtccattgaatcggaagcctctactgcttcatctttcaaccccatgacactgttaacaacaccgctaactgcttgtgaagctaatccagcaactgcaccaaacgaaaatgcgctttttagcgagcctaatttgtcttttagtccgtccagtttcctggctgaccttgtggacttgtcgccaaaatcttctattttttttcctgattgatcgctggagcttttgagtgcttctaattgtctactggatatttggctttgtcgttctaacttttctaatgccctttttgcatcttcggtttcatttgctgaatcgccaaactcatcagccatcagtttcacaactttgcgctgttcttcgatagctttctcggataattccgtttgtttggctagccctttttgttttgcttcaaaagctcctgcttcgttacctgcagacttcaatacttttacttcggcgttcatttgtcgttcattttctttgatttcattagataaatcattgacggctgttttggaatacaccaattctttttttgtgtcgttcaactggcgactgtaagcattatattttgcggtagcattgtttatctgtgtgttaaggttagcaacttgtttcgattcctcgccatacttgctaatcgcttcatcacggcgctttgttaattctcttactttggcgttttgcccttccataaccgtagacaagtctttcgtcttttgactaagtgcttcgtatgaacgccctgctgaatcataagcctttagattggcacgcatattcgactcagcttgtttgactttcgcattgatttcatccagtgtgttaccaaaattagtgctatctaaactaatccctagcttgatatttcctgccggttgtccttttcctgccattatttacctccttcctcaagttttaccaagtcttcagccgataaaaattgtttaatgaaatcagcaccatctacatattcttcgccactctccacttctccaaaaaggtgtaacaaataatgatagtcggcttcgtccacatctctcatcgtccaacctgcttcgattaaatctttgtagatttgatccattgctttcctagcttcagaaaaacttatctctttttgctcgccatctgctttttttcattgtttcccagttcattgatttgttcaaaaacactttctaatgccggtactaactcgctcgcagtcaaaccgtctaaaatagcatcaaatgtaactgctgggtcttggaaaatatctgctgtaattgcaatcattgaatcaattgcttctaattcagttaggtctgctttttccgctttctcgtaaaatttgatacactcacgcattgcacgtgcggaaatatcttgttgtttgaatgtttttttctttccgtcaagtttcaattgcaattcaatcattaatagttcctccttgtttttacaaaaaataaggctagccaaaaatggctaaccttgtgtatcaatttttggttctggttcttttagtgtccctgtatctgtcgttggtgtagatgcagggttaactactacacccctttgttatttaccaagtccttgaatttttgtaaggtcatgtctgttgattctacggcagtcataaatacatacccacgttcatcagaaatgaattctccttcgatagaatcggtttgcaattctacccctttgtcttcagctgttttcatgttgatatctggatgactgaattttccttttaccaatcccatgaataagcgttttccttctttgttcgctgtaaccatgactaccgacacgtaaggcgctgcagtttctgaaccaattacatttacaccattcacggttttagcaccaatgatttcgctgtaaatgccgttatccattaagtctgccacgtcaagcgtaacttttggcgacgaaacccctttacttgcaatgaagaacggtacgtttgaagcgtgtgttgtgttagaagttgcgcctaatccagtaattttagcttcgatcgctccgcctttcgacttatctgctactaattcttttagagtgcctttttcatctgtttttacgacaaaagtgatgctctcaaatcctactgttgccatctattttctctccttttaatttagtgaaatatttgctacatatcgtttgataatccgctttgcaccttccaaatcctcgtcatctgtttgttccgtgtatgcgcattgccaaccattccccctcataacctcatcaagggcaaaataaaaggcatcaacctctttcatggttgacacccatacatctacctgtacgttaaattgaatggtcaaaggattgttgcttgcgaaatcttcatagttgccatacagctcaacgattcgcccgacaggcaggctaggaacggtttgagccgactcaggcacgctgttagtgtagaaatcaatagtttttgttttttcagcgctattcaaaattgaataaacctgcgatacagcagttttcatagtcctaacctccgtttcagctcgttggcaattatttctgttacttgattttcaatttgtttttgtgttttttgtacgaaaccttttggacgttgtttgattgttccgaactcgataaagtgcatccgccaagaaacatctttgtcatagccgacttctatcaatccgttttttaccgagcttgtaaccacatggttcttagcatgttcttgcatatacgaaccacgtttaccgtttgacttcgttccatcccagtaaggtgtgttttgtcgtaacttttcttgagcgtactccccagcttttctaagtgctgggctttccactcgttgaacgtttgcttttacttccctaagcgctttgtacacttcggttgcatcgacttctacactcattttgaaacctcttttgcaatgattgtcgtgaagtccttcgcaaactcgcctttcgtaatcgtaatgatttcaaacatttttccattccaacgcactttcatatcattggttagctctgatttttgttggtagcggataatgaacgtcagtgttccttccaaagccgtaccaatcgacgtcttaatatcgttcaggcgttgtgtctgcacacttgcccagcaagtaagaatggttgtagaagtcgggacaacttgcccgtcctcatccttaacagtcatatctcggacaaacttgatgcgttgatttaaatttcctgtttgaataaggggcatacgctactcctcctccacaaaaagcaaataacttgctttgagttgcaagattaggcttgtaaaacctaaatcgtactctcgcaagttcccactcacggttgcagaacgcgctttgtaatagtgatccgctaattgcagaatagctaaattaatcagatcaactgtgtcgctttcttgcgtataaaaagagggcttatcattcccgatagcccctctaatgtatgcaattgcagcttgtaccgcacggcttacttccacatcgtcatcatcggtatcaatctttagtgcgtttttgatttcgcctaaatccgttttaggatcaagaatcataaggaatcagctccttaaactttcgtcggtttctcgttcgcaatagttgtaaatgtagccaaaacaaccgcttcatcatcaactagttgcacatcgaagcgatcgatgacgcgtactttagtggtgtctgtttcaaaagctccaccaccaatattcgttgtcagcaagctcatgttttcgcgatcatacaatgtaacggcttctttcagatcaccaatgtacagtggatatttaggagtagatttttcccctttatttggcaagaaacgagaagcaattttcttgattggtttacccaagaaagtatatccagttgcagaagttacgtctttttgtaacaagtaagatccatcagcacgtttcactttatctaaaacattgaagccatcttggtttgtaataaacatagatgtagcttcgatagctggatcaagttggacgtttacgatatctttaattccatcaacatctgtaacatctttcttttgtgccgctttgattccatcaatagctgccaagatttttgtattgcgagtaacaactacttttttcgcgatccatttagacaaccatgccaaaatgttttcggcggtatcttttagcaagctgttagttactgtagaaatacctgcgtagcgtttgatcaagtatttgatcaagtgaagtgcaggatcatcatttgctgggatttcaccgtcttcagtatccaaagcggtcagtggtttaatatcagaccatttttcataaacccgagaaccactagcagtggtcactttttcaacgtttacgtattcttgcaaagagtcaaaccgacgaaccaaagtatgaatagtcgtttgcacatctacaggaatagtcaatccgatagcattaccagattcatccgtattagatgtcaaagtagccataatagcaggatcaccattgaccatcgctttaaagtctttgataaacttgtttttcaagttttcatcttttttatctaatggttcttttttgacgtttaagacttgttcggcttccatatttgccacttgctctttcaatccgtcccgtttagcccgtgctgcttttacttgtgcttgcaaacttaccacatcttcttctgttttttcatcgtcaaccaatgctgcattgagttgtgcatttaagtcagagactttacttcccgcctcgacccacgcattttttaattgttctaaattcattcgtttttccctccatttaaggcttttagttttttttgcaagagtgtttcttcttgcggtgcttccgctttgattattaaatttttcaacttagttactgcgttttttggaataaccggttgagaggcattgagtaccgttactggtgcttctgcaaacataatttcatccgcaaaaccttccgctactgctgtttgagcatttaaccaagtatctttggccattaaatcagcaagttttttccgatcgagtcctgttttgatctcgtaagcattaacaatagactcatccacactgcttaacatttctgcatcggcttttaattcctcagcgttgccactagtggtcacccatgcgttatgaatcataatgtgtgctgtaggtgagattctaagcggttcgcaagcacaagcaattacactcgcagcacttgccgcaatgctcacaacatttccagataccttccctggataggcgcggatagcggtatatatttcgcttgccgctaggacatccccaccgttcgatgagatatcaagttctacttcatcccccgctgcttctgtaagagcggcagaaattttccctggtgagatacaattgatcccaaaccattcataaagccacgcggtatcgttatccacgacatcgccgcttaacgtcacttttttcatccttccacctcccttcggtgcaaactaaaaaagcctaaccgttttcggctacgcttttagacgaggttgtttttcttaatgttggatccatatcgattggatataggtctccggaaatatggtaatcatccataccggttttatttattggctgcaagtcctcaaagcggcgaacatcattggcagaatatgctccacctcggcgcataatctggtaaaactgccctctggcctgtgtatcagctcttagcaaacttgcgatattaaacttgtatcgataacccttagctttttcagctctcgatagtgttttcttatttagttccgcttcatattgattaacggtcggtactagattgtatgtcaaaaactccatattgagctgttcctgtgaagagtaactcgactggttattcccgatgaaatgttccggcacgttgtagaccatcgcgattctggagcgagatactttatcagtatctaaaagcttgctgtctaccagctctcgttgtaaacgttcgatttctacaccgttttcttccacaagtagtccaccgttttgtcgataaaaatcagcaatgtttttaactgtagcttttttagcttcttcatccatattgctagcaaacttaacttttagcccttcattacttcctttaagctgacttaaagagatttttcggacttctcgatcatatccgagggtattcgttaatacttttgtggggtctgtaccttccaagccgccaaacctcggttgtttaaagtggagcatttccatgtaatgtacatagataacttgcttgtaactgcctttgtcagtcgcagttacttggtagtaaagctccccgctatccatatcaatcactggatggcaagcaccaggttttactaacgccatatctgctacttctccattgatatttcggaaaatctgcacatacgcattcccttggtagtttctcaaaacttccacgtcccggaaaaaatcaaactttgtaaaatatcgagggccttcgctcaacaagttgtatgcaggacagtcgcccggttggccaaactccacatctatcattttgagagggagagacgcaaaaacgttcgatacacggctaattacagaaaaaatcccttctgatatttcatcttttccgactaaatacggtatcaatcccggatcattcaaaaaatactcttgtttgctcgctttcggcttcgctcggccaaaagaacgcaaacgatctaaaatactcattcctccacacctttcttacatattcattaaatcggaaatcgagtaataggttactttcccggttccaacaggattaaccaacatattcaacacttcggcgtggctgttcaaacttgctgcaaaaccatctatttttctactcttggactgcttagacggcatccagtttgagttgcgatccatcaccagcttgacgttggatagataccatcggtaaagcttggaattgttgaaaatcaccttaccgtccaatagcatttccttgaagttttgcattggtccgcctaatgatagaaacccttgccgaatctcgttggtttcaaatcctgcattttctagttctttatttaatcgtagcgccttggccttgtcataattgatttttacaatgtcatagattttcgaattttctacaaaccaatttaagacgtattcataattgacgtaatcaccaggaataatcgttagatctcccaccttctcccacgctttgatacgctcttgattgttatctcgatcaaatctagcttgtgggatccatgtgtgttgcaaaatgaatacctcgcctgtttcaagcggaaattctaaaacggctgcggtaaagtcttccgtttcggacaagtcaaaaccaccgacacacttcttacctttgagcgtttcaatatcgatggttttattgtttcgtttaatggtaggcatatcgacaaatgacagctcatcaatatcggaaaacaagttaaattgcttagtgatccagtcagcatattcttttggatcttttttatccttaacatagtcatctagcatgccaacaaaattcattagacaaatattcggattggctttgatccataatcttgggtcatcagcctcttccgcactgtcaagttttgccagataataaaaagtccgttcatcgatgtcatcttccaaatgttccaaacagtccacaccttgctcaaaataagacatcaacggaccatctaatacatatccagcagttgtgatataaactatcagaggctgttttctggttcctcttgatttcttgataacgttgatcagcttgtaattcgtaaactcgtggatctcgtcaaaaataccaaaatgagtgtttagcccatccaatttccggctatctgaggcgcgtggttccattttagaaaaggcgggagcataattaatgcttgatcgtttaggcttaccaaatttcttaaagagcgccggcgattgtttgaccatttctgcggccttatcaaacaacaagcttgcttgatcacgagcatttgccaatacgtaaacgttggcgccttgttcatcatcataagcgaccatgtatgtggaaaggcccgagataagacttgtctttccgtttttacgtccaacaaaaataagagcctcgcggaagcgacgctctcctgtatcacgatgtacccatccgtacatggatccaattatgaaatgctgccaaggttgcaaaacaaacgaaccaaagtcgccttcagttggtttacattttttttcgatatatctaataggccggtgacctttttcttcgtcaaagatccaaggaaaatcatctgttccttggcgctgaaaatcacgcatatgccgtttagcagcttgaatattttctttactggctggtatgcttccatcgattaatcgttccgcataccaagtagttaacaattccggatatggacattttaaaaagccaccccaagaagcttgctcctcaagatagctttgccaatagtccacacgttctgtgtaagacatatccaaaatattagaagtcgtcatcgtcatcaccaccatcatcagccatcttaatagctaacttagctctagcagaaggcgataggcctaggtcactgccaaaagaacggagattccgtgatgccgtgtccatctgtcgagagagcgggttaccaattaattcattaggttcgttaaacggctctcctctcgcctctgcctcctctttcgcaagcgcatagttcaacttgtactctcgttgtagttttcgaagctgtttttctaaagaaacgtattgcgaataccaattggagtagagagccattgtatggacgtccggattactgattaaatccacagacagcaattcatcagcgataaactcaaaggtatcctttcctagcgggtcgagccatgtcggtggtttgattttatcggtcgccattttcattttttcttcggcagccgctcgcttgcgaagttcatcggtattttttttatttgggtttccgtttaataattgtaattttgcactcttcgctggttgcggcatatcacatacctcctttctttaacatagcaggaaacattattttaacagtattgaaatttataacctttacatgattttcgtcttcctttaagacagttaactatcgagctatccaccagtccatatttttcgcatgcttccacgattgaattacatattttttctgtaccatccgggaacgtaatcaatattttctttccgtatctttttcgtcttgtagctgagcttctttttatcgcatttccgtaattaacattatatttatgagtacaccactccaaattgctcactttgttatttgtaacatcttcgtcaatatgatttacataaggcaagccttcattattttttataaactctgtagctaccaaccgatggactttatgattggtttgtttaccatccttgcacaaatttactcttaaataaccatccctatctggagttaattttcgaatcattcctgttttagccgactttatttgaccgtcatttgaaacaaaatacaatccgtcgaagccgcttacttctttccatttttctttcatcagtttgatttacctcctaaaaagtttaaaaagcggtaatagtatacaggtgggacagcaccgttcttctcaagccttactctttaatcttttagagtaggggggctaccttcatttcgctgcaaacttatctttcaggagttgaatacattttaacgatatgtgatttaggttttggtttcttcttcccgcctgatctctctggatgctctctgttgtgacaagctacacagatacattcaaggttatctacggaccagaacagtgacaggtcttccctcgcctcgactatgtgatggatgatcgtgccccttgtgttccgccctcgacgcttgcactcttggcacatgccgaagtccctagctattactacttgccttaggtctcgccatcgtttggtcttgtatagtttgtctatctcgtctctaggtctagcttctttcatttacacatctctcttgtgtccgattgtttttatatctggatacttagttacttcacctaggtactccatattgatgtcgtttgttgaaccagctaccacatcagttgttgtatggtagtgatagcttacatctatcaatccctctaacttctgacctttgtaataaacctctggtactgagtcagtatcttttagtttgatctctagtaggttcgcattacttctattatctaacgccgattcatcaatcctctttttgatctgttgcagtacttttcttcttgtcttttctgtcattattggtactactatcttatagccagtaaactcgcaagtaaagcgttcaatagcataagcgttttgaagtggcttagcactaagaacagctggatcattgctataaaaacgatctactaataacttccctataggaatggcatctaaagctctatcagtaaacactaaagcattgggataatcttcttgaattttgtaagctagatttggtgaagttacaatgttatacccttctctgatataatcttttaatttcatagtttccctcctgaaaacatccaataattacttgctaacaacttgatgtaatcatagttatcattcatttgatgtacctctcaatgttgcattggatatactcgtctttccaataaccatgaccgcaatatatcaacttgcatttatccacttcgtttggtgtagcttctcttagcatttcgacaatagagtacttccctttgatttgtacagaacgcacaacacgcactgaacaatcatcaatggttcgaggatattcattcgttagtgatacataccagtagttcctcattacgcagcctcctttgtgcaaaataaaaagaccactcaaagagtgatctaatatgtaatgcacaggcagggacgtttccgatcctgtgcttgagacatttgacgattcatttgtaccgaatcccaaatctcaatctaacctaaccaattatgtaatagcaacctacaccgattccatcgattactatcgacctcgccttgctcgtgtactttgagcgcccatttccaaccctcagttgctaaaatcgctggcaaggaatcgaaccttgcatggtcaaatcataaaacgttaaggttatccctcgacgtattgaccttatttttaagcgtctaccctttccgccacagtgacactataaaattattcttggctgctactattttttattttgcccatttttaaatccaatcatatagacattaagacagagcgcaaaaattgaaattattaacgccatcatttctcttcacccacctttttaattatttagttaaattgtatttttctgcaaattcactatcagctttttccaatgacctaagtgaaataaattttttattttttaattgatctatattccaaagagcatcttttctaatctcttttattaattctaatagaccttctcgggattcatcagatatcaacaactgatcatagtaatttttagctttatctaagtttgttttttcagtatcgctcattctcttttctatctcattattcatctctattatattattgatttcagtctttaatgtattatgatcatagaataaatcgttactaaatgattggtaagttaggcgttctttactcgaaatatcagtcaacttgatttcatttaatttttcatagtttttctctaggctatctaatattatattgagattacttctggtaacaggtttatttttcgatgattcaatagtagcatatagaacatctaaatcttgtattgctagtctgttagagttaactagtatttcattaactgatttaccatagtttgttttcatattccttaaatcattccaattatacagagctattagtaccgaaataattgatatactaaccgttattacatctttccactttatgtttttcaaatttatcacccattgtatattttacgataaatcatgtgaataaatcaaaaaacaatagacagcaacggatgatagataataagaacaatttagaaggagttaaaattcacatccttattcttaatatttccgctgctgtctatcgaagcttaattaaacgatgagggagatttcctcccttgcgttttttattttgtctcagacctatcactaatctttcgacactatcataatacaacattgaataggtaagtgattggtataaaaaaggtataaaatggaaaccaaatgggtaataaaagggtataaaaagtgtaaaaactggctacttaaaagcaaccagttctaacgatgaagcaaattggatgataattctgtttgattctactttaaccgattcttcactagtattatttctttgagcagttacataaatcgacagaccattgatgtaacgatcataaaatatttttttacgtctttcagtcacatcaggtttgtgcggatgctgaatagcagaataccctcgaataaacaatttatgcaaatactcaaattcttcctgtgcttcttctttatcgatcaacattcgttcagcttcaaagacattattagctgtagatggcggaaccaaggaataagatgccgtcacttttggctcacgaggttgtcctactctacatcttgctgatagatatgctgaaaggaaaacaccaacattatgttttgtgcggtccatatcaacatctttcgcgcttggtgtctcatatttctttacatcgaaaagtaccatcctctgattcccccaattatgatataatacttatgtcggaaatattattcatagtcggaggaatccgactttttttattttgtacgtgaaatgagttctcctgatttatacgcctcagcaaattcaaccaaagctactgccttcattctctcgatagttctatcggaatatcctaatttttctcctatttgatacatcgacatcttattaggaaaacaataactataataaagtacctggaaatggattctacttagccgtgttaatgcttcgataaccgaatctcgagtacttatcgcttcaatgatttcttcgttttgactgtcaattgtgaatttcaaatttttggtaacagtcatcacggaaaagtctattttcactggtccgaccaaacgttctaaatttctgtatctttttagtaatcgtctagcatttttccttgtttgcttaatatctatattctctaaaatgttcacaattgcctcttctccttccagttatggaataacgctcattgttgtaggatagttgtaaaaaagcaaaattaagattttattacttcaatatccaccaatctcgccactgctaaattctctttgcctttcgctaataacttgtcgcattccatcgtgttttcaatgcgaatgatcgctgagtgattatagagatgctctacatatccacgaaatggatagatgaacccttctgcttcacatcgaaccatgtcaccgactttgaattttggtttctcacgttttttagggttctttgtcggcatatctagcattaaaccgccgataccatgactactagcgtaaaatccgtcttttagtttcattatgcttcctccaattttatagataatgttttcgcagatggtgattctgctttttttaactgcactatatctttatttgctgatcttccatcaaaatacttctttgctttcctcttgttttttgtaaaaactggcttgctaccattccagtgatggaaataaactttcttaaacgaatcatctttgtaatcgaacagataaaatgctattttgaacatttattccgcttccaatggcacagcaaatggccagtaacgttcatctgctgatttaatcgtaagttcatctaattttgcgacaaaaccttttctaggttcttttgtaggaaatattctagtttcatcacttgtgatctcataatgtagatacaaatactctgttttaagttccgctgcctcttcatcccaaacttcatatggtagtctcacataatataacggctctttctcgacctcgtagcctacagcgtatgcttgagcaaataacagttgtcgttcattttctgtttcgattcgaggattcccaaaaagccatgtataaacttcgtcttctgaactgtccatcatttcatataaagttgctcccccgcctctgtattcttcgatataatccgccacaaacttcggtaccactggtttctgatgttcaccagtcttaccaaatacagcattatctaaagtgtttctcaagctttgtgccgattcaggataagcctcagctaccttattccaagcttgttcgtctgtaatttttgattcatttagtcttttcaccaactttaaagatacttcataagcgccgtaccttccttgaccatgctcatccatagcgttctcataactctttacatatttagctaattcatcaatcaattcttgtttattcatcgctgttcatcccccgataactctggattttcgtagatatttccgataacatttaaattgcgataatccgtcaagaaattaccggcatcccatttaaaacaaaattgagcgtaatctttgtcatatacaacttcacaagcttcaaatgtttcccaatcaccatttaaattatcgtcatgctctaccaaatccccttcaaatatctccacaccattcttgtctttcattcctgtggattgcataagcacatatttatctggagccatttcagcatgagtgatcaaccttcctgcttgcccatatttcatttcttgtccaattgttttacctttaaatggtgtgtaccacgctcgaaacttcggtatcatttgctgacctccttctgtaactcgccgtaaaatgaacatctgcgtctaattgcttttactctgcgttcattttcgattgtgggccgaatttcgtatgctctttttgccattttcaattgatttctagcacctcttaatgcatctgaatagatttcttttggcatcatcattcgctgtcctccaaatcactcgacttcacgaatacaccatctaccatttttcctgtgcgtcctttgatttcgttgtatgcttggttcagacactcgtacaaatccatatcattttgcatagctaaaataatcaaggttaccactacatcaccaatgccatctctcaaagcatccttctcttttctagctaacgctgctgcgacctccccaacttcttcgacagtttttaacatttgcttactagattgggcttgatctagtcctttatctttagcccactgctctacttttgtgattagttcgtccattttttctcctccacatacctaaactgtcgtccttttgaatcaatccataagctcctagctctatcccagataatgtttttgctcagaccagtaatttcagataactgttcagcagtacctgttactagaattcgatcaccatgccagattgcaatttttctcggcgttttccgtctggttttttcagcccacattgatttaccgatcctttgtacttctgcaactatttctttgtcttcttgccaatcttctgaataagtcaattcgataattcgctgcattgccgctttcttatccacgctcattttctccaatctacgaatttcccttcttaaattctctatgtgcaaatcgattgccttccttgccgtttcattgaccatcactgcctttgtccgctccagatcgtcaatctcacgctgaaggcttcgaatacgcatttgaatcacttcttctgttgtcatgatgattcctccacaattttcaacgcttcttccactgatcgtgcaacaccatataggactggttgtgtttttaaaaattcgccaaatcgaatctgctctggacgtagttttcctttttcgtttttgacttcgatataaattgatttcccatcagaattacgatgtccacatagatctgggaacccttttggcatcccgtaaaattgccgcccttcgatcgttgtcacttgtcccgcgttggatcgaaaaatcgtgcaaccatgttttgataatgcaattctgatttcatcttgaatttgatgttctgatttcaatgtaaccctccagactgtttaatcgttggtattaaagcatttaggaagattttggtggagagtttggagggtcagacccaaaaacctattcttttttatataatttactttttattttttactttaatactttattattttttttaaaccctccagaaagaaagaaaaatataatataaatactggtatatcaacgtttataagggttggagggttgagaacaaaaccctccggaaccctccagatttacttgaaaagttctctaacgttatcgtattttcttggttttaatgtgattcctttataaaccataaatccgccagctttttccttactatattttttagaaatttctctaccaaacttcgtattcgtgaatatatgctcgccattttcagaagcccattctcgatacaccttatacaattctccgccagcaatactcaaccctggtccgacatcacaacacgtttcgataaacgtgccgatctgatccatttcgcttcgataatcctgacttgcagcaaccactgactgcggtttttgaagcccttctctctgccacaacaggcaaccatcaattgcccatttaaggattccttgcaactccgtctgcaatttaaatttcagatttttatcctttttgtgatccgggatttggacagtgaatggaattaaatttaaccgtcgccagatgccatcatcggtcccacggatgatgggcttgtggttcgttgccagccacaacttgaattctggttcaaattcgaattccttaccataaaggtgccgagccgtgactttatcaccaccagtcaattgtttgaccagaccttcgtccagtcggacgccttcattcggttctgacgaagtgaccaaccgcgcacctttcaaccgtgcaatatcgctgttagcggacgactggctttgcttgaccatgatcgtttgtgcctgcatagtcatcgcatagtttcccatcaattcagaaataatttccaaaaataccgacttcccatttgacccatgaccgtagaggatgaacatacattgctctctggtagatccggtcagggagtacccgacacatttctggatatatctgattaattcttgatcattgtcaaaaatctgattgataaattcttcccacaacggacaatcaaccgattcggtatactcgatgtttgagatacgagtgaacattttgcgaatctcatgctcatgtagaagaccgtcatgcaaagacagatagccgctttgtgtgttgaacagcgttttatctttgtcgaactcttccggcaatacggatagtcgatgtttcaattcgtccatcatagcgttttttccggcattgctgcgagaacgcttgacgtgtttttctttcgctttcatcaaagcttctttggtttcatcgtctgcgccttcagggatcgttaacggttcttttcccatgatgtctactgtcgtatcgatcattttccgaacttcgccggtattgtcctgtagccaaactttcccatcgtagtaataccaagatttatcaatgtacgaatatttgactaacgttccgtagatatcagtaaaccgatccgcgttgccggtgtcgtcgtacgaatagtatttttcctcttttggctgttcctggtctttgataaaaatcttaaaatcagatttccgtttggggttgtagacggaatttgtatcagcgattgccttatttagtagagattctccgtaagttgccgatccccttttttggtcatatttgctacggatcattgcagacgctctgaaaatctcattcattttttcaaagtctctaccggtccaaaaagccaagtcattggcaaatgccatatcagcttcggattgagagctatagaacgcttcccatccaccgttcataaagactttgaatcttgccccttgggaagacgattcagcacgtttgataatttcttcaaccggtaaatcaacggtattcatcagcggattttcttctttgaattggatgatttttttatctccaacgtagcgatcatataggcgtttgatatcctttggattcggctcagttatttctaaatattttgatgcggcatttccagtcataacgaagaatcggccgttctggtacatttctacgtcgcctttcctgcgtcttccgccaggcaattctccgcgagcaataatgtggatgccagtacctgattgagaatactcagcataggatctcatgctttctatgaattcataaatgatattctcttccacatctcctgttttatatcgctcaacttcaccttctgcattatcaatatcaattccaaaatatggcggtttgaagaaaaaacctaatccactcatatcgaatgtattaacagcatcgagagcggtctggaaatcagaccatgtactctcgtcgttagatttagctttgtatccattgtttgcgttataaggaatctttgtgtgtttgtttcttttttcatcccaaactagcttgtaaacacaccactgtttgagatttttaagctctgttgggattttttcgtacatttttacacctcaattaaaatggaagattgtcatttctaaccgttgtcgctcttgaacgttccggtccgaaggatggttcatcaccatttttgaattggtgattcattacgccccgtgtgttcgttttatcccaagacttcacattgacgtttttatatccatttgactcttcagttttcacacgcactgaggcggttttcaaaacaaagtccgccagcaattcatcaaacccgttatatgattttccgtcttccaactgtagcgcttgtgcaattgccatgatcataccttcgttatatttgccggtagctttggctttccagatttttgcgaaaatgtgtttattttggaacggttgatccacatcgttacgaacgatcaaatcgatatcgataaattctgcgcctgatttagttgcgttttctacagctttgtttacgaccacttcgtacgtaccgtctttgatttcgttcccttgttgtgcttttgaaaagtctaagttaaatgttgtcatgttagttattctcctttttattttcatatttttctaagataggtttgaaatatttttcttctgctgcaagtcgtgcttgaattgcctcttctttggtgttgaaatccttttgtaagacatattctcctttgaaatataatcgtgctttccatttatttcttcgtttatcccaattaacgccttttgttccaccgacagacaaagccttaacgtaagttccttcaacatggtatttttcattagctttttttaaattaacgtagccactctcttcgcctgtcccgttaacaacacctctttttatattagatagagaagattcaaaaacttcgttatttttatttctagcgattacaatttgattgcctgaactatctctttttccagtatcacctattattgttacgccatttattattgaaccttgaacatcttctgcttttctaccaaaaataccgcccattcctacaaccaccccttcctcttactagccatgtacgcccaaccgggcttaaagcctttggctctagcaattgcgtataaatcttcaactgtggaagcttcatcttccgtcatgttgtaatatttattgttctcaaaattcaaagtaattttcgtttctccgactttcattaattcagccgattcatcgatttctaactctgactttcgttcttcaatcggctgcaactctccgcaatacggacaaatattatcgccttttggccgttcgtaagcaccaaaacaaaacgcgcattgaacaactgacacatcactatcagtttttgttttcttttttgtatctaaactccactcacgatccatatcaggcaatccaaaacggttcacattacccacatggtcaatgatgattgattttttatttggtcggtaacgcatccctctcatagattgctgaatgtacaatgacaacgattgagtaggtctcaacataattacagtcgaacaatcaggaacatcaaacccttcaccaatcaaatccacattgcacagaatttttatttcgtgtttgcgaaacgattcaatgatttccgagcgttcatcttttggagtttttgcatcgatatgtgctgctttataaccagcatcgttgaatatttcagcagtgtgtttacttgcatcgatactgtggcagtatgctattgcctgctcaccttctgctaacgttttataatgtttcaatacatcaccataaatagtatttttgactgccttatccattgatttctttgtaaaatctccagtcgaagctttctttaattcggctgtatcgatcaatttaggtgcataatattcgtatggcgctaatcggtgattttcaattaaccatttagctgacacgccctcgattaacacatcattcacatcgcctaatccgctcccgtttaatcggataggcgttgcggtaaagcctaatctcggaacatctgaataatattcatagatttttcggtacgaagcagctaatccgtgatggttctcgtcagtaataatgagttgcggttttttgattgtttcaaggtgtcgcacaactgtttggaccattccaaaatttacaagctgattatctacgcccatcttttgaaacgtatctttgatctgatcaatcaattcacgacgatggaccaagaacaacactctgttgccttttcgtgtggttcgtttagcgatctctgcaaccatgactgattttccggaaccgcacggtgatacgatacatggtgccttgtaaccatcaacataggcttgtcttgcacgatcgactaaatcattctggtagtcgtacagttccatctaaaatcagctcactttgcttacagccagatctattatccaattgatttttggcataggttgaatctgtggcttgtaaaataaatccgcgttcatcgtcttcctttaccatcaatcgaccaacaacgtcacataatcccaaaatattgtttcgaatctttcgattgatctgcggcaaagcgatgttgtaagaagatccatccgaatccgtccacaaatcgatttcttcccatgcggtccagataaggttgctgtctaaatttttcatatagcgtaggctgttcaccattctaaattgcatatattgataatcgccttgcgaaggaacgccgttgttttttccttctgcgcctaaactggacagaatacaccgttccaattcgctgacattatcgacaaccacgttgtcataaacacctacataattggtagttaaatcagccaacgtgttgccccagtcgttccaggtatcttcgttgtcgatatatacgatatcgacatttttctcacctctaaggacttttgaagtccgatcaatatcaaggatcagtgttttccctggaaaatatttagccgttgaagttttaccttttcctggagcaccgtagatcaaatatgttcccttggtttgttcgatatccgtcgccttcttaatctgcatcaaagttctcctttctattggttaaaaaagtttttcgattgtcggtatgctgcattgtcgatccactatcttcttcaactgatatagtgattcttttaatcatttacccaactcccctactttttgatctgtatactgccgtaattcgctcacacgctgttctaactgctccttgtcgttttgcactgtggacaattgttggcgcaagctatcggcttcctgctgctttgtagcgatctcctgttgcttttgctcgatttctcgttgcttggcttcaatttccttttgcttgtccgatttgatttgctcgatttctgctttcagctgctcctgtgtgcgagtgttgttggatagctgtgattcgagttctgacacacgttgcgatttcgtttgaccgtattgtaggactgtgttgaaatttgctttgatcgtgtccaaatcttgaaacgcgttgcttgctgcgtagccgataacgccgctacctagtgctagtccgatgattgctgttgtttttgctagtttgtttttcaatgttgtttctcctttatatgtttatctgccgatttaatcggttggcgtatagcagttcctggtacctttttaattcgtgaatcaattgagcgcgttggtgatcgctcatttggtttttcttgtcgtttagttcgtcgtgtagtgatctaatcttttcttttgctaggtcgtggatggatagttcctgttttagtgtgtaggtcataggctatttacccaaatacacttctgacatgccgagtaaatcagcaacgttatatagtagttctcgaaccatttcttggacatcttctgttgttgctggcttaccatcaacttttattccctttgattctgcaatttcgatagcagctttcaaagcgtcttttacgttttcgtgttccattatttctcctccttcatcatcttatcctcaaaccttttgtttggacgagttcagcaccaggaatatctccatgcttcagttcctccttcaattgctttttatccaatttgggaggcacaggggtaaagaatccttttggaattaagttctcgtttattacattgaccgatattggattattttgaattccaatgttgaataattcgcctttaatcttcgttttaccagtcttttccatttcctcttgtaaatagtgtttgatactcttagcattgttcaaaagcgatgtcttacgttcctgtagacgtttaatttcactatcgattaactcagctttcccttctacttctttaactatttttgctaagttttctgccttatactcgatcgcttcattaatcgaatcgagagtatcgcgaagaatttcttcatccaattgttctgccagttccaggactttgatatatgactcgctgagctggtaaagagttgccattcttttgtgcctcctttaataattttgcaatttgttcaaaagctaggattgcctcatctaaatccaattccacagaatcatcaatttgttcgaaagcaaggtttgtttcttcaatatcacttgcttgatagataccaatttttccattgtcataaagatcaaatactaaaattcctgacgcatctatattgcgcagtttgtattcgtcttttaaaaagatgcggtctagtgtatccgttgcaattagcatttacggttcattcctttctgtggtaaaatataaaaagatagtttatttccctgacacgatcatgcttgccggcgttcgtgtctttttttcgctctgtactcagcttcatcaagccccataaaaatccagaccatgtaaacgatcgttcctatcaacgcttgtctatttccccaaagtcctaaagcgtagatgattagcggtgcgctgaatactaatgttcgattaaactttcccatgttgacctccttttaaatactgatacaaagcgatactactaaacctccattctctgccaactttcgctgctggaatctttccagattcggcatctttagtcagcgtgcgtgtcgtggtttttaaatattccgcagcttgctttgtatcccacacttcatttgcaatctcagattctgccaaagaagctttgaggtctgagaggttaactaaagctagttgctccattggttgtttcctcctaccgaattcgataatcgcgaatgatttctaagatagtcttattagctttcggcccactccaatggccatcaataatttgctgcattcgaacacgcgtatatccatatgcagtagctaaatcttccatagttactccgttttctcgcataaacttcttgattgcagcacggccgttatctagatttgacatctattcactccccttacatatagatttgtaagtcaaaatgatagaaaaaaacatataaaaccattgactaatagtatacaatcgtatactatataaacatagttaaataagcctacaacaaaccctttattatgcaatcggtcgccaaacttaatgctataaggtgtgtttttagtttgctttttttctatcgaattaacttacaaacaaataataatacaaacttatacttatgtcaacagtataatttacattttgtatacttttatttgtttaggattggagaacattattatgacactgtttgaaaggataaaatcattagctaaccaaagagataaaagcatgaaagaagtcgctttagaattaggatttagcgaaaatcttttctatcgatggaaaacaacagaacctaaagcaagagatttacaaaaggtagctgactatttcgatgtctctgtagactaccttctaggtagagaagaaagagaaacgcctaaatttgtagatttatcagaagatgatactgtattttcttttgacggaaaagcaatatctaaggagacaatgcgtaaagcgattgcaattgctaaagctttagaagaaaatgaatagttggagtgatgggttgtatgtatttaaagttgaaagaaatgctgagtgagtataatttaaagttaatctatatggaaatggaagaaccaggtttttattatccaaaacccagaatcatttttttgaatgaaaatctatacggtgaaactgcagaagcctttcatttatctcatgaacttgcacatttcagcgcctctcattttgaattttcagttttgtacgatacttctacaacttttcactcaaaatttgaaacagaagcagataaaatagctattctaattttattaaatatctatattgagaacgaactgactgatgaatctcagtttaatctcgaaaaatttatggaattctatgctatcaataataagttaagaacagaatgttttaatgtttgccagtcttatttcaagaaaaaatactcttatgcacaataaaaaagcccgtgctgcaacacggactcatacctcatttctgagatcacaaatatattataccagaaaagagggaaacgaaatgaaaaagtctattttatgcgttggggttttaggtttgagtttagctgttttaggggcttgctcgtctaatgatggtggcaataaaaccgctgaggaatcaactacaacaatttcaagctctaccactacggaaatccaagcatcggctcaacaaacatccgaaagagatgtgattgaaatgtcgtttaaagacaaaacgttgactggacctggttacaaactcactatcgataagacgcaggtcggaaaagacaattcttccggagaagacggattgattatttggtacacgctagacaatcagacagaagcaaatatggtgcctagcgatatgttttcaatgctcacttttagccagcaagatgatacgtccgaatatgatctaacatctagtgtaggtacttttgacgtgtctgaggcgctctatcctatgtacaacgaagacggaagcccactcgaagatgacgctgcttatgatgaagctgtaactaatcaaaataactttttggatgaagtagacgctaaatctgacgctgaactgttgccgggtaaaagtgtacaatgcgtcacgggagtcgttttaaataatactcaaggcgaagtaaaaattaagctcggagaagacttccccgcaagcgaaaatcaagaactgatagttagtctaaattaacaaaaaacacgccctctcccctaccaagtttgagtgacgtgagatattagacctatatagtaggcttctttatagttcctattgtatcagagaaagagagctgattcaattatgtcagaagtaacaggatacttagaacaagtagacaatgaaacatatagactaagagctgtattaggatacaaacctgatggctctgcaaaaagaaaaagcaaaactataaaagcgaatagtaaaagagcggcatataaagaattgaacatctggttagagcaattcgaaggaatgaccgatgattcgttggatttattcaatataacttttggtgaattttatagaaaaatatggctttcagaggccgaaaaaaatttagagccaaagtcttatcataactataagcgaatgatcgagaatagatttcttgataaatttgattttatccctctaatcgatatcaaaccatacatgataaagaaaattgttgttaatgctcaaagaatcaatacaaaagatcctggaagaaactctgataaacctttatcaagaaatacaaagcttcgtatgttatacgccgttaacaacttatttttgatggctaaaaatgagtacggagtaattaaagaaaatcctgtggaaaatgtaaaaataccaaaagaaaaaggcgtaaaaaagaatatcgaagaaccttattcggaagaagaaattcatgcaatgctaaaagcagcatttgaggaaagtatagaaattaaaactttaattgttctagcatttattacaggagcaagacaaggagaaattgcagctttagaagaacaagatattgactttgataaacaagaaataagattccatcagcggatttcagaagtagatggaaaatcagatattcggttgcttccaggtttgaaaaatgatgatgatgaaaaaatagtaaccggtcctgcttatctatttgatatgttagatgaattaatcaaagagaataaaaagattcgttggaaattaaatataaagaaattaagacactattttatatttgatacaaaacaagacggaactttaccacgtggaagttatctgtataagaagttcaaacgattcaccaaacgtcacaatttgcgtcacattcgttttcacgacattagacatacatcagctacctatttgcttagcgatcctaatatgactccaaaagagcttcaaaaacgattaggacaccgagattttaatactacaatgaatgtttatggccatgtcttacgcaaagaaaaagatacagcaactacagcgtttgaaaaactattaaaaaaagatataaaataacactaaaaaattatattttcgggtataaactcgggtaggatatacaaaaacttgggataatttgcggtatataagcatttaaaaatgctgtaaattcgcttatcttcatttaaaataccattaaataacgaactcttaatcagcgggtcgcgggttcgagcccctcacggcccattgggtgccaaacccacggaacaggtaaatgttggtgcgaaagcatttcgaaaacatttacgctgttctttttttatttttcaaaataactagggctttttatttttaactcaaagtccactgtagccctttggactttgagttaaaaaagaagcataattatgaacagtaaagtttctaatataacaataattcgagaagctttgcaaaatcatgctgccaatgaactctctaaacatataggattaaatctaagtactataaaaggttaaaaagtggagaatatttaatagaaaaactaaatttacttgctgctttccccttttccattaatacaacaatcagagagtgtcttttttcgaaaaaattagaataaataaaagacacgtagtttttttatctacatgtcttccatcgactacaagttatcatttctcaaaacgtatttagcttttaattgattaattcgtttcacgttgtctacacattgcctaattaagactttcttattagaagcatcaatcccgcaataatacctaaaactccaggaattacccacaataatgttaaaagaaaaaatggaataatagctaaaatgagtaaactaataccatagaccactgttttttggttttttcttactaaaaaacctattatgaaaatcattatcgaaaaaactagggtaattcctccaaataaaacaacattcccgcttagattgactaacatatctatatccttactggttagttctgtagtatttaaagtagttgaatcaatagaagatagaaacataccacccatcaatgctaaaagactacataaaatccctgttattccactaattaaaatcaaaataaactctgtttttctcttattcatttaattctctccagattaagtgttttagaattagaaattttttgaccatagttaatagcttctaatgaacgaataacaaccactgacgtgttagaaaaataatccccaatatgttgtttcttgggtgtgaaagcagccaccaaatacccaatttgaaatacaaaattttttaatataaacctacatatacactcacgaataaagatagtttgccaacttagctctttttcctcaaagctcactactcttatcccaaaaatcattttcccaattgtttgtcctgaattcagcttagtcaaaagtacaaaataggttaaataaatagctaatgacgctataccataaaaagtaataatggatttgtcagattccagtcccatgattttgtaaaagagacctatagtagcatgggtgatgatgctaatacaaattaaatcaataagaaaagcaaaaaatcgtaaccaaaatcccgcaaatacataattaggcaaagtttcaatgccactcttcttattcattttatagccctccatagtaatacattggttttggagtatcagaaaatccaagtttttcaaaaactgaaattacacgatctgatgtagttgcctttagcccttgccattcagcaatcttattacctaaccaagaagaagcaaagccagttgtgtcatttttatattctataaccgtcgcatcagttaatttcttctctttttttagggaatctaatgcatcttcagagtaaccaatttgatccaccaacccattttctactgcttggttaccatcataaattcttccatccgcaagttctttcactgcattagtatccatatttcttccttttgctacaacattgacaaaacgatcataagcactcatcacaaattcctgtataactttattctcttcctctgaaggtttgtgttgaggtgacatcatatcttttaatgcaccacttttatacgtcgcatcagttacgccaagtttttctaataagccagaataatttaaaccagaaataatgacaccaattgatccagttgttgtttcttccgtagcaaatattttatctgatccagcagaaatgtagtaacctccacttgccgctgtatttttaaatgcagtatagataggaatatctagctttttaatttttgccatttctttagcaatctcagcactttcatatattcctcccccaggtgaatttacttctaataacactcccttaaccgctttgtcttcttgaattttctttagctgtgttaaaaaattctgatggttatattgttccctactaaaaagattgctttcacctgtatctgcaataactccattgacggatagtttgacaatctttttatttgatgcgccttcttctaacgtttcttctgtgatttcgttagatccgtaaaaaatcttatttattcctgttagggttgtatttgatgcttcctctttatcttttcctgaaattagcgcgacggtaatggatagtaacaataatccgcacgctactcccacagcaatccatcttcttttattcatataaactcctcctatattcttagtaaaaataattattttttatttagaaacacatcgacaatttgttgccaatatgttttctctcctacaattaaagacaactctccagttaatccataacgaaacggaaacgattgagttgtttttaacgttcctctcactgcataaaaaacacctttctcagtggcagtagaattttctgaaatttcatctaaagttccgtcgatcgtaatcggagccccacctttttgatccaatttaaaatgaaccttcatcccttctttaatataggtactttcattcgcaggtaaaagtgctgtaaatttcatttttgatttttcgtggatcggataaatttctgcaagcactgttcctttggctagttctgcttgtccctttgtttcttcatttaaatgaaccgttccagatacaggagcttttagtattccttttgaaagttgatcgtccaaacttttgataactgactggttcttctcttgtttttcatttagctctgtaactgtttgttttacagttgttattgcttgttctagctcttgctttcctttttccgtttgactaattctgtcattctcagaagtagttggtttaactaatttagctttttctgactgatactgttctacttctttttttagttgctcaatttgttcatttatgcttgctgaaattgtcagtttcacttgatttttttgatcatcagaaacattatttagttgttcttgccaattctcatagtttgccatcatttcttttgaaaaatcttttaatgattgattattactccaagctacctgtacttgttgccattcttgtaatttactatctgaactctcaatttgtttttctagttgtctttttgtcttttcgtatacttctaattgcttttgatcatttaattcactttgcttcaaagcgtagcggagtgattctttttctgacaacatgctctttaattgattactgtagccaaaactgtcatccgttgaaaacaaattttttcctttacttatactttcaataaatagctgagccatctttatttgttgagtaatacgttggttttcttgttctatctgagccttttcattctctattaaagaacaatccaatctaaccaacacatcgtccttatgaacaaattgattttcttttaggaagttttccattattttagcttctaatggcacttgtaacttctctattttttcggggttcaattgagccgttgtccgaataacaacctcttttttagcaaaggttaaaaacaatccaataatacataaaaaaagaattacagggtataacacccaacggtagaagctatgatgttgtttagtatagatactagaatgttcgaaccaattattattctgcataaattgtttccctctcctagatttcccataatttttgatagataccatcggcaaaacgaagttcatcgtgcgttcctttttctaccaaatgcccttcatggagaactaaaatttgatcacatgcttttgctattggtaaatgatgcgcaataaaaataatcgttttttcttttaaattgaggagataattcataattgcatgttctaacaaggtatctaatccactagttgcttcatctaaaattaatatgtccggattttttaataaagcccgtgctatggctaatcgttgtcgttgccctcctgaaagattatttccaccttcttccaacaatgtctcgtaacgtaatggctgttgattaataaattcatttagttggactatctcacaaacttctattatttgttcgaaacttggtgggctatctaaaccgaatataagattctcaatgattgttccactaaagaaaaatgactcttgaggcaaatatgtcactcgatcgcgtaatatctgaaaaggaatgtctaagtgattaatgtttccataatggatcgatccttctgatgcttcataaaaacgaacaaataactttgcaagagttgattttccagaaccactaactccaactatagccgttttactgtgcgaaggaattgtacatgaaatttcgttcaacgttggggccttcatgctatacgagaatgaaacgttttttacagtgatatcttgttgaaataattgttcagaaagcatatattcaaaagactggttcgatttttctgaatcaatcgcgaaaatttcatttaaacgattatttgcaacttgagccgtttgcattttcacttgtaaattaataatgttttgtaaaggatctgtgaaaaatactagtaaagcattgtatgtgttaagttgacctagactaattctattatccataacaaaataagaacctagccataaaattaatgcactgctaattaattgaatcaaatgtttaattccttgttgaatattatcaagcgtaaccgtacgaaatgattttttcattaatttaacaaattcatggtctatacggttatatactttctcttcaccgctatatgctttaattgtttctatccctttaagactttctatgatactagaatttacagctgcaccggctgccatttcttccctgttcgatttttcatagcttttcacgaaagcgaatattgcaactacataaaaaggcaaagagcatagagtgattaaaaacaacgtactattctgaatagctaacgtaaccccaacaagcaacaccataccaatatctaaaaatattgataacgtagcacttgctaaagcatcaataatcttactggcatcaagaaaacgagaaataatttcccctgattttctcgtagcaaaaaaattcattggtaaagttaacacatgtttgaaatactgaagcataattgccatactcattcgctgtcctaaaataataagaagataactacgactatattcaaacaatacccgaaataaatagacagcgatcaagccaatggaaattatatttaaagttgaacgtgcttgattagggatgaaaaaatcaagaataccttgaaaataatatgagcttcctatgccaaaaaacgtaatgaaaatcgatgctaaaacgatgtggaatactaatcctttttgtttccaaattataggcaaaaaagaacttaatccagctactttttctttaataggaatataagtttctctaggcataggtaataaaagaatacctgtccattctttttgaaacgcttcaatcgtttttctattttttccattagcgggatctgcaatccatagtacgtttcccttcgttttataaattacaacgtagtgcatatagctgttatcaaccaatatatgtgcaattaatggtaagataagatctctttctttccagatctcactatctgcttgaatagccacacaatcaaaagacaatttttcaaatgtctttttcaatccaaatgctgaagtaccctctaaatcagtcccagataggtcccgtaatttatgaatcgggatatcagttttaaaatattttaaaatcatcgaaaggcaagcaacaccacaatctttttcatcttgttgctgcacaaaaggaaatgattttatcacttatctaacacaactccttctaaaaaatttttatagaaaaattctcaatatagctttaatacagtgaaaatattgtctcataattccacaaaaactttgaaaacagttcttgaacactaactttttcattcctgaatcaaatttattttggaaattttactattcaagaataaacttgataagtttcaggaatatttttactgttaatcaaatacgtatgttacagtagcaccgtaaaaaatattatttaaagaagcgtgtttaaacatgcaaaatgtaaaggaactaagtattgtggaaatgcacaaactgttggtggaggcaataatgcttggggaaaattggggcaagttgtaggtggacttaccacaggggcagtaggtggtgcaggtttaggaacagcaatttgtggaccagcttgcggtgttgttggagggttatatggagctgtcgctggaggtgctgcaactggctgggatgctcgaaaaaaataaaaaaggagaataagtattatgcatattaaaaacacaaaaactacatttatattatcttcagaagagttgaaaaatattcaaggtgggagtgccgtgggagttttaggcactactttttctggggcaacagcaggagtaaaactttgttcagccggaggaccttatgcaatagctgcttgtggtgtaggtggagctttattaggtgctggattcggcatgtggaccggtgcgtaaacaattaaaaaatatcaaacctcaagattggtttgtgtcgattacgaacataggtatgttctttatcttttcaaaagtttggaatggacagaactttttactaaagcttcttgtgctagtttttataattatattaaatttttatcttttattaaagtcagataaaaattctttggaaatgtaatggtagagatatttttacaaaaggagttggcagcgctgtagttggtgctgcaggaggacctatttcggccgttacaggaggtattggtaatgtacttgtcggatgtgcattaaagcctgttcctgcaagttaaatttataaaaacaggaaagtaattatctcaaatcctatcaagtacaatcataggattgcacttgacaggataaattttttaactaaaaaatgaaaaacactttctaaaaattagtagaatttgccaaatctttcgcatcttccaccatacatttaattttaattcccctttatggtacttaataaaaacaagaaaagaactattcatttggcccttttttggttccagaccatagaaatattcctccagtaactaatattgctgttatgcacgtaactaataacagctataaaaattggtacaactttaataggattcagaaaaatttgcactagtgaaggaatctattttattagaaaaatgcaatctccctaaagaaaaaaccactaaacagtgctttctttcaacttctccttaattttttgtgctttccctaaagtaaagtttctggccaactctgaatcaaaatatagtgaacgttttttaaaatctatttctttaacgttaaagatatttactaaacacgctcgactaattcttgttaacataggatatttcttttcaagctcactaattcttccataaaattcgtactgcccatctttagtacacaatgataatctatgtggtaattttgaagcttctacaaaataaatgtcatttatatcaaaagtaaatgtttgagaacctatggaaaaaacaaatgcttgattcgtaacctgttttgttgcatctatcctttcttgcgctaataacaataactcaacaatctcgtttcgatactcatctagtgtttgatcttttgttacaaatcctaacgtttcaactcttctttttattgttacgggtaacatctcatcatgagtagttgtaaaaatgatttttgcttgaacatcatattttctgattacttctgctaattctataccgttaacttcatgatttaaatcaatatctaagaaatatattccttgctttggtcggaattgtttgaggtattttttaacttctaacggactttgtgttttcaatactatcttaaatacttcatcgtgaaaaagaatgaaattatcaataattcgttctaactgatttaattgtataatttgatcttcacataatattattggataactcataaatcctccttccctcaaaacaacaaaataacttgagtagtaaattgatacggatcgttttgatagttcacaaacatattgggattctttttattgatttcctctatactagataaacctaacccttgatgtcccttttttgttgttattccttttttcattagagtatctatagagagtagtatctctctacaactattcgatatcgaaatttctatctgtttatcatctcggtaaatagctagagacagttctctatcttgactctctatagatgcttcaattgcattatcgagaataattccaagcaccctaatacagtcaaatattggaacaggaacttcaataatagtacttggacattcgaatttacaacaaatcttattgttatttgcttggtatagcttcgctatcaacaaacttttcaaatattcattttttatattttttaaataacgatattcaaacttattggttagataagaattagaatagatctctaattcttttatttctttttccaatatcgaatcatggttttgattagcgatttcttttaaactcagcaataaatttttatagtcatgtctaaatctggcaaatttttcttgatctttttccagtgaatcagtatatttttttagataaaccaattcctttcttttcaattgctgttcatattgttctcgttgcctaatagttattctaataaataaaaatagaacaacaaacatttgaatgattaaaaatattaagacaccaaacacaaaatgatcaaatacttgatattgatgagcaacataagaaacaaataaaccaattgtaagtaaataaatcatgaatgtagcagtaagtttagaactggactgttcaacaatcctatttatagctaattttctatataaccaaataaacatcagtaagaacaaagaatcaagcattatctggaatactacataaccatacccttttatcccttcaaatgaaaacatatacgtcataaccatggaagtaataatagatctgaaatcatcaataagcatacataatagtaatttatttaaaagcactatattagttttcttcttttcctttaatataaaataacttccgattataggtatagctgcggaaacatcagtaaataattcaacaaaaaaagtgagtggtatcaataaacatacaaaaagatattttcttttgttaatatcagtattagtcatataaaataagagaaaaaagaaaaagtttcccacgaacattcttaatagataagcttttgtatcgatagtaatcaagagatcccctcctgattttaggatatcataaaaaaaaattttagttacactttttaaataatgaaaaaacacattccactaaatttgatgccggttttccttgaggttttgttccagcacctcctttaatttttttaagctcttgatctgaacattgtttagcatttagtctatttttttcttccattacgattccccctacaaactataaatacttttatggcactgattcaatatacctatttttctaatcaaaaaattttgagacatatttaatattataagtatcattaaaattgagatttatctccataatctgctcgatataaaccatttattccagcagttcttccaatttcactcaaatttcttattaattcctcttgatattcagtgaatcttattttattagtataagcagtaaaatatagataattcaccaatctatttattaaaggactgggatctaattcatatttttgtttttctaattttaaatataccttttgtaaaacctcaagaatatcagaatatttaggatctttacttatagatatatcattatataattcatgaacaatttgcttagcattttttttcattttagcacttccctggaattgctccacctaaaaaaccacctatagacattcctgcaatacaagtagttgccttggcccaatcgaccgtacatttatttttagtgcaatacactccatttccataatattttccactatgagtggtacccccatagataagttgtgtctctttaatagacaaaatttttaaatgtttcataatctaatcacccctaaattaatgtttttagactattattctaacattcattaaatttcaaaaaacaattccttcttgaaacgtagcaaaataattcctgaataagaatttaatcacttttaagtatataaactatgtatattctttaatattttttgagaatgcacttcgtacataataaactttaatcacattagtctttcatacctacgatcgatctctttgactcgcacccataaattcataatagtttgtcggcgtctttggacgtttcgaagatgagctacgcattctctttttttatagacaaaaaagatagagacgaacatggagcttccaaatttggatatttgatccaattttggaagctccatttatttcgtgtctgtctttttattttttccagctttcgactaattcttggttctctttgatccagtcttttgctgcttgctgtggatcttttccattgttgatttccaacataactttttccatatctttttctgaccaatggaaattgtctaatactttgtaagcttctggctggtcttctttcaatccttttcgaaccatcgtatggatctgctcttcgcttcccattccgttttcaggatcttctaagtatttcagatcatatttggcaaacatccaatgaggtgtccatcctgtaactacaattggttcgtgttttttgatcgcttgacctagtgcaacggtcattgctcctgaagaagatgtctcgactttccagtctttcaagttgtcatatttttggatcgtgttttcagcagccgtaactacaccagctcctggctcgattcctatgattttcttacctgcctgatcggttaactcatcgatcgaatttacatccatgtaggctggcactgctaaaccaacttttgctcctgtcaaattggcacctaggtcttcgacttgatctttatattgtgcatattgtgaaccatgagttttaggtagccaagctgaaaccatggcatctgactcgccatttgaaacagatttccacatgattgaattatctaatggcgtcatcgttacatcatagcccatttgtttcaatacttcaccgactacatttgttgaagcaacttctgtatcccattcaacataagataagttgatacgttttgtttctttggcagatgaaaaactccctataccaatcgcacctaagatcactactactacagcaccaatgatcagtccttgacgttttttacttttctgtgttgctgctcctgcagcttttttattgtttggctggttcaaatgctgtgtaaaacggtcaatgatgattgctaagataactaatgcaaccccgttgacaaatccattcccgacttgtgctctttgcaatgctgataatacgccgcgtcctaagccgggtgcaccgatcatagaggcaataacgaccattgaaagtgacagcattgttgtttgattgatccctgccatgatcgtacttttagctaaaggcaattctagtttgaatagtttttgacgacttgtgctcccgaatgaatcagaagcttctactaattctttaggaacttgtcgaatccctaaattcgtaaaacgaacggttggtggcaaagcaaagatgactgaggcaaatacccctggaaccatcccgataccgaaaaatgcaactgctggaatcaaataaacgaatcctggcattgtctgcataaagtcaaggatcggtttgataatactttgtgctttactgctttttgccatcaagatccctaatggtaccccaatgatgattgagatcacactagataaaagaacaagtgtgacagtattcatcaaatcattccatagaccttggttataaataaaccatagaccgattaatgtgaacaacgtaagtcctggacgtttcttagaaataaagaaagctgctaccgtcaataacaagataaacaaaggagctggaatcactaacagtaaatttgtaatccccgacatcactgcctgtccgatcgtttgtaaaaatgaaaataggccagaaaaagttgtcgtaaaccattctgtgatattttctacccagtttgccactggtaattgatagttcaatagattattcatgttcactcacctcgcttgtttctgctaatgcttcaatcacactacctcggatgacgacaccttttaattttccatcctctacaactgcaagtggagtcggtgagtcataaataatattgaaaatatcacttaccaccatgtctttcccaatcaccgtcacattttcatctaggaagtcgatcaatggacgtttttgcttcctagcttctaacgcttgatctgcagtgatgatccctttcaggtgtctctttctgtcaacagccatcagcatgctgacttcttcattacgcatccttgtcaatgcaacgtttggtccatcagattcgatattcgtcgtcaatgcaggtaccatgatgttttgagccgtaagcactttggaacgatcgacttcttccacaaattcacgtacataatcatttgctggattggtcaatatttcttcacctgttccgatctgcatgatttcgccgtctttcatcaaggcgattctgtccccaatccgtaaagcttcattcaaatcatgggtaatgaaaataatcgttttttgaacattggcttgcaggtccagtaattcgtcttgcatttctcgccggatcagcggatcaagagccgagaacgcttcgtccatcagcaagatctcaggatcatttgctaaagctctggctaggccaacccgttgttgcatcccaccagataactgactaggatattggtctttaaatgaaagcaaactagaattttctaatgctttttctgctttttcttgtcgttcttctttaggtacaccacggacttctaacccgtattctgtattttccaagatcgttcgatgtggaaacagaccgaagttttggaaaaccatattgattttatgacgacggacttctcgcaattcttctttgcttaacttcgatacatcttctccatcaatatagatactgcccgaagttggctcaatcagacgattcaatagacggatcaatgtggatttcccactcccggaaagccccatgatcacgaagatttctccttcttttacgtcaaaattcacgtcatacacaccaaccgttgcaccggttttctttaaaatctccgttttcggctggtgatcattcatcatatctaaagcggcttgtgtctttttaccaaatatctttgttaaatgttttacttctacttttaccaaacaaattctccttttttatgtaaattcatttttctttctgaaaaaagtgaccacactatgttaacatcatgtagtcactttgtcaaaaatgaaagaaatttgcttgtccaaactgaaaaaaacttggctaaatctttgtaaataaaaggtttagccaagttaatatttttttaatatttcacacaatcattctgcaagctgatgctccgggtaaaaaaagtttgtcatacgctgtagcgtatattcatttccaataaaatgaacgatgtcccctgccgtaaatttagcataggggccaggtgaaacaagcagttcttcattatgagaaattgcgataactgtggcgccagtcgcctgccagatattcaactcgctaattgaacggtccagatgcattgctttttctgataaagataattcaaacggaagtaaaggattcatcttatgtattcgcttcgtttgattgaccagctgatccaataattgagaaaaatgattcagctcatcttgttgcttctccacacttgccatgatttctgcttttgtatcttgtatggattgtacatcttgatattgcaataggaaatcttttgctttttccttcgaagcaacaaatgccccacttccatgccgtacttccatgattccaagatctaccagcacattgatagccttgcgggtagtctcaggagaagcattgtacgtactggcaagtgttgagcgggcatggatcttctcacccactttatatcggttttcaacgatacgttcggctaaatcaacagcaatctgctggtagcgcgggcggacgatttttttctttccagacattttctttcctctttctttttttactttccctcatcttactatgctctagcaaaataagcaaaaaaggggagaatagcctcttgcaacgactgatcatcgcttgatctgttccttttttactgggcaagctgtttgacagtcatcacaattctttccggattttaaacgagtatagacaatggcgcctgcacttccaaagattaacacacttaataagaatgtcgccatcctattcctctccttctaatgacaatatagtataaaactggttcttggattttggctgacggaacaaaacataaacgagtcctatcatcagtaaaatagcaagatacgtccctaacgctacctgtccaccctccaataagtgtcccaactgataaatcacaaaactaactaaataagctaaaccgcattgatagcctatggcgatccaagtccatttattggcattcatttcccgatggatagccccaattgccgcaaaacaaggcgcacaaagtaaattgaaggctaacaatgaataagctgctgcgggagtatatgtgtgttgtagcacttgccagatttctctgccattttcggatacttccgcatgaccaaacaaaataccaaatgtgccaataatattttctttagcgaccaatcctgtaatcgctgcgactgttccttgccagtttccccaaccaagcggctgaaaaacaactgccaggattcgcccgaaaaaggctaagatactttggtcttcagaaacaggttgagcataaaaattataagaagagctgaaccagatcacgatactagaaacaaagataatcgttcctgcttttttaacaaaagacttgctgcggtcataggtttgtcttaggaccgctgaccattgaggaaaatgatatgcgggcaattccatgataaaaggagctgtatctccagcaaacaaatgtgtttttttcaagctgattccagagaaaataattgcagtcataccaagaaaataggcagaaggagctacccaagattgatgaggaaaaaaggcccctgctactaaggcaataatcggcaactttgcagaacaaggcatgaaggttgtgaccatgatcgtcaaacgacgatcttgctcgttttcaatcgtgcgactggccatgacgcctggcactccacatcctgtagcaatcagcataggaatgaaggattttcctgaaagaccgaatttcctgaaaagtcgatccatgacaaaagcgatcctcgccatatatccgcagtcttccagaaagctcaagcataaaaacaatatgatcaattgcggtagaaatcctaacactgctcccacgcctgcgatgatgccgttcaagatcagctcctgcatccatcccgctacttgccattcagctaacaatctgccaacatgttctggtaaccatgtaccaaacaatgtgtcattgatccaatctgtccccattgttcctactgtttgaatagccagataatagatcagccacatcacaaatgcgaagatcggcaaggctaaccaacgattcgttgcaatctgatcgattttgtcactcatcgataattggaaagaatcatttgacacaacacagagtgtacatagttgggtaataaattcataccgttcattgactagaatcgtctcactatcgtcgtccaatagtttctctgttaactggatcagttgctcgatctctttttgctgagaaactgctatctcgtaatcctctcttaccttctgatctcgttcaaaatatttcattgcataccagcgtttcttgccgctttgttctcctagtacatcttcaatttcatgtaaagctgcttctaaacgtggatcatatgtacagggaacaggaatagaaggccgcttttttgcagactcctgaatcttttcgattagtttttcgattccttgctttttcaatacgctgattggtaaaactggtacaccaagaccataggaaagcttttctagattgatttttttcccttcttttttgatgacatccatcatattcagaccaatgatcataggaatgtctaaatccaataactgcgtagttaaataaagattccgttctaaattggtagcatcaataatgttgatgatcagttcaggctgttcctgaaccaaataatctcttgcaatcacttcttctggtgtataaggagacaaagaatagatgccgggtaggtcctgaatatgaatgttcggattttttttcaacgatccttcttttttttctactgttacgcccggccaattccctacatattgattcgaaccagtcaagagattgaacaagctagttttcccgctgtttggatttccgactaacgcgatattcattctttttcctccctttgtatcaagattagttcggcctctgactttcgtaacgtcagttcataccctcgcactgtcagttcgattggatctcccagaggggctagttttcggataactatttttacatttcgcgtcaatcccatatccattaaccgtcgcttcactgcgccttgtccgtggattgctacgacgatcccagtctctcctgcttttaattgatcaagagaagtccagctttcagaggaagcagtctttttattgacaaagatttgacctagtatttccctacttactgccactcgatgactttttaccagtaaaatggcattgttgcctgataaattgacgacgacgattttacttccggcaacgatcccgatattttgcaaatggcgttttgttttttcttctgtttcgattcgttcgacttgataaacgaaattttgctttgcctgcgctaaggtctgcatattgattcctctcttgtgaaataaatcatgtattaaaatcattcattatatgttctaattttcttacgtgttacgcaaataaatgagaatcattctcacatagaatactctcggtaattgagaatgtcaattatacttgtgatattatgagcgaatctttagtattgatagataaaaatgagaaaaaaatatttcttcatagttttccacaattttttctctattaaatttgctattttcccacacgatacttgttttcagctcttttttcaaaaacacaaaacttagtattccacagtttccacaacacaatatgtagtgtttgttgtttgacttttttactaagagttttatactatctattatagataataagaatgtgttagaggaggcactcaccatgaacgtaaaaatcttttctaaaaataattgtatgcaatgtaagatggtcaaacggtttttaacagaaaatcaaattgcttttgaagaagtcaatatcgatgaacagcctgaagcagtagactggttgaaagcacaaggattccaaagtgttcctgtcattacttctgatgcagaaacagttatcggattccgtcctgatcagttgcgtaaacttgccagctaacatgactaaaagaatcaaaacgtgatacatggatttgaagggcttgagacagcaccagtttttgtcgcaaacttccaaatccttttttaaagcttaaaaacaatgcaatgatttgcaatcaagcatcatcaaatacgaaatgaaggttgggcgtacgtatgagtcttaaaaatttacaagatgtcagttatttcaagctgaataatgaaatcaatcggccagtcaatggtcaaatccctttgaataaggataaagaagctttagttgccttttttgaggaaaatgtcaaaccaaatacgatgacttttccatctattatggaaaaaatcaattacttgatcgatcaagaatatatagaagcagaattcattcaattgtattcaccatcatttattgaaaagctatatcaatttttggacgagcaacatttttctttcaaatcttttatggctgcttacaaattttattctcaatatgcgttgaaaaccaacgacggttccgcttatctggaaacttatgaagatcgagtagccttcaatgcgctttactttgcgaacggggatgaagaattagcacttgctcttgcagacgaaatgatccatcaacgatatcagccagctacaccttctttcttgaatgctggacgtaaacgtcggggcgaattggtgtcttgtttcttgactcaagtcactgacgatatgaactctatcgggcgctcgatcaactctgctttgcaattgtcccgtattggtggcggcgtagggattactttatcaaatcttcgtgaagccggcgctcctatcaaaggatatgagggggctgcgagtggtgtcgttccagtcatgaaattattcgaagatagtttcagctattctaatcaattaggtcagcgtcaaggagctggcgtggtttatttgaacgttttccatccagacattattgctttcctttcagcaaaaaaagaaaatgcagatgaaaagattcgcgtaaaaactctttctcttggcgtgatcgtacctgataaattttatgaattgacacgtaaaaacgaagatatgtatttatttagtccatatagtgtcgaaaaagaatatggtgtcccattctcttatgtagatattacagctgagtatgatcatctagttgcaaatccaaacattcgcaaacaaaaaatcaaagcgcgtgatcttgaaaatgaaatctcaaaattacaacaagaatctggctatccttacgtaatcaatattgatacagcgaaccgcgagaatccaatcgatggcaagatcatcatgagtaatttatgttcagagattttacaagttcaaacgccttctgtgatcaacggcaaacaggaatatgaagtattaggaacagatatctcatgtaacttaggctcgacaaatatcgtgaatttgatgcaaagccctaactttggtcaatctgtgcgtacgatgactcgtgcattgacatttattacagatgcatctgatatcgatgtcgtaccaccgatccaaaacggaaataagctgaatcatacgattggattaggtgccatgggcttacacacttatcttgcaaaagaacaaatggaatatggctcagaggattcattagactttacaaatatttacttcatgctgttgaattattggacacttgttgaaagcaacaatatcgctcgtgaaagaaaacaagttttccataattttgaaaaatcagcttatgctgacggcacttatttcgaaaaatacgtaactggagaattccagccaaaatcagaaaaagtcaaagcattgtttgaaggcatttttatcccaactgctgaagattggaatgctttgaaacaagcagtaatgaaagatggactgtatcatcaaaatcgcttggcagtagcaccaaatggctcaatttcatatatcaacgatacgagtgcaagtattcatcctatcactcgcatgatcgaagaacgccaagagaagaaaatcggtaaaatttattacccagcgccttatctatccaatgagacgattccgtattacacttctgcttatgatatggacatgcgtaaagtaatcgatgtttatgcaacggcacaacaacacgtcgatcaaggcatgagtttgactttattcatgcgttctgaaatcccagaaggcatttatgaatggaagacaacaacgaagcaaacgacacgtgatttgaatattttaagacattacgctttccataaaggaatcaaatccatttattacgtacgtacctttactgatgatgcagaagaaatcggaagcaatcaatgtgaaagctgcgtgatctaatatcatagatagattcgcttattcatattttaattaaaggagcattctcatgtcagaaacatattatgaagcaataaactggaatgaaattgaagatatcattgataaatccacttgggagaagctgacagagcaattttggctagatacacgtatcccactttcaaatgacctagatgattggcgtacattgtctcaattggaaaaagatacagtaggacatgtatttggcggtttgacactgctagatactgtccaatctgaaagtggcatggatcagttgcgtaaagatgtccgcactccccatgaagaagccgttttgaacaatattcaattcatggaatccgttcatgccaaaagttattcttctatttttagtacactgaatacgaaaaaagaaatcgaagaaatttttgactggacaaatacgaatccttatctgcaaaaaaaagctgagcgtatcaatgaaatctacaaacacggtacaccgctagaaaagaaaattgccagcgtctttttagaaacattcttgttctattcaggtttttatactcctctttattatttaggaaacaacaaattggctaacgtagcagagatcatcaaactaatcatccgagatgaatctgtacatggaacctacatcggttacaaattccaattaggattcaacgagttacctgaagcagaacaagaaacgttaaaagactggatgtacaatcttctttatgagctttacgaaaacgaagaacgttatacagaagaattatacgatccaatcggctggacagaagaagtcaagacattcctacgctataatgccaacaaagcattgatgaacttagggatggatccactctttccagatactgccaatgatgtcaacccaatcgtaatgaacgggatttcaacaggtacaagcaaccatgacttcttctcacaagtcggaaacggctatttgttaggtcatgtagaagcgatgaaagatgacgattatttgattggattggaataaggatttattttaattcaaaaatttttcgaaaaataaaaagagtttagcgtacagatattttaaatgtacactgaactcttttttatgcttattcacttgtttcttccagcacttttggactgtctaacttttccgaaacatgttccattcttctcaataaatagattttccggatatttaatattatcgtcttaatcactgcatagacaggtatgcaaatcagcatgcctaatattcctgcgacacttcctgctccaatcaataccaagatgatcgtcaaaggatggatattcattgatttcccaaataacaacggcttgatcaaatttccatctaattgttggatcactaaaatcgacaacgccatatacaaagcttgaaatggagagataaacaaaccgacaatgattgctggtaccgctccaataaaagggccgacatacgggataatattcgtgattccgcaaatgaccgcaagcaacaagctataaggctgatcgaatattctcattgccaaaaagctcattacaccaataatcaaagcatctaagatcgtactgctgatataggcagataatgtttcgtttaattcttttaccgtttggcgtaactctttacgaatcgctttcggaaagaagtgagacaacgcatcaataaatttgtgcccatccttgaacataaatagcaaaataaatggaacggtaaataacaaaataaaaaattgcatcataaatgaaatgatttttgagacacttgcagataaactgactaatatgatattgaacaaattactaagagataaatttgctgatgctaattgttcttccaaattgaaatttttaaactcttcccgctgcgccaattcatttaaccatttgcttgtttcatctgcatacgttggcaagctctgggtcaattgaattgtctgttccattaactgaggcactacattcatgacagttaaaacaactaaaatgattacgaccaaaaacgtcaataaaaaaccgaacactctcgggatccgatgcttttcgagaaaaacaacgattggatcgaacatataatagataaaaccagcaacaagcaatggtaaaaaaatagccgaaagcattttcaatattggactaaaaatattcggcatttgtaaaataaagtacacgccgatgatcgtgagtactagctccactgtccagaaaaatagttttgattgtttaaaacgtgattgcatacatctcctccaaggtcctttgatacttctattctatcatttaacaaagagttacgcgctgagattttcatttgcttaaaaaaaaaaaaaaaaaataaacatattttaatgagtagacgagtacttaaacaaaaacacggtttggagtagtgacaaaaatcatactgcagtccctttttccaaataaacggtgttcaaaagcttgcatcttcttaataagcccagccaaacgaaaaatataaggaactatttttatttggctgggcttattacttgatgtaggacatctattttacaacctcagatcatttattgcgcaatactgactaaatgcagctttgtgatatttttgtgtacggacaactcctcgatcacatcggcataagtgagcccttttggaagatcaatcgtatagatatttttgtacactcggtagtcatcaacgaattttacgtcaaaattcacatcttcgattacgatatttttctcttcaaaataatcggtaagaaaatctttggtttcttttctatggataaattggatttctaactttttagtcgtaggtacatggatcacgcgtttcactactgtgagtgcaatagcaatcccgataaaactgatgatcgcaatggaatagtaacccatgccgatggcgatccctaatccagcaatagcccataaagaagcggcagtcgtaagtcccgtcaccgattgtttcgtgacgatgatcgtcccagctcctaagaaaccgacaccactcaccacttgagcaatcagccttgcttcatctgaacgaatcgttccagcaagctgtggatactctaaagcatctcttaatgctccactagcgatctcaacttggatcaatgcaatgatacatgctcccatacaaactaaaatatgcgtacgcatacctgctggacgatttttatattgtcgttcaaaaccgattgctccgccaaatagcatagcgatccctaaacgtaaaataatctctggaattgtcaataccatatcattcatctaaacaccctccagtccaatatatcatgtctgaaaggagcagacaaaaaaagtgcaatttttaccttttacgaaaaaaggactgtgacaaaatttttgtcatagtcctttttatgaataaacggtgttcaatcagctgaccctcggtattagctcaacaaacggcaaaatatggggagctatttttcctttgtcttctctaatactcaggtcaaaacgctgatttcacaacctctttagcctactattgaaaattacaacttacttgctgcttcttcatcgatgatcacaacaacattgtcgtggttttgcaatacacttgctggtaaatgattcgttacaggtccttcaatcatccctttgattgcatcagctttgctttcgccaaatgccatcaagacgatttctttacttttcataattgaaccgattcccattgaaacagcttttgttggtacatcttctgctttatcgaagaatcgtttgtttgcattgattgttgattctgttaagtcaactactgaagtcgttccgtcaaatgaagcaccaggttcattgaaaccgatatgtccattttgcccgattcctaagatttggatatcgattggatgtgcatcgatgatttgatcatactttttgcatgctgcttccagatcttctgcttttccatctggtacaaacgtttctttgaatggttttttatcaaataactggacatccatgaaatgacggtagctttgttcatctgaaccgcctagtccaacgtactcatctaagtttacagaagtcatttcactgaaatccaaatcgcttgaagtcatttctttatataaagtaactggtgtgcttcctgttgccaatcctaatacttttgcacctttgttcataccttctttgatgatttcaaatgctttttttccgccttcttcagcgttttttacacgaatgatttccatagtgattgctcctttgtattttggtatagcccaattatagcattctttttttctttttacaataattagtatagaccaaattgcatttttttcattttcttgacaataaataggaatccgtgttaggtttcataagatggttcaatcaaacaatccatgttgcatgaaaaccaagcaagtgattcactgtggacgctttatgtctgcagtttttttatgaaaaaggagttattatgagtatactgacattaaacaacattacccagcaatttggcgacaaaatcctctatgaaggtgtcgatctgcaattaaatgctggcgaacatcttgggctgattggacaaaacggagccggtaaaagtacattgattaaaatcatcactggtgagatcttaccagatgacggacagatccattggcaaaaaaatattcacaaaggttacctcgatcaatatgtggaagtcgatgaaacattaacaatcgaagaatttctaaaaactgcgtacgcaaaagaatacgaaaaggaagaaaaaattgcttttctttaccaaacatatagcgagaccttcgatgattccttgctggaaaaagctgggaaactccaaacggaattagaccaaggagtgttttatcaaatcgacaccttagttgctgagatgagcagcgggttggggatcgatgtcttaggtttagattcactgttgaaaaatctaagtggtggacaacgttcaaaggtgattttagcaaaactacttttagaaaacccagatgttctgatcttagatgaaccaaccaatcacttagatgatcagcatatccaatggctgacgcagtttcttcaggattttgacggtgcgtatatcgtgatttcccatgaccaagaatttcttgatcagatcaccacccatatcgcagacatcgagtttggaaagattactaagtatactggccatctaaaacaagcattgaaacaaaaggaacaaaatcgcgaaagctatttgcgccaatatcatgctcaacaaaaacaaatcgaaaagaccgaagcttatattcgaaaatacaaagccggttcccgatcaacgatggcaaaaagccgacaaaaacaattagataaaatcgaacggctgacgcctccagcttcagcaagtaaagctgtctttgattttccattctcgcctattgtcacgacattagcagtggaaacaactgatttagtcatcggatatgatcgaccgctacttgcacccatcaatttgaccatccgctttggtgaaaatattgccattcgaggcttcaacgggattggaaaatctactttattaaaaacactgatcggtgagattgaaaaaataagtggcgatttccacttcccagataacacaaaaatcaattacttttcacaagatctgtactgggaaaatccattagaaacaccactacaatatttaagcagtcaatttccaaaagcgactatcaaagaattacgtcgccaactagctaaagcagggttagttaatcaattagcaagtgaacctctcactacattaagtggtggggaacaaactaaggtaaaacttgcacagttgacaatgaaccaaggcaatttactgattctcgatgaaccgacgaaccatatcgatcaagaaacgaaagaaagcttacaagacgggatacagaaatttccaggaacagtaatcatcgtctctcatgaacaagaattttatcaagatcttgtgcaacgagtcattgagattgaaccaaaataaacgtttgattgaatagttgaaaaaaaggagctgtgacaaaagttttgtcacaactccttcttctgaataaatggtggccaattagctgaccttcggtattagctcaaaaaacggcaaaatatgaggagctatttttatttggctattcttattacttgatgcagaacaacttttcacaacctcttttcgtctattttttattttcgagatttctctttcctttaaaaacaactgtttgaaagaagaacgcacatccttgaaaaacaagcccgctaaccgttacacctaaccagccatactgctgccacattgtcgtccctagcaatgaaccagccgcacctccaataaagtacataaacataaatacagtattatttcggttgcttgctgcttcacctagcccttgtactcgtgtttgattggcgacttgaccaaattgattcccgacgtctaataaaataatagctaaaagcaaaatggccaaatggcttccgccaaccaataaagcaataaagcttattgtttgcataacaagtcccatatacacgatttttctttcagaataagaatctgccagtcgtcccacgataggtgcagcaactgctccagacaaaccaaaaatcgctaatatccctgcttcgaatgttccccaattgtaggcgggactgctgatataaaaaatcaacgtagaccaaaagatcgaaaatgttccaaacatgaaaaatccactgactgccgcttctcttaatagacgttgagaagcaactaaatgcggcaaacttttaagtgaatcaaggtatgaaacagctgtactactttgctggacagaacgcggcattttccagtaaagcagaagtgtaagaattccgactgcacataaagcaaataaatagatcatccgccaagaaaaaagacttgcaacaatgccagacaccgtgcgagaaagcaaaatccccacgagtaaaccgctaagcaatgtacccatgaccttccctcttgcttttggtcccgctaataccgcaccataaggaatgatgatctgtggtacgatcgaaagtaacccaatcaagaaagaagcgcatgcaaataacgtaaacgaaggcgcaaaaaaagcggccaacagagagacggcagataacgctgccattcgaatgatcaattttggacgatccaccacgtcccctaaaggaactaaaaacagtaaccctaacgcatagcctaattgggtcaacatcgtcaatatcccgactgcacttgtgctaacagataagcttgctgctactttcgttccaatcggctggatataatacatattggcaacaacaacgccacaagtgattgataatagtaaaataagcgaagttgttaaaggtgttttttcattactcttcattgatttcccccatttcctatcttagtttacaacttatggaaaagattggaaatagaaaaatacaactattcgccacacttattatttgtgcttttgttttccttgttttttcttgcgatctttataaataaagacaactaaccctactagtacagtaacacttgcaaccaacataactgcagttttattatatccatgaaacagagcttctccaccacacgcatacaacacagacgaagggatgactccaatcacgatcgacaatatgatttgctgtagaggcaatttcatcgcatctgcagcaaaattgaccatagaagatggaataaccggtatcatatagcctaacattacacctatttttggatgtttcatttgccgaatggattgcacccaatgattcgtttcggttttcttatctaaaaatttcaatcggtgcatcaaaaacacagcggagatattgcccaaagcattccctaaaacattgatacctgccccaataaacggaccaaagctcaatccggcaatgacaccaataaccgaagtagggatacccggaacagcacacatcaccgctgtcaatacgatcaagagtatcgatgcaaaagtcccatgcgaacgaatatgtgcgagtagctctgccttactcgctctcggatttaaaaataattggatgtctgtctgatattctaaatacaaccgatagcccactaccagtatcagaatgattcccaacgagatcaacatcaatcggattattttctttttcatatttcctcctgaaaaaaatctatattcattaaataatagtttaacataaaaacaaaaaagcaccgaaatccaacataggatctcagtgcttttaaatagtaaaaattatttaacagttacagatgcgccaacttcttcaagtttagctttcaattcttcagcttcttctttagatacgccttctttaactggtgcaggagcgccatcaactacagctttagcttctttcaagcctaagccagttgcttcacgaactgctttgataactttaactttttggtctccagctgcagttaattctacagtgaattctgtttgttcttcagcagcagcagcgccaccagcagcagctacagctacaggagcagcagcagatacgccaaattcttcttcaatagctttaactaggtcgttaagttctaggatagttgcttcttttaactcagcaacgatgttttcaatgttcaatgccattataatttcctccgtttaattgttcttttttatttaatgctttatgcggcaattaagctgcatctccatcttctttgtctgccactgctttgacagcgtaagccacgttgcggactggcgcttgtagtacagatagcaacatagatagaagtccttcgcgatttggcaattttgccaatgctgtgatttcttccaatgaagagactttaccttcgatgataccgcccttgatttctaatgcttttgcttctttagcaaattcgtccatgattttcgctggtgcgactacatcttcgttactgaatgcaacagctgtaggtccagtgaatacttcgtccatgccttcaaggccagcttttttagctgcacgtgaaagaatagaatttttgataactttcatttctacgttagcatcacgaagttgtttacgtaaacgtgttacttcatcaactgttaatccgcggtagtcaacgactactactgatgcagctgctgtaaatttttcgcttacttcatcaacgattgctgctttttttgcgataattgcttcactcatttttgagtttcacctcctgaattttgatggaagagttttttgcactgaaaaggcaaatcacttttatagttactttgctcaaccagtattgttcatcatctcttcacttcgttcatagtgattctactcgctttgctcgaaaggaaactcctttcgctttgctcaaccagtattgttcatcatctcttcacttcgttcatagtgattcacaataaaaaactctatgccaccgcagacatagagggactattgaatatattcaataaacgtcctcggtaggaaattaaggcttgatgccacctactgtcttcggtacaagttaattattaacctcaactagcttagcatgctaaactagttgagtcaagaattatttttcagttggatcaatcaacattctaatatttaattagaaagaagcttggtcaacatggataccaggtccaaatgttgttgtgatcgttacatttttcatgtattgacctttagctgctgatggtttagcttttagcaatacatcatggattgctgcaaagttttcaactaatttttcatcgtcaaatgaaacttttccgattggtacatggatatttccagctttgtccacacggtaagttactttaccagctttcacttcgtttactgcttttgttacgtccattgtaactgtaccagttttagggtttggcattaagccttttggtcctaatactcgtcctagacgacctacagtagccatcatatcaggtgttgcaacaactacgtcaaagtcaaaccatccgttttggattttttgaaccatgtcgtcgtcacctacgaaatctgcaccagctgcttcagcttcttttgctttgtctcctttagcaaaaactaaaacagtttgtgttttaccagttccgtttggtaatacaacagcaccacggatttgttggtctgcttttttagggtctacattcaaacggtatgcaacttcaactgttgcatcaaattttgcaatgtttgtttcttttgctaaagctactgcttcggcaacaggataaactttacttgaatcaactttttttaatgcatcttgcatttttttgctctttttagccattttggttcctccttgattgtggttataacggttgtacctcccacgtgttctatatctttcaatatagagccaactgagaagctgctgtcttagggtgtatagattattctacagtgatccccatgcttcgtgcagttccttcaaccatgcgcattgctgcttcaacgttagctgcgtttaggtcttccatttttaattcagcgatttctcttacttgatcgctagaaactttcgcaactttatttttgtttggttcgcctgaacctttttcgattttagctgcttttttcaatagaacagcagctggcggtgtttttgtaacgaatgtgaatgaacggtcttcgtatacagaaataacaaccggaatgatcaaacctgcttgatcagctgtacgagcgttgaattcttttgtgaatcccatgatattgatacccgcttgacctagtgcaggacctactggtggagctggagttgctttacctgcaggaatttgcaatttaacgattttttctactttctttgccacgagacatacctccttaagtccgtgatgtggttaattggagatgcatatttctcctcccacgttttatctgatctgaaaaaatccagacaaataatgtgcaaaacaatgcacactggtacagtatagcaaatttatttgttttttcaagatttttttctgctatttttacattttgcttgaataaacgctaaatttattctaaaaaaacaacaatttttcgttcccatttcttcttttatgttacacttgcgctagcatggttcaacagatgaaagcaaacaataacacggttttttagacccttgtacaaagattcctacataacaaaatgaggtggagaaaatgaaagatttaaggtatagaagtgtctttgatattattggacctgtgatgattggtccaagtagctctcacactgccggagctgctagaatcgggaaaatcatacgtagtatatttggcgaacaacctgattctgtagatatttatctatatgaatcatttgcaaaaacctatcgggggcacggaacagatattgcattagttggcggcctgttagggatggaacccgatgatgaacgtttagctgattctttgaaattggcatatgaagccggtatggaagtcttgtttgttcctaagagtgaaaaagccgaacatccaaactctgtaaagatgcttctaaaaaaaggaacacgaaagctttcagtcactggcatttcgatcggcggtggcaatatccagatttctgaattgaatggattcaaaatttctttaagcatgggtactcctaccttgatcgttgtccaccaagatgttccaggtatgattgctaaagtgactagtatactttctgagaccaatacgaatatcggcactatgacagtgacacgggaatcaaaaggtgaaaatgccattatgataattgaagtagatgatcctcaagtagaagaaacggtaaaaagactcaaacagctgccaaatatcgacagcgtaaattatttcgattaaggagctaaaaaaatgtttttatcgattgaagaattagtagatcaagcaaaagcttatccaagtgtagcagaattgatgattgcagttgaaatggaaatgagtggccgttcccgtagtcacatcatcgagatcatggaaaaaaacctctcagtaatggaacaatcaatcaacgagggaaaagaaggtgttacctccgtcacaggaattaccggtggtgatgcaaaaaaattagatgattatttaaatgaggcagactttttaagtggagaaacaatcttaaaagctgtacgcaatgctgtagctgttaatgaagtcaatgcaaaaatggggttgatttgtgctacaccgactgccggaagcgcgggtgttgttcctggtgtgctgatggctgtccgagatcggcttgatttgacacatgaacagcaattggaattcttatttaccgctggcgctttcgggttagtcatcgcaaacaacgcttctatcagtggtgcagaagggggatgtcaagcagaagttggttctgcaagtgcaatggcagcagcagctttggtttgtgcaaaaaatgggactcctcatcaagcagcacaagcagtagccattacattgaaaaatatgatgggactgatttgcgatcccgttgcaggcttagttgaagtcccgtgtgtcaaacgtaatgctttaggctcttctcaagcttttatctctgctgatatggcattagcgggtatcgaaagtgtcattccgccggatgaagtcgttgctgcaatgtaccaagtcggacgtcaaatgccgtcgattttcaaagaaacagcagaaggtggcttagctgttacgccaactgctaaacgacttgcggaagagattttaaataagagggcgtgataaagctccttaatttcgagtattaagaggttagttatcttcataacaaaaaacgaagagaggactagttgtccttctcttcgttttttattaatccatcaatttcgtattttttacttcatcgatcgtttttgttcctgcaagttgcatcgtgatcgacaattctttgttcaggtgttcaaaaacagatgttactccttctgccccacctagattcaacccataaatcactggtcggccaatcgcaactaagtcagcaccacttgccagagctttgaagacatgctctcctcgacggacaccagagtcgaaaatcactggtacacgtttgttgactacttcggcaatttttggcaatacttcaaaggaagcaggacctccatctaattgacgtccaccatgattggatacccagataccatctgcccctgcagagatagcgattactgcatcttctggcgattgtattccttttacgataactggaagatgggtgatttctttgattgttttgatgtcatctggtgtcaagccttgttttgcagctgcataaatttctgcgattccttttccttcgccattaccacttgcactttgttcgctataagcagctaagttaggcattggtaatggaaattggaattgattgatgacgtcttcttcacggtaaccaccgagcgttgaatctgccgttaaaatgatagatttagcccctgcttctactgctttgttcaaaatgaactcattgaatctgtcgtctttactcatatataattggaaaaactgcggtgcgcctggcgctgcatcggctgcgtctttgattgtcgtatttgcataagtgctgatggaaaagattgatccagcagcagctactcctttagctgtatcagcttccccgttttcatgtgccaatccttgggccgctgatggcgcttggataatcggtgtatctaattcaattccgaaaacagatgtatgcaaatcggctgagtcgattccgcgtaatatccgtggcatgattttctttgaattaaaagaagtcgtattttctttcatcgtccactcatcttcagaaccaccgcgaatatagccaaaagctcctgcttccatgcgctcttttacacgaccttctagtgaggcaatgtttacaatatcgattggatgttcttcattacttgtatgataagtcatagtagatccttctttcatcttcttgattacatataaatcatactaaacttacaaaaagtaagcaaacatttactctcagatacttttatcgctattctttccaaataaatcgacttacaagctgatctacttcttggttttcatgaagcatactatgagaggcattttcacctgtcactactttttcctctatttcatttccgcgttgcttcaacaacgcatagaccgctaatgcactgtttaacggtactgttccatcactcaagtctgtttcatctagttgaccagcaatcaagaaaaatcgagtggttataggaatattaccgatcatttgctggtaatcttgatagcggttagaaacaacagcaggcccctttgctaactcatctgtcagagactgcgcactatcatcgacaaaatcattaaaaggcgcgccaattgctgttaatgtctgaacttgtggcaatgacgtatcctgtccatacgttcctaaatagcgtagtgcactaactcctcccatggaatgccccactatgttgactttatctatgccgtagttttctttcagatacaaaagacaagttttgatccattctgattgattccactcgttatttttattatcttcaaacaatacttggaccatcggattgtctgcttttccagacaaatctcctgttgcttgtatttgtccatctgttcctactgttaaaaccaattcttttactgcttgctgatttttttccaaacgccgcaacatccctttaaaggaattttctgtcccgctgtagccgtggaaaaaaagtgttggaatagtggttttttctatcactttactggattctgccgttttttctttatcagaaacttcagtagtatttatcttcgtcgtctggcaaccacttaacgcaaacaaactgataaggactaaagctgctgcagttgcacgtttgcataaatttttgattggttctgtcatacacctcttcctttccatatagaaaaaagaaagacttgaaaggccaatcatatgatcgacatttcaagtctctttattaatcgattttatctacttgatcgaaatcaagttctgtactggtttcacgtccaaacatatcgatgttgactttcaatttttctttttctccgtcaacttctgttacttgtccttctaatccagcaaatgcgccttcgatgattttcacgacttcgccaacttctacttctagatcattttgtcgcaggctcataccgatagaacgcaagatatgattgacttcttctggaagtaatggtgctggtttgcttccggctccgtgtgaaccaacgaatcctgtcacaccaggtgtgttgcggacaacataccatgaagcgtctgtcatgatcatttcaacaagtacgtatcctgggaatgttttatgaacgatttctttttctttcccatttttgacttcagtttctttttcttcaggaacaacgacacggaaaataaagtcggccattttcatactttgcgcacgagattcgatatttgcttttactttgttttcatatcctgaatatgtatgcaagacataccagtttttttcaaaagattccattgaaggctcctcatttcattgtaaaataaaaaaacctcagtacacccgaagtttttctttcgcttcattatagcactaaaagtacgttgtggctagcgagttattttaagatccagccaaataagctttggatggctgtatccattacgtaaaacatcaatccgaaaataatagaagtttcgatgactactaacgtatctttacggagttgttttctgcttggccaagttacttgtttgatttcatcttttacgctttttagaaatttcatgagacaacctcccttgctactgtttatttcgtttctttatgtaatgtatattgattacaatatttacaaaacttattgatttccaaacgttcgccgctttttccttcactgactgattttgtgtagttgcgagacccacaaacggaacaagcgagtgctgcttttttctttgccatttacttctgcccccttgctgagaatcagacttatacttcataacagtatcacgtaactttttacttgtcaatttgtgaaataaactatctattgttttggataaaattatgatatgattaatttgaaattaagctaaaatgagacaattggaggtatagcgatgctattaaaaacacttgtatataagaaaaaagatctgacaaccgttacagagactagtacattagaagaagcattaaaaattttagaaacttccggataccgttgtgtgccgatcttagattcttcaggtaatattttccgtggaaacatttacaaaatgcatatctatcgtcataaagcaaatggcggtgatatgacgcttcctgtcactcatcttttgaaaaacgctacaaagttcatttacctggatacttctttcttcaaagtattctttacgatcaaagagcttccttatattgctgtccttgacagtgaaaatcatttttatggtattttgacacatagtacgttgcttaatatgctctctcaatcttggagcgtagaacaaggaagctatgtactgacaattgcttccacaggaaagcaaggagatttggctgctattgcaaaaatcatttcaaaacacagcagcattgccagctgtattactcttgatattgaaaaagacgaatacattcgacgtacattgatcacgctaccggctaacactgaagcgaaagtatgtgaaacgatcgtcaaccacttagagaaaaagaattataaagtggtagaaattgaaaatttgcaaaaccaagaagcataatcaaaaagcgaaaaaagaaaacagctaatctgctttcttttttcgctttttataattagacacgcttttcaaaatcaagcgcgcgatctaaataatacatcaatggtgctgaaacagccatgacgataaactcacttaatgcaagcgtgccataggttgtccaaaatgcttggccacctgttggaactaacatataagcaatcagtcccatgctgatggtaaagaagatcgtgttcaatactaaacgcatctttacatttttcactttgttttgcaataaagctgtcaggcctaaagaaagcaatgtttggccgccaccaaaaaccacatccatgataccaaaaccaaagaaggcattatagacgatgaccccgcctaaaactccccaaagcaatttacggttaaagacaactaaatgattcaaactttctgaaatacgaaactggatcggccctgaggatacaggcgcaactaaaatagttaacgctagataaagagccatgatgatgccatttacaacgattacggataaccgttgtctgcttttcgttttttgcattttctctcctcttttctcctagtttttttaacgcgggatggttgatgaaccgcggttatgtgaaacaaacaataattataacagacttttcatttatttcaatccgtcttatctgttttaaaaaaagcaaaagctcaaacaatgtaaacgcttgctaaaaatcgtgggatatggtataaagtaagtgtaaggggtcataagaattcccagtaaagcagacgaagtaggatctgcaagaacagaattgttgtgaaacttaaataaataaaaaaggatgtgggaatttgagcaacctcttactagagaacggtctagcaagcagctgaagatctaagtggacatgccgaaccttggaacttctccttacgtaagtaatggatcatgcgcttgctaggcttttttgtgtttttcggtcttcggacctttttcattttcctagacttctgctataataaccaagaattaattttgtaacagatttttttgaaaaaacaagtttctttcattcaaaaaatagaaaaagcttgctaattattggttaaccagcaaacaggagtattaaaatatcttgttttattgaatagcaggaggaaattatgaaattccattatcatatattgatcaatccatcggcaggcagcggaaatggctataaagtagcagaaagaattttaccggtattaaaaaataagcatattgactatacacttcattatagtgaatacaaaggacacgatgctgagattgctgaaactttggcaaaagaaacattgattccttggatagaagaagaacagaaaacaatcgatactttcccccttttgatcatcgtaggaggtgacggcaccttacatcaggtacttgatactttctatcagatggaagtagaattcccagttgcttatattccagcaggttctggaaatgattttgctcgaggggcaggccttccaaaaaatcccaaaaaaggacttcagctgattttagcagctcaatcaccagaaaaagtccacataatggcttatgaagaaaaaataagtgaaaaaaaaggaatagctgttaataatttcggtataggattagatgcagctatcgtccatgcgacaaatcattcttccacaaaaaagcgattgaacaaatacaacttaggatcattttcgtatttattctctattctccgtgctttattcactcaaaaaggctttccaattctggtagatgcaggaggaaaacaattaagtttttcaaacgcatttttatgtacagcaacgaagcatcctttttttggcggaggaatcgcgattgttccaactgctgatgcgtctaaaccagtcattgattttgtcgtggtcgaacgaatcaatttctttaaaatcttgtggctcattcttttacttatacagaaaaaacaattgaaatcgaaatatttccatcactacacaacaaacaggttacgtatcgtttcaacaacaccgcaacatggtcaagaagatggagaagaaatggaaaaacgaccttttgatatcacaataaccacaactaaacagttgttttggtgttaataaaagaggttgtgtcagaagctacatctggaacaccgtttattcggaaaaaaggactgtgacacgacttttgtcacagtcctttttttactatgcagttaattctttgcccaattgggttgccatcgatagtttctttctttacccaaaataaattggatcattgaaaacaccgcagcaaaagcaactaagacacaaccattgaaccaaaaagattctgcaaatgtttgattgtaactgagtgtttcactgatcaagttattattttgaacaaaccaatatgttggtgtgaatgccgctattttgctaaccatttctggcaagtattctgctggtacaaacaccccaccgataaagcaactgcctgtgataaaaatatctttgatcccaccgctggtttctgagttttttaccaatgaagtgatacaagccgaaaagctaatgatcggcaataaaaacaagaaagtatttaaaatatgataccataccgttatatcccacgaggtgtggatcactaacagaaccattagaagtaagaagccactgaacaacagcagcgagtaactaatcaaactaaaggttactttgcgattcaagtttcgtttggtaatgggcgcactctggtttcgtttactgatctctttgcgattaaacgctagattgatgacgctgaaaccgctaaaaatggataaaaacaacccataagacaagaaattaaaggttgtgcccgtcaacagctttttcatccgctgactatatcccgtacttagctcaacttctccagtaaccgagagtgccatttgtgtctgttccatagctgcatcgattgttttatcttcttcttgaaacagaatcagtgtttgcaaaaaggtgttcacttgctgtgtaacaactgttttagaaaaggcatctgggcgactctgtatcttgatcgtcggcatctttcctacttcgacttgttcggtaaagtctgcaggcagatgtaagataatgtttacacgattaaaataaagagcatcatcgatttctttttgtgaggttccatccaatgtaacgactgtttccttgtcattcaaatatttacgaaggccatcgactacaggcgactcttcttcactaatcaaggcgattttcgcatcttgcagagaggtattttcaacatcaatattttgcgcaaaaaagaatgtggcaacaacagtgataattacacctatcagtaaattcgatttatttgctttaagcaatgtccaaatcgttttataaagcgtcataacgcacccctctttccatccaagcatttcctaacgcaaaaaggaaaataaatccgatcaaccatagaagattggtataaaaactagccaaatcagtgtagaaataaagtttatacaaactttcgctgatcaagttgacgagatttaattgaccaacaatcggaatatgaagatcaatccaatacttcacttgttccgaccccatcataccagcaaaaaagctcatcgcaatcgtcactgaaatcaagatgctatccttttgcaccagattcatttttggtatcaaattaccaaccaatgtacctaacaaaatcgcacacaacgaccccagagcggtaacaatcatcaaccattgccaacgttcaccaaagtctacttgatagataaaacgaaagacagctaacataatataaatctctgtcaaaacaatcgtaaagcttgctgccaaattagcgattgaaactaacgattgctttctaggaatcaaggacaagcgaataccatttgacgattgatttgcttgctgatcctgtacattgcggaccccccacatcgtcccgtagagaatcgccattccaatcagagtgaagaaataaaaacttttgaaactcatattacgacctgcatgaacttcttgaaaagatacttcttgttcaaaaacagtcatgatgggcgcgagatcaacgttctccacttctgccactttactcgaaattataccaatacgctgtaaaaattgatccatgacgtttttcatcaacgtctgactcattcctgcttgacccacatggagcgaaacagatgaaccatcaatgagataaaaaccagccaaatcatctgcatttagcttttcattcgcttctacttccgatagttcctgtacttcaaataatggtttatcattgacttcgacttgttctaagactgtggtaaaattttccgaaagcgctgtttgatccgctttgattacaattccagtattaatcgtttcgagattgccaccttgatcaatctcgccaaaggccgccataaacatcaatcctaaaagaattggaaaggccaatgtccaaaacaacatggatttatttcgcagcagtatttttgtgcgatatttataaaaatgccaaaacattatttcccctcctctagtctctcaaatccttgccagtaatctctaaaaagacatcattcaaggacgcttctttggttgctatttttccgtaactgatcttttcttcttgtaagattgtaagaatcggcaacaatactgtatttagttcagtagttgttacttggagctgaccttttttataagcgattccatcagaagctattgttcgctgaatcgctgacaacacgttttctgggagtaatgggatgtcgatcgtcaaacgatccgccgtccgtaccatatcttttagagattctttggttcctttagcaatcacctgtccttgatccatgatcacgatctggtcgcaaagaatttctacttcttccatgtaatgtgttgtatagacaatggttgctccttgtcgattcagctccttgatactttctaaaattttattccgactttgggggtctacagctactgtcggctcatctaaaaaaattaaccgcggcttgtgggcaatcccacatgcgatgttcaaccgacgtttcaagccaccactaagttctcttggacgaaacgacacatatttttctaatcccactaattgaatcacctcttcaatcaaggctttccttttctctttttcggaaacatataaaccgcaaaaataatcgatattttcttgcacacttagttcgtcaaagaccgcaacgtcttgaggaacgaccccaatcattgccttgacagcataattttcaggagtcattgttgtcccgaacaatttaatggttcctttgtcataatttaacaaagaaagcatacagttgatggcagtcgatttcccactgccgtttggtcctaacagacctaagacttctccttcttgtacttgcagatcaaaatgattcaatgctacaaaatctccatagcgtttgactaatttatcaatttcgataatcatcatgaaaaactccttccaaatttcttgttgatctgactataataaagtgcaagaaaagaaactagtgacgattggctaaaccacacatgacatttgtcacaatgaaggagtctgctatgcataaatctcggctactcaacgaaactagctttctactggttatctcattgcttttgctggtaagtcaaggattcgttgctatgcaagttatctatttattgatcgccgttttattcactggtgtcagttatttactgcctacaaagccaaattggattttccaagttattctatttcttttatgtgcctttttacctgatcttgtcctgtttctgccagcgacgatgcgagtgatcgcccctgaagaaagccaccttgattacttgtttttgttaggttttttgttgatttcgacggttggtaatcatccccccatcaaggtcgcctttgtcgtaattttgctgtttttttccttttacttacgaaaaaaagatcaacgaacgaccgatcttgagaaaaagtacattgtctccaaagatactcattgggaaaaacaacaagagttatcggaacaaaataaagcattggccctgtcacaagaaacacaattagccttgcaaattgtggaagaacggaaccgaattgcccgagacatccatgacaatgtcggtcatctgctgtcaagtgcgattttacaaattggtgcgcttgaaatgatcaatcaagaaccaaaactaaaagaaccattagaaaatttaagtgccaccgttcacactgggatggatcggattcgtcaaagtgtccatgacctccatgagacatcgatctcttttcaacactccttagagtttctgatcgctgattttccttcttctgttacgattgaaggaaacttgtttgaaggattgaatgaaacgcagcaaaactgcttcttaatggtcatcaaagaagccttaaccaacagtatcaaacatagtcatgccaaaaccgttgttttacattttcgaacgttgccggccttttatcgcttgcaaatcacgaatgatggcaccagcccacaaaaaaattctgctcccggtattggtttgaaaacgatgcgtcaacgtgttcaagaacaaaagggacaagtccatattttccaagaaaaccagcaatttcagttaacgatcattttaccaagggagggacaccaatgataacagtagtcattattgatgatgatccatttgtgacgaaatcgttacaaaccattttagaaagcacgaaagagatccgtgtgttaggcattggtcattgtgccaaggatgcgctagtcttatacgaaacccatcgtcccgatgttttgctgacggacatccgcatgcctaaacaaacgggcatcgatgctgccaaagaaattttggctaaatttcccaaagccatccttttgcttttgacgacattcaaagatgaagaatacatccgcgaagcattttccatcggtgtcaaagggtatttaatcaaacagaacttgcaagcgattattccttctgtcaaatccgcttataatggacaggccgtatttggtaatgaaatcatcgagactttcactcaaatgatgaagaataaaccgacgattgatagtcatgcttatgcttcttttagtgaacgtgagcttgcaatcatcaaagaagtagctgccgggaaaaacaataaagaaattgcagatgacttgtacttgagtgacggcactgttcgcaattacatcagccaattactagaaaagctagatttacgggatcgcacgcaattggctatctatttttatcagcatttgcaataagtcttatctaacacaaaaaaacctgaatgatgctccttcgcatcattcaggtttttttcacatcttctattcaattgtcccgcaaaccatttcctcacgattgaaagaatcaaggattcgcagggctgccaggattcgttggattgttcggcgtgttaggcggaaaaataggcgccttgtctaacgttttttctagttttgattcttcacgatcgtctcgttctacatcaggactttcattcaatttgaattctttttccatctcatctaactttttaaagtcattgccagattcttttgctaatttcgctaatttatcttcggtttctttagccataaagtaacgccccccttttgatttcagcttagcatatcacactgaaaaaacaaaagaaaacgctaaccaatgatcatttttagctatttctcatctttaaaatcaagaaaatcaagcattttttgccggtataaaatcgtagggagaactgttttccataccaatcatcggatctactaactggttatcgatcacttctgctgtaagaacgaaatctttagaaacagcaggttctacctcttctttcttttcttctccaacaaatgaagaaaatagatctggttccactgtttccattacttgttttttcgattcattcgtcccactgtcatcttctacaggtagcttttcttttacaacccgtggctcttttgtatagttcccatcttcaaatggatcatttccgaccaaagaatcttcataagctgctagttttgtccgcagagtgatattcattttatcattatctatgatccttgatttcaacgtagtcatccggcttgctgattcattcgctacacaagtgacataggcttgctcttcccctaacaaaatcaacagttccttactgcgggtcactgccgtgtagagcaaattacgctgaagcattcgctgatattgatggaccatgggcaaaataaccatcttgaattcactgccttgtgatttatggattgagcaacaataagaaagagtgattttattccattcgtttcttttataagtgacctcatttgcatcaaactggataactaattcatccactttatcttcagaatcttttgccaagatgatacccgtgatttctcccatatctccattgaatacattcaattcgggagtattgactaattggaggactttgtctcctatccgataaacggtgtcgttccaatgtacttccttttttccaggtttccctggattgaatatctcctgcatcattttatttaacgcatcgatccctgcaggtccccgatacattggtgctaatacttggatatcttgtgcacggaatcccttatttttcgctttttccacaattttagagatcaagggttcaatttgataagcatcacttcggaaataggaacgatctttttgattctttgtgaaatcttttggcagacgtccttctttgatctcatgggcaagaggaataatactagaaccatcaccttgccgataaatctgattgagttccattttgggaatttgttcgatttccaaaagatcatggagtacttgaccaggaccgacagagggaagctgatctttgtctcctactaagataacttgcatattcgtcggaatcgctttgaataatgtgttagccagccatgtatcgaccatagacatctcatcaacaatcaaaagtccgccttctaattctttcgtactgactgaaggtgttttttcccgtccattcagccccagaagacgatggatcgtactggcaggcagacctgtcgtttcgttcattcgtttagctgctcggccagttggtgctgcaagtagaataggaaaaatttcttgggtatattttgaaggatccaattccagtccgttcaactctgcaaaaagattgacgattccgttgatcacagtagttttccccgtacctggtcctcctgttaaaataaatagaggggaacggattgcttcagcgatagcttgttcttgcgaaggtccatactgtatgccgaatattttttcgatacgccgaatattcttctgcacttctttttcaggataatggatttcttttttacgactgagaaggcgctggatcgaattaccgatcccccattcagaaaagtacaaactgttttcgtaaagattagtctcttcttgttgtatctttccttcttcaacaagttggataattacagtagcaacctgatcaggctggatttcaattgggcgacttgtttctaaaatacggatcgtttgctgaagcaatgtctccgccggtacgtatgtatctcctgtttgaactgcatgctgaaaaatctgatgcaagatagctgctcgaattcttctcggtgaatctgctgcaataccgatttgttcggctagattatctgcacgtttgaacccgattccttctatgtcttcgactagctggtacggattttcttcgatgatatccaaagactcgttcttataggcctggtagatactgaaagctaactgactaccgaacccgtaacgattcagtcccatgatcacttgatccatcccgtggtttagccgaatcgtctcagcaagcatttctctttttggcttcgtcaaaccggagatttgttttaataccgaaggatcagcaatgattttttcgatagcatcttctcccagcaattctacaattttttctgctgttttcttcccgattcctgggaatttttcgctggaaagatacgctacgatcccatttgcagttgttggcttttcttgctcatatctttcgagtttaagctgccttccgtatttaggatgatccactaattctccataaaaacgataagtctcattttcttgaatatcgccgaaacttccggtgactacaatctctttttcacggtaatcagctgtggtttcactgatgtgtaccaaaagcactttgtaaaaattactaggattttgaaaaaaaatcgcggcaactgtaccaacgaaataaggcatttcttctggctgcatcggaagccgcctccttcttctatagtaaaggttctggtgctgtttcagttcctaaaaaatctgtttggttccatactttcagttcatatggcaataatctgcaaggctcttcagtctctaaaatcgtcaaactactattgaacaatccacccatttcacgcaactcacttagctcttttcctgtcatccattgaatggctgcagttaaagaagctccatgtcctacgaataaaagtgggccatctttatgttgggcaaccgcatctgctacaacagtttcgatacgtgtgattgccgattcaatcgtttctccgtgaaaaggagaaggatcatacagatctaaatgattacgcaaattcggcagattatccgaatatttctggtacatttcatcgatcgactgaccttctaaagtacccagccctagttctcttagcttatctgtataaaaaatctctaccggacgagcaagctctttgttgataccttctgctgtatcacgtgctcgctttgctgtactggaataaattgctttaaaaggaacatattttacctttttcccaaatgctttgatttcttcgtaactttgtggcaaaagcggagaatcgccattgctcccttgaaaacgtctttcctgattccattgtgtcttcccatgtcgggtaaaatatagttccatacgcagcaaactcctgtctttcttttattttactctataataaactgtctaatccagcttgtcattttcatagtgatgcgtcaattctaaattagggaatccttgctggcgaagtgcttcatacactatcattgcagctgtattcgataaattcaatgagcggacatgctcatcattcatagggatgcgtaaacacttttcttcgttttcacgcataaatgtttctggcaaaccggttgtttcttttccaaataaaaagaagtgctcttctccatcagcaaaattttcgtcactatatactttatgggcaaattttgagatcaaatgtagtttacgattacctaaaaatgttaaaaaagcttctaaattactgtggtaagtaatatttacatcattccaataatccaaccctgcccgttttagatgtttgtcatcagttgaaaaacctagtggctcgattaaatgaagcggagtattcgtggctgcacacgtacgggcaatatttccagtgtttgcagggattaatggttcaaataaaacgatatgattcatcaggatcattcctctcatatttatgttcgtttctattttctgacaatttgatttttgcataaaaaaaaacgtatcaactcggtgtcagtcactgcgagtcgttacgttagtgaagctcttctcactaacttttatcagaacaggaacctgataaaaaccaatgaaaaaacaacttgttgctaatataacaccctcaacttttttttgcaacctctactcattaaaaactgctagaaaaacgttttctcttagttccttttaataattctatgtcaattgtaatcttcttcaaaggattcttatataagtctgctttgattcgctcttctacctgccattctaaaggtgacatggccaaaagatctttttgattttcctctggtatctcaaattcataggttacacgctgacgttcagttaatttcattgcttcagcaaacttggctactacacgttcattggaataactctgtttttcaggttgattcggataaaaagcctgacgtagttcctttaaataattttcttgtggcaccaccttcaacacttctccatcttctgagagtacacgttggaattcttggtaatgagaaggcgaaaagatatttaaaaccgcgttgaatgtttgatcagcaaacggcaaattggtcaaatcagctacacaccaaaatgcttcggcagattgttctgtagctgcgtagactccttcttttgaaatatcaaatccaacagcattttgaatctttttcaattttgaaagttcattcaagaagctaccttctccgcagccaacatctaatagcgagacttcttcaggtaaatgctgcgcaatagtctcaataacgggctgatacatgccagattggatcattctacgccttggaacgaacattccttgatcgtattctgttttaaccgcatgggataaaaaataaagtgttccttttttggaaaggtcaaaacggtgattatttttgcatatcaagccattatcagacttttttacttcttcttggcaaaccggacagcggaacagctgatgattttctgccaaaaactggcgtcctcggtcaattttttttaacatagttccccctcatttctgttttatcttaccgttagatgctcactttggcaactgctaaaaatatgatacaatgcctagaagaaagtgaaagataaaggagaagattagatgatcaaagaattttgcgctgaaaactacacatctattcctctagcaattgctagaggagccgatcggatcgaattgtgtgacaacttagcggtcggtggcacaaccccgagtactggtgtgatcgaagaaacgttaagttatgctggggaaaaagatatccccgtaatgacgattattcgtcctagagggggcgacttcgtctataacgatatcgaattgaaaatcatgcatactgatttgattgaagcaaagaaattagggacggatggcgtagtatttggttgtcttactccttcaggctggctagacgaagaggccttagaactattgatcgaaacagcagaagggttgcagatcaccttccatatggcttttgacagtattcctgaagatcggcaattcgaagcaatcgattggctggtagaacatggtgttgaccgtatcttgactcatggcggtcctgctgacaaaactattgtagaaaatttcccacggcttaaagaattgattgcctatacagatggccgcttaatcattttgcctggtggtggtgtcactgcagagaatgcagcacatgtagctaaagaattgaacgtaagcgaagtacacggaaccaaaatcgtggatcttcagttataatcttataaacaaaaaaacatttgcaacaggcataatgcttattgcaaatgtttttgtttttttacataaaatagcccataaataaagaagcaatattgaaataaatcagtacactcgtcaaatcgctcaaagtcgtgataaagggaccgcttgctactgctggatcaaatcctagacgatccattagcatcgggattaaactacctgcaagattcgccactgtgattgcaaatagcatagccatccctatgacaaaccccaagataaaattatgtttccaaaaacctacgattagaaaaatcgtgatccccgtaacagctcctgtgacaacgccggtcaagacttcagccaaaacaagtcgaacaaatccatgatctttctcatcagaaatcgcaagtcgacgaacagccacagctagcgactgggttccagcattaccggcagttcctgtaatcagcgaaatgaagactgctaaaatactcgcttcacttaccaagtcttcatagtgactgattaaagaagcggtcgacatacctaaaaacaacagagtgatcagccaaggcaaacgtcgagacgctgcctttactggattttcattaatttcttccacattgaccccggcaagtcctgaataatcgctagccgcttcatcatcaataacgtcgatgatatcatcgactgtgacgattcctaacaaatgatcatcataatcggtaacaggaagagctaagaagtcataatccctaaatgtttgtgccacatcttcttggtcgtcgcctacatgaactgaaagcactcgttcgctcatcagatcagaaatcattgcgtcgtcatcattcacgattaggtcgcgcagagaaataacccctactagctgaccttcttgattaacgacatagatgtaatagattgtttcagctacatctgcttcgttcttcagcacgtacatcgcagagcgaacagtttgattggctacgatcgaaacaaattcagttgtcatgatcgcgccagctgtttcatcctcgtaatggagaagttccttgatttcactggcatcgtctgccgacatcaaacttaaatatttagcaatttgctttttatccagcgtattaagcaagtcaacagcattatctgtatacatctcagaaagcatatcagctgcatagctaggacgcatttcatctaggtattctttcatatgttcgttgtcttcttcaatcacatcgaacatatccgctaattctttaggcgacagataggaatagatcagctgcctgttctcttctgtaagagattggtagaattgcccctgctcatagatatgcatctctaaaaaactgtttctgaatgcctgaatattattttcccttaaatcttgagtcaactgggcaaatctttcctctaattcttgattttcatccaaaccaatctcacctcgccttattcttcaaaccgtctcacaactgcctccatgtctgcggctaaaggctgcttgaactccagcaactcttctgtaaatggatggtaaaaacgcagatcataacaatgaagggcttgtctttttattcccagatccattcgcccgccatacatatcatcaccgagcagggcacagccaattgcggaaaaatgaactcttatttgatgtgtccttcctgtatgcagctggatatcaactaacgcgatttctgttagtcgcttctctatccagtactcagtctgtgccgaacgtccttcatcagagaccattcgcttcaatagcgaagaataatctcgggcgatcggcaaatcgatatgtccatgtgccgataaatctgaaagccttccactgactaaggcctgatattttttcacaaacttcttttcacgaagttgcatatctaattttgcgtgcgcaaatccatgctttgcaaaaagcatcaagccagatgtatcccgatctagtcgcgtcaccacatggattacttggttttcgtaacctttttttttataataagcctttacacgattagccattgtcccatttggatggtattgggcaggaatagacgaaacgcctgctggtttatttactaccagaacgtgttcatcttcatacacgatatcgatcgatgtttcatccaaaagtacggtttcatgttctccttcagcaggaatcacaatggttaccttatcatccttagctagagaaaacaagacattttctacttgatcattaactttgatttgaccgccttgaaattttattttcgctaacagaccctttgagatccctttttcttttaaaaaatattttacttgctgagaatgatctttctcataatcccatgtaaactgcatatcaatcctcactaataaaggcatctttcacacgatgccaaaaatgcatatgtcgataagaagcaaaatggatccgttcttctgctattcgataataaattgagcggatatttgcttttgcgacattcaattgatcaaccgttacaagataatcttctgtattttccaattttatttctagccattcatcatgggcaatcacgatcggagaacccaaagtacgaaacactcgattattcagtgaagcaatctctgccaactgaaaggcattgatactaggatggatcacagcaccgccgacacttttattatatgctgtcgaaccagtaggcgtagaaatcgtcaatccatctcctctaaaactttcaaacagctcgtttttgatgtatacatcggctaccatcgtacgattggcccgtttaatcgttgattcattcagtgctaaaaaatgctggtccggtgtttcatccaaataactgatccgaacatccagcaagggataactaacactttgttcccggttcgttcgtaagctgtctactagttcttccagctcgtaatcccgccaatccgtgtaaaaccctaaatgacctgtatgcacgcccaagaaacgcacatcattcagacaatgactgtagtgatggaacgccgacaataatgtgccgtctccgccgactgagatgaccaattctggctcatgatcatctcgttgaatccctgcttgttctaaaagtgcgttcaaacgttctgtcacttctatagtctttgcttctttattatgaacgatcgctactttcatcccctgcctcctctctttcgctttctttcttcaaaagcgttcgatagtagacatcatctgattttcctcttccatgggagaataaccgctgtgcttcttggatttcttcacggatactggacatctcttcatccaactgataggcagcttctgccgcacgctgaagtcgttcactcatttcttctggaaaaacgccttgatatttataattcagcgaatgctcaatcgttgcccagaaattcatcgcaagagtccgaatctggatttccgccaaaattttcttctcaccgctgatcagctgtacaggatactcgatcaccagatgataagaacggtagccacttgcttttttatttgtgatgtaatctcgttcttggagaactttcatgtcttttcttttacggatgatctcaacaacttgatggatatcttctacaaactgacacatgatccttaacccggcaatatcagacatttcttcttctaaacgtcccattggaatatgccgtaattgtgattttgttacaatactatcgactggcttgactctcccagtgacaaattcaatcgggacatgtcgattttgttcacggaactgtttgcggatcccccgcagtttcactttcaattctgatacagtttgttcatatggtgctaaaaatgcttcccaatctcgttccatagctgatacctctacttcattaacattcattgtttattctaccatatatgcaaagttttttcgtactcttgatttatgcattgaccaaaaaaagaaaattaggcaaaatagacaaaaaggagtcgatcaaatgacacaaatgcttgaaatcgaatataaatctatgctgacaaagcaagagtacgagatattcatcgctcactatcaattaacagataaagatttccgtgtacagactaatatttatttcgataccgttgatgaacagctgaagaaacaaaattgtggcctacggatccgtttcgttggtcatcaagctgaatatacattaaaaacacctgctgaaaaagggcgtctcgaaacaacggatacctttataacagaagaagcagaagcatttatcttcgaaaaacgtctgcctcgttcaggcgcagtttttcaaaaactttctgatttgaatatcgatcctgcttcattaatccaaaccggaaagcttacaacaaaacgggctgaattccctattgaagaaggacttttagctattgatgaaagctggggagacaatctacacgattttgaactggaactagaggtaggggatgcatctgtgggaaaaattgcttttataaattttttaaaacgtttttctttaccttatcgtcctgctaagaacaagatccaacgtatgcttgaagctaaaaattagaaacctttcattttcacaaggcacttgagttcatttttttacttttttctgttaagttataggatgtgaaagaatctagtcactagttgtatagaatctattttgggggagattcatatgatcgaaatctatttatttgttaatcctttaggggaatactgtttcgaaatggaacaacagttattacaatttatcgaagaagagtacgggacaccatcaaaagaaaagatgcaatttcgctttcttcctttggtcaatttgcagacaattggggatgtcatgcaacaaaaaggaatttctcagaacaatcttgaggaacgtaatcacttattctcaatgacttattctgcagcattagactgcaaagcggcgcagtttcaaggaaagaaaaaaggccgccgttttttgatcaaattgcaagaagcagtcggctgtaatgacataccatattctcaagaacttgctgaatccatatttgaagaaatcggcggcgatttgaatatgtttaaagaagatcggcagtctgacttcgttaaagaagtattcttttctgatcaaaaaattgctcgggaaatgggcatcacaaaacacccttctgcagtcgtttacaattatgcctgcgaccgtgattttggtgttttagtagaagtaaaaggtacaagtagcctttggagaatcacagagctgtgtaaaacaacagataactcatatcaagtttttaatggtgaacatttacatacaaatgattctcagttccattcaagaactagccatttacacttgctttctaattaaaaaaatacgtcgactcccttacaagagagccgacgtatttttttcgtttctattcgagaaaatcaaaaatagaaagccttataaatgatcgatcaattcttctaattcatttagacgttgttcaaacatcgacattgcatcttcgatatatgcagcttgtgtcatatcaactcctgcttttttcattacttccacaggataatcgctgttacctgcttttaggtaagccaagtagttctctagtgcctctggttcctggtttagtattttcttcgccagtgctgaagcagcagaaaagccagtcgagtattggaaaacatagtaattataataaaaatgcggtatccgtgaccattcgaatttaatttctgggtcttcttcgactgctggaccataatattttgcattcaatttaccataactatcacttaggtattcactagtcaatggcacacctttttcatcttccgtatgcatgaaatgctcgaattcagcgaattgtgtctggcggaaaactgttcctttaaacccatccaagtaatggttgagtacataagcccgtacacgagggtctttttctgtttccaataaatactccgttaggatattttcattcgttgtcgaagcaatttctgctaaaaagatggagtagtcgccgtacacataaggctggttcgaacgagtgaaataactatgaacactatgtcccatttcgtggacaagcgtaaatagctgatccagcgtatcatgccaattcaataaaatatatggatttgtgtcatagcttcccgaagaataagcaccgcttcgtttccctttattttcgacaacatcgatccaacgttcagagaatgctttttctacgatggccatgtattcttcacccattggtttcagtgcttctaaagctttttcttttgcttcttcgtacgtaaaggtaattggagcttcccctaagaccggtgtataaagatcatacatgtgcagtttttccacttctaataaacgtttccgtaattccatgtatcgatgtaacaaaggcaaatgcttgtttaccacgtctaccaaagtatcgtatacactttcaggaatatgattattgctcaaagacgcttctctggcagagctataattacggactttcgctttaaaattatgtccttttatatgtgtgcctaaagtagaagcaaatgtatttctaaattgttcgtaaacactgtacaatcccttaaatgctgcttcgcgtacccttcgatccgtgctttctagcaactgaccatacacgccatgagataattggactatttcaccattttctccttcaatcgttggaaaaactagatctgcattattcaaaacagcaaatgtatcacttgaagcatcaaagatttcacctgctccagcaagaagagattcctgctcagcagataagacatgggctcgattatctactatttgctggatataatggcgatagacttccaattttggttcttctttgaaatattgccaaatctggtcatctgacaattgcaatatttctggttcaaaccaggaaacggcttcactaactttcgaaaacagactgcttgctcttgcataaagcgcttggtaatctgtatttccagtgtcttgatcgtttttaaggtgcgcatatacataaatgacttcagtttggcgataaaccctcaatacgaattcaatcgcatttaaaaattgagaagcgccttgatcaagtgttcctttgtgtttttcagattgttttaactcttctgataattccaaatatttctcatcaaactcttggtcgcttgaaaagatcttggtcaagtcccaagttaaattttcaggcaattcttctcgttttggcaactgctttacttccatgaaatccactccttttcttcccttagctctatctatcaaaatagatcatagtctaacatccacatgtcacagcatctaacttttctactcattcatgtgtctgcttccatcaattttagcataactaaatcttgttttacatagaaaaccgattcctagcctatttttatacttactattttttcaaagaagacaaatgtatgcattcgttaaaaaactgctgatagaccatctcttcatcaatcataggaaaaagccattcccttttatgttcttttatttggcaaatccatgagttgaaatcaggaactttctggttttccaaggcttcttcgtacaacattcgataaagaaaaacctgttcttgtaaataaaagaaaaaccgacttttttgatagatccacgatgatagatgcaaaagatgtttatgacgcaagtagcattgttcttgtatggatactgtattcttttgcttgtgaataagttggcgtgtcagccatttcttcccatcttcactcactttttctatttttttcatttggttcattttaatttcgttactagtgaatatttctttaaggtccctactagaaaaagtccagcagctactgcaaaaggaaatatgccctgatacagtctctgtaatatgatgatacaaataaatcttttgtttcttgagatcagctttccagcaatgcactcctctttttctattatagtagcagcaacttttttctatcaatgagaattgcgattgtccaagaaaagaattaccaagtatccaccatacttggtaactgttattcaaataattttgggttctttcaataaatctctggtgagacagtctagaacattggatttctattgctagattcgccaacaaaatatcaggcctttgccgcaacctcggcaaataggcttccaaaaatactggttctactgactgtcccagccaatccatgaagcattcctttaactgtaagtgctcttttgattctctttcactaaagaccgaacagttatctgatttttgatgggcaaaatgagcacattttttctttccctttttcaaaatcactctttttcgacagccacgacaataatatttctttcctttttctgcatgtttagcaaaacagcacttattatattcattcattgcaagcagcatttttctccctctgaacttatttacgtctaagaatttatttacacgaaaaaagagggcgtgaaaaagctattctgcatcaagtaataagaacagctaaacaaaaatagttcccaatatttttcgtttggttgggcttgttaccgcagatgcaagcttttgaacactatttatacgaaaaaaagactgcgacacaatttttgtcacagtctcttactataatgctgatttatacaaaataaaatttcgttcgctcgatagcattacgtgccatcagacattttccatattcattcaatgtttctggtgtacgatcgctcttttcagcaaactccaaaattcgagcaatctgattctctacatccgcttggttgagattttccatccagaagtgaacgactaggtaatagcgctcttcgaataaatacaaatcagtccaagcagactctagttcgacatctgttgcaagttggatcacttgttcaaaatcttcaaaagcaaaagttgcttgtctttcctgttcttctagggcacttccagataattcttcctccggatcgctgccaataatctgctgacgaagaaagtcactcacatcttctgaatcaacagtagaatcttctgattgagaaatttcttcatccggaagatttttactgataaacagttctaatccgtctccttttggcaaaacttggaaagtgacagcttcgcttcctcggaactcctcttcgatatcaacttcttccaaaatactataaaagaaattttcgatttctttgtgattgccaagtaaatccaaaaatgaaacgccccgttcctctaaatcttcatgaccaattagtacacggatcgtattttcattaatatgttccatttccattttgctacacctcactttgccacaatgtttaatatagattcattgtagcgaaatcagcttaaatgtaaagaaaaaaaatctcgctgttaagtgaatttaataaaaccagcggatttttcaacctttcaagctatcttatttaactataacatttttggcagacgaatactatatagccgacttttcagctaatttttcctctctatttttcgtgcaatcatcatcttctactacctttttatacatctaatcaagaatactttttgtaaaaacaaaaaaacttggaaaaactatctttgtaatagtcttttccaagtttcgtattatccttctataatccagccatcaattgcgcttgacgtaattctaattgtcgtacatcgcgcggtaggaaccgacgaatttcatcttcattaaaaccaacttgcagacgtttatcatcaatcatgattggacggcgaagcaatccaggattgttttgcacaagttccaataattcttgtaacggcagatcatctaaatccatgttcagtttttggaatactttggaacgtgtcgagatgatttcttctgttccgtcttctgtcatttgtaaaatcgcttttaattcagaactgttcaatggttctgaaaaaatattacgttcaacaaatggaatctgatgttcttgcaaccacgcacgagcctttctgcaggaagtacaacttggggaagtatataatgttaacaacgtgcaccactccttttcgtgataagaatcacttttttgtaacagaagatcataataatctcccatctgtttctattatacataatcaacttttaaatagctacctttttttcataatttttttaaaaaaatgaaagttatctaaggttaatatacagtaaaaccagcattctcgctttttttatcatttaaaaattagagttttcaaatctaattcaaattttctaaacatatgaaacagcgtataaaactgtactattattttatctcaaaagctaaatgaaaccgatttcttaagattttttatgttttttatttctttaatagtaatgttttctgtcattttaaataatactgttctttattataacgcttattttctctgttatataagcgtagtattttaaagcaatgattactaaataaaatttactataaacaaataaatcaaataacgttattttatgtttgaatagttatattgagactgtattaaaaaaataaatctttcgaaaattccacagagattgcattaaaataaatcaatcgacttctaccataatgattaatttgttcatcaaacttattgacgtgtttcacgatttttagtgaaaaaaactgaaatataaaaaccttattctgtcaaggaaatagaaatatagtaagaaaaacctttatttatcagcttttttagacaattttttctgttacaatagtcaaggatttgtgaaaaaatcaatgaaaaccgaaaggcgtgtaaaattttgattaaatcagttgtgtttgatgttgatgatacgatgtatgatcagcagcagccatttcgaaacgcggtcaaaagagtcgttccgcttgtttcagatgcagatatgcatccactatatatccggttccgccatcatagtgatgaaaacttcccaaaagtaatggcaggagattggacactagaatatatgcgagcacatcggatcagccaatcactaaaagatttagactaccctcatattacggaagaagatggcctcttatttcaaaaaatttacgaggaagaacttgataatatctgcttgcatgaggaggtcaaaaaaaccctcgatttcttgaaggaaaagaatgtcccattaggaattatcacaaatgggccgactgaccatcagacaaaaaaactgaagcaacttcaattgaacaattggattccttcccgcaatatgctcatttctcaagcaacaggtttccaaaaaccagaaaaagagatttttcagctggctgagaaagaatttcatatgcttccagaagagaccttatacgttggcgataattacgacaatgatgttctaggtgcaaaaagtgctaactggcaagcgctttggttcaaccatcgagaacgcaaaattgaacagactccaatttgcgatatcgagatttcttcttttgatcagctgttagagacaatgaagacaatctttgtataacctttaaaaatagaaataaaaaaatgatagcaaggaagctgggataaaatggaatcccagcctccttgctattttttaaatcaaataaacaatcgcttctttagaaagactttcttacccattactgaacgctttttcgagtctcttactcctcgatttctcctacacttaaaatcatgcggatgtcttcttcagtcagtttcgtcaactgttcttcattaccttggatcactttttggaacagttcgcgtttttcttgctggagtgaatccatgcgttcctcaatcgttccttcagagatcatacgccacacttctaccacatttttttgtccgatccgatgtgcacgtccagcagcttgttcttcaatggcaggattccaccaaaggtcatacaagatgaccgtatctgctcccgtgagattcaatccagttcccccagcctttaaggaaatcagaaaaacatctttttcgccagcattaaatgcgtctaccatacttaaccgatcttgtggtttcgtactgcctcttaaataaaatgtcgagatccctagctcggctaactcttcttgcaagatagtcagcatccctgtaaattgagaaaacagcaaaactcttcgtttgttctctttggcagctaccagtagatcttttacttgttcgagcttgccggaaccgccttggtaatcttcaataaacagacgaggatcgcagcaaatttgtcgcagtcttgtcagaccagcaagtatcccgatccggtttttcttgaatgcttcagaatccattgatgtgatttcttcacgcatttgacgcaagtaagctaaataaacagttttttgttcttctgtaagtgcagaatatagattcatctctgttttttccggcaagtctttcaacacagtttgtttatctcgccgtaaaataaacggtcgaatcatttgcgcaatttcttctgcggcaagttccctgaattttgttttagtcgggaaaaatcctggcataatcgttgcaaacaatgaccacaattcttctaaattattctcgattggtgtcccactcagtgcaaaccgctgaggtacagctaattctctcaatgcttgtgcagttttcgtactgctatttttgaccatttgtgcctcatcaagaatcaaataatcaattttttgcgactgataattagctagatcctgtcttaagctggcataagaagtcactcggatatctgtgtctttagccagtaattcttcacgttcttttttattcccattgattacttggatacttaaagaaggggcgaattttctcacctctgcctgccagttgtaaattaagctcgcaggcgctacgatcaaagcagagaagcttttccgttcttctttttccgaaagtaaaaaggcaattgtctgtagtgttttcccaagtcccatttcatcggctaaaataccgccaaactgataatgacctaacatcttcaaccatcgaaaaccttgcttttgataatctctcatcgttgcattcaatcctttgggaagctgtgcctggtatctttctggatgaatgagatcttgtaccatcgtttggaacgattcactaaaagtagcattgcttttttccaattgattttgaatgatcaatccttgatttttaggtacatggatcgttccttcttctgtacgtatcgattcccgtaattgttgcaacacttggcttgtttgttgaaattcttctgaatcaaaagaaagaacctgaccattttctaatgtataaaaagcatcatttctcagcaagctttgcaggacatgatcgatttcttgctcctctatccctgtcacatcgaatcgaatatcgagccatgaaccggtctcggttacttcgattttcggttgatgtttatgcgcatctaaatacaactctcgcaattttcttccaagtctgacttcaccaaactgacggaagacagatagttctgtgcggaaaaaggcatatagttcttccccgcttggcaatggacgttcataaccagtttcatttttctggtagtgatacattctgaatagatcaagtactcgtttctcttctactgtgtcacgtaacacctgaaaagtctgatctgtcgagacctcatgcttcgggtcagtcgaatagatgacttcgccatagacgaaatcgactcgagcttggatttttccttttgcttttcggaaaaagaaaataaattcgacggggatatctgctacttcctcttctactgcaggggcaatatctacgtcgccgatctctgaaagcagagggataatctctttaaacaaagacggtaattcttttttcttgaacactacttctggtttctccaatcggcgaatcaattgtttccaagtttgataaaccatttgttgatatttcgtcagagaataaaatgtcccttggataactccccactgataatgcataaagaaaaaatcaaaatcattcaatgcttgcagcaaataatcttctccaaatttttccactttgaatgataaaggtttgttttgatcggaaaattgtattccttgatcgttttgttcatttatctgcagatgcaaacgtgtagtctgattcatctgctctaacaggaagcgggcttgttctactgggagaagcagatatcttttatctagttttcctttgacttgtaagccgttcgtacctaataattgatgcgtctgagcacttcctgcaagatgcgtgagtattttttgatcttctttttgaaacgcccgtttatctagacgaaactggtactgtttattaacagtgtaagtttctttttctgcgtaagcttgtaaaaaatcatagatgttttttacgatatatgtttttttcggtgatgccaatgaaccgatacgcaagtaaagtgccaaaatagaaagctctgggtgatactgattagtctcaatcgtttctacttggtattcaataatcaaaggttgcaccgcttgaggattgttttgtgtttttagacgagaaaaaccttttgcaatgatttctccctcacttgttgcttttaccggttctagcattggctggtcttttttcatgatacgagatagatttttcgaccgtaaataaagttccacagcaactgtatgcttacaatatttatgttcctcccaatagggacattggcagtaatctatctcttttgctgtaccatccaaatcaaccatatacaattcactgcccaagacttctgcatgccacacgttttcttcttggtcagggacaaccgataacactcggccttcttgcaagtattgacgtccacgtgcaatgactttttctggaatactccatttcatagttaccaatctccctttttatccaagttgatagcgtattttgctttgtccgctaccttctgtatcaattcttatttgttgtaatactcgttctttcaattctcttacatgactaatgatgccgatcattcttccttcactttcgatcgtttctaaagcttccattgccatttccaaagcttcttcatctaatgacccaaatccttcatcaataaacaatgcatcgattgctacaccaccagcttgtgtctggatcacatcggcaagagctaatgctaaagaaagtgctgcaataaaactctcaccgccagacagggtatgcgcacttcgagacatacctgcctgatcatcatagatattgatttctaatccggttttccctcgataactgccaatggtatccgctagctcaaattgataacgatttttcgttaaacgttggagatgatcatttgctacttgtaacacttcttgaagataaacctgaagcacataccgttccaaactagtcttcttaggattttctccgttgaatgtttgcgaaagctgctgtaattgcgtaagctcatctaatttcgtctggcttgtgtgataaatcgaaagacattcatcgtagattttttgattactaattttttgttcttgtaaaccgtatatcttttcttgctttatttcgatcatacgtcttatctcttctaactgttggctgatctcttctgtatctgggaatgtctcagttagctggatattttctaattgacgcagccggtcagctgtcactaattgctcttcatgataagaagtaactgtacgttggttttctttatattgtgcttgctgttgtgcaaatgcacagatttcttcaattgttgaaaaatacgactggctttctaactttttagctattctttcttgttccttttctattttttcatctattttttctatttgttcatgttgaagatcaagctgtgtccgaagcgtatgaagatcttgcaacaattgcactcctgctttctgctcaacagctagttgattcgagtcttcttctaactgtttttcaagtcgtcgtatctcctcttctaaacagttactatccgtatcttgcaattgttgttctaaacttttgatttctccttgcagttgctggagctgattatttttttctgtctgctgctgtttgtagacagctaattgttgttcgagcttttctgcttgttgtcttatttcttccagctctattcttgcattggccatcttgctttttcgtctatctaaagattgttcgattactacaagagctgtttttgttttttgttctgttatctcaggaaatgcctttttcaaagcctgttgcaagtgttcttcttgttcagccaattgtatattcgttgccatgattttttgttctaaatctgataattgttgttgaagattattttcatgtgcttcacttttggcaatgatttgctgagttctttctacagcagactcagcttctgccagttgttgttctacttttaagatatcttccttatttggctgttcgtgttttgattgttgtatggggtgttccgttgatccacaaacaagacatggctcccctggacgcaaaaaaagctgaagacgagcaatttgctgctttgcccattggcttttcagctgttctgcttgttctgtctgttctttcaatagctgactattttttgttatttcttcagttgcttttttgagttcttctcttatctgtgcgagcgacccagtgtcttttgctttttgtttttctatttcttgctgcttttcatctagatattttaactgtccaaaagcaagacgatcttcttgcagtttttcctgatccagtaaattttcttgaagaattcgagttctttcctgatagatagcgagattttgatacagcttctcggcattcaattcttctttatccaatgaaattgttaattgttctgcgtcttgttttttactacgtaaggattcgacaattggcaccatcatctgtttgttttgcagtttttgagcagcttctttgatttttgtttgtcggcgtacgcggtttgcttcatttttttgccactcttcataattctgcgtagtcatcgctagtttctttgtttgctcactacttttttgtgacagttctattttttcagcttttatttcttgtaggcgctggattggttcgactaatcgttgcgtaaattcataatacccaatccatcgtttcttttcctctatttcgtctttttgagcagctaattccttttgcttgtttattaatatcgttttttcttcataactttttttcaagctttcaaaacgatagtaggaattttctagttgcttttgtttttcctgaagttccgttagagcttctttttcttccgtgatttgtttttcgagtattgcctgatggtttgtccattgggctaaaacggcttcaaaccctgctgctggttcctcttctttgactaaaacaaaccttttttgcagaagatgcagctcttgctctaaatgatccaatttttgttgctgttgttttgctttttcttttaatcgctcattgaactgttggaaaaattgagtaccgaataaatgacgtaaaacagtctctttatcactgcttgatgaaaccaaaaaattacggaattctccttggggtagtaaaacgatttgagaaaactgtttcgcatcgagattcatcagttctctgatcaactgatctgcttctgtacgttttgtgatttgttttatttcttttcctttcccatcaaaaatggtcaacgttactttggctgcctgtttttttgttccgtttccttttcgttttgctaaaacttgttctggttttcgttcgatttcatagctcatctgctgatgttcaaaagaaaaagtcacgcttgtttcttcgtctggtgtagcaaacaaagaacgcatctcttttccagagcgaagtcttccagaagtttcaccaaaaagtgcgaaggtgatcccatcaaaaatcgtcgttttgccagctcctgtcttcccgctgatcaaaaaaagcggtgcttctgtcaaacgtgaaaaatctacggtctcattgataaaaggaccaaaatttttaagttgtaattttttcggtttcattcttgatcattccatttccatgatttcttgcaacgtttctccgagccatttttcttggtttgcagttagctgttcttccgtcatttcactaaaaaatgcttctgctaatttttgaggatctttcatttctagtactttccgtttgcgctttgattgttctgctcgaccgtttgcccgttcaatccccaaaatacgaggatatatttgccgaagctggttcatcatattcgggatgatcgttctgtcagtgagatagatatggatgtaattctcccgattgacggactgataaaaggcagggtccagcaattctttgaaactcgctgttatttcttcaatatcatgcaggggttcgatctccctaaaattcaactccaggcctgttgtcaggtcaacgatccatacgccttttttttggttgatctcagataaagagaatttcaatggggaaccgctatagcgagcattatcctgtctcaaagcagcttgattatgcaaatgtcctagtgctacataatcaaacggtgtaagtagttcaccagggatcgaatccaacccgcctacttcgattttcgtttccgaatcagattttacacttcccattacaaaaaaatggctaatcaatacttgttttttttctgaatcaaatagctcctgcattttatctatcaccttggctaccgcttgcttgatcgttcggatattgtcatcttcaaaatataatctcgctgcaattggttcaaagtaaggaagaaagaaaaattgtacgtttttaaactcgactggttcaaatgcttctgctagctgtgttcgcaaaaaatagttcgaataactgaaccatgacgtacccgctgaaagtctcgtactgctatcgtgatttcctgatatagcaaaaatcgggatcttttcctttaaattccaatcgaccatcaattcattgtataattctacggcatcaacagctgggacactcctatcatataagtctccggcaatcacgattgcctctactttttcttctttcgcgatatctagtatagaagatagtacatgacgctggtcttcaatcaagtcataaccttgtagtttttttccgatatgccaatcggctgtatgtaaaaaacgcattcaatcacctcaaaaaatgtccttctaattattataacactttgatccattacatgacacctgtcttctattttacatattggaacgcaaaaagagggcagacttgacgtctctccctcgttttcattgaaaaagtctgaactgaacaggacagtagattcaaaagaccgcccacgcataaacttatcattttatttttttttgacttcatatttgaaatcagggttcacttctttgtccaatttgtcaaaagctgcttgtgttcgtcgttcgatctccgccataccttctttatccgttttcttgatatctgataagtcgattggttcgccgaaacgcactgtcactctctgacgcttgaacagatccccaagtgtcaacggaccttgatatacagctggcacgattttcgctttagacattctggaaatcaatgccattccgcctttaagttctgtagcatgtcttgtcccactgggaaacatgatcaaactcaaatttgtcgatttcaaaatctttacaggtgttttaatgacgcttggtcctggattttctcttttaactggaaaagcattggatcgagttaatataaatcgcagaactggatttttgaacagttcttcttttgccataaagctgaattccttgggtgctgcagctaccgccagatataatgggtcccaccaagtacgatggggagcaactagtatgtaattctcatcttgcggtaaaacttctttattctcatagcgggcatttccattaactaaggctaatagtactcgaactaccccgcgcataaatcgataaaacatagtctcttcctttcccttcttatggtcatagtatgcataaaaaatagaggtttgacaagccaccttggttctttttaataaaaatagtataatacagacgactatttttttcattttggagggaatccatgcttcacgaagacgaacgaatcgaccaattatacgcagaagatatcaagattatccaaagttccaaagtgttttctttttctttagatgctgtgctgcttgctcacttttcccgtgtacctaaaaaagggaagattgttgacctttgtgcaggaaatggcgcagttggactttttttaagtaaacgaacccaggcggctatcgacgctatcgaacttcaacctcgtctagcagacatggcaagacgtagtatcgcgcttaaccatttaaatgaacaaatgaccgtccacaccatcgatctgaaagacagcttatctgtcgttcgacataattcttgtgacttagtcgtctgtaatccaccttatttcaaagggctgccaacaaataaaacgaaccctaataaacacctggcaatcgcccgtcatgagatccatacgacgttagaagaagtgatcgatatttcaagtaagctactaaaaacaaatggacgctttactatggtccatcgtcctgatcggttcttagaaatcattcaggtcatggaatactatcgaattgcacctaaaaggatccaatttgtttacccaaaacctggaaaagaggcaaatattttgttagttgaaggaatcaaagaaggcaaattagacggattcaaagtcgctccaccattgatcacttacaatatggatggagaatacactgcagagattcgtgagatgctctatggcaaatgaacattatttttacgtattattctgtaaagatcagacattttatggtggatatacaaccgatctttctagacgattagaggaacataacaatggtactggtgctaaatatactcgtcttcaaaaaagaagacctgttaagatgatccatgcagaagtattttcttcaagaagcgaagcaacaaaagcagaagctgcattcaaaaaactcacccgaaaacaaaaagaacgttatttacagacacactcaaccgttttgcttcctgaatctataggaatgttaaaaacacgataaatataaaaaaacttcaggcaaaaacaaatgtttttgcctgaagttttttgtagctatcattctgtcacgtttgtctcactgctgttcgtacttgaacttcctcctagcaaggcttcgctgactaagtgaatgtaatgtgtcatcccttcaggatttggatggacttgatcatcataaaaccagtcactatggtcattactgtagctgtaccaatcaatcagcgtcatattgtcgtattttctcgtcatctgttcaagcatcgcattcacgtcattttgccagcgcttcgtcggtactcggacattgacccagtatacttttcgatcaccgattgcatccatcacactatcaaactgagcttccgagaatgagccattcgttcctagtccaatcagaacagtgtctttcaacaaatcttgttcctttaatttttcaatgtacggtacactggcatataattgtcgtccgacatctccatctaccactacttttggataaagttcttgtagatccgttgcagcatccaacataactgaatcaccaaatgccgttagttctaatttttgtgccttattcccttgtgccttggataactcgtacttatcaaggatcgcttggtcaaccgaactagtggtgttttctgaattgtttctggtttcttctgctagttttttactttcagcgatttttgcctgcagttgtttttgatcggctgttacagcgtttttcggtgccgtaacgaaaccaacgagtgcaattgctacaagtaatgtgcctggaacaacccatggtttgctcttactgatgatcggtttgctgaaccatcctttcatcacttggaatgtacgaccataatcaaaacgtgctagcggacgctccacatatcgataagaaagttcactgatgattagaatcaatgtgatttccactaaagtatgcaacaaaacatgatcggcaatatcagtcacctttgcttcataaaaaatcataactggaaactgatacaaataaatgccatagcttcgtttgccaatccaagtaaatactggatttgtcagccatcgattcaaacttgctccagggtgtgctgtcactgcaactagcactacgcataacagactcactaggagcattcctccgtaatagatgaaattgtaatgatcatctaaaaagaagaaacaaagaatcagtgccaaaagtgagattcctccagcgatattcagaatatttttcgcttgtttcgggatgtttttctttaaacgcgtacttggccatacaaacgcaagcgcacttcccaaccatatagaaaacagacgagtgtcggtaccgtaataaacacgggttggatcgcctcctggtgtatacaagatcatcatcaagatggcggagaggaaggatgtacctaacacagtataaaagatccattttcttttacgaacaaataccatcaacaatacaaacaagatcggccaaaccaaatagttttgaccttctactgctaaagaccagatatgcgtaaacggtgactcattagcaaatcgatcgaaataagataaaccgttattgatttgccaccagttgttgacatacagtaagctgctgaccacaactcctcgaagattgtttaacagccctcgctgaaacaaagtgatataagccgaagctgtcacaagcataaaaacaagtgccggatagagtctcttcattcttctgacataaaattgccaaatattgatttttccattttgttcccattcctgccgcagcagatccgtgatcaaataaccagatacgacgaaaaaaatcggaacgcccaaatagccgcctttcatactagttggcagaaggtgatagaagataacacccaccacagctaatgaacggagcccatcaaacccagtgatgtagcggctgttttttaaccttttttgtttttccattcaatattccaacttttcataaacttttttcattcgtaatatacgggtattaagtgaaaatagcaagtagaatcgtgtcctttctctactattttttctatcatcccataaattttaaaaaataaacatgctttttttcaactttaagaaaatttcaaataaaaaagcagtttttctttgctgattctactatggtagaaaaaaactgcagacaaacgaacgtctgtctacagcagtatttcatgaatttttgtcaaactcgatttaaatgccatcctcatagaaacgaccaagtatctggacgttttctgcaatacttacaaaagcttgtggatcagaagctttcattgcttctctaagtagaggcagttcgtatcgtgtaacgatcgtcatcaatactgtctgcttatcatgcttataagcaccttctgcttcattgatgatcgtgatccctctacgcatacagttttggatttcatttactactttttctggatgtttcgttacgatcattacctgcatcttcttttgtttagtataaacgacatcagttacttttccactgacgaaaatagacaacgtactgtaaaacatatattgccagccaaatagaattccggcaacaaaaacgatcaatgcattgaagtagatcgaaatagaaccaatcgactttcctgtttttttacgaatcgtgatactcacgatatctagaccgcccgatgataggccgtttctcaacgctagcccaatacctagtcccatcacagcccccccaaacaacgcacagatgattggatcggtagataggactgtttccggtaaaatatggatacaaagggaggtcaaagtgactgtgataaaagtgaaaattgtaaacttcttcccgatttttaaccacgccaatacaaacaaaggtatattcagtaaatacaaagttgttgataccggtacttcgaatcctatcagtgattttgacaaagtcgtcaaaatctgagctagaccagtaataccacttgaataaatatgtcctggctgataaaagaaattcaatgcgactgatgcgatcaacgcataaacgatagataccgaaagcttggtcgtgtaatcatgataagcccaattttcgaatgtttttttcatggaaaagccccgctttatatgttatggcttcattataaagtgtttttcaattaaatcaaggttatcaaaagaagcgtattcgacaaatcctttttacctttttatcggctattcttctatattcgttacatcaatattcaattcgaacaattgtaaaggcgaaaccatacttggtgcatcactcatcacatctgctgcttttccgtttttaggaaaggcaatgacttcacgaatattatcttctccggctaataacattgcaaaacggtccaatcctaatgcaataccgccatgtggagggaatccgtaatctagagctgttaacaagaaaccaaattgttcttccatttgttcttttgtaaagcctagagtttctagtactttttcttgaagctcacgagtatgaatacggatagaacctccgcctagttcataaccgttcaagacgatatcataagcttctgcatagacttttgcagggtcttcagccaataatgtgatatcttcttcttttggcatcgtgaatggatggtgagcagagacatatcgaccttcttcttctgaaaattcaaattgtggccaatcagttacccataagaaattgaatttcgattcatcaattagtcctaattcttttcctaaacgtgtccggatagcacctaatgcagcagcgacgatttcacttttatctgcgccaaacatcagcaagtcacctggttttgcatctgttgctttaatgattgcttctgttgcttctcccatgaatttagcaattggacctttcaatccgtcttcttctactttcagccatgcaagtcccttagctccgaattgtcctacatattgacctaactgatccatgtcttttcgtgagtagcgatctgcagcgcctttagcattcaatgctttcacgacaccgccgttttcaagagccatttggaagactttgaattctacttctttgactgtatcgcttagatcgatcaattccatgtcaaaacgtgtatccggtttgtcgctgccgtagcgagccattgcttcatcataggtcatacgaggaaatggcaatgtgacttcgataccgcgaacttctttcattaccttcgcaatcaatccctctgtgtaagtttggatttcttctgctgttaagaacgttgtttcaatatctacttgcgtaaattcaggctgacggtctccacgtaaatcttcatcgcggaaacaacgaacgatttgataataacggtcgaatccagcattcatcagcaattgtttaaacaattgaggagattgcggcaacgcatagaaatgtccagcatggacacgtgaaggaactaggtagtctcttgcgccttctggtgtagatttccctaggtaaggtgtttcgatatcgagaaagtcattatcatctaaataatgacgaatcgcttttgttgtcgcatttcttaatttgatatttttagtcatttttggacgacgcagatccaaataacgatatttcaaacgtatttcgtcactgattgcttgatcatcttcaatttgaaatggcggggtttttgcttgattcaaaatcacgatttcacttgcaatcacttcgaattcaccagtggccattttaggatttactgcattttctccgcgtcttctaacttccccagtcacttcgatcacgtattcactgcgacatttatccgcgatttcccatgcttctttgttgatttcaggattaaagacgatttgaacgattccttcacgatcacgtaggtcgataaagattactcccccaaggtctcgtcttttttgtacccatccttttaatgtaactgtttgttctaattgttgttcggaaactaatccgcaatagatcgttctttgtgccatttatttttttcctcctactcgaataaagtcatttcatcatagacttcatcaaaatgttcatatatctcttctaatggaaaacttttttcttttcggcttgccattgctttgacattgattgtttggctagcaagctcatcttcaccaatcaccaatactaatttggcattcgctttatctgctgtcttaaattgcgcttttgctttacggttcatgaagtcgcggtcagctgaaaaaccaaagtttcgaatcgcttggaccactttcaatgcttcgatatttgtttcgtctccgagtgcgaccacgtaagcatccaactcattaaatgcagggataactacttcctctgcctccatagtcaagagtaatcgctcgatacccattgcaaatccgaagccaggtgttgaaggaccacctagttcttccactagattgtcataacgtccgcctgcgcaaatcgttgcttgtgcccccatttttggtgcgtcactcatgatttcaaaaatcgtatgtgtgtaataatctagtccgcgaaccatattactgtcgatttcataaggaacagccaatgcatccagcatggaaacaacggtatcaaaatgtttttgagcaggctcgcttagataatctaagatagatggagcttctgccacaaatttttgatctcgtttgtctttactgtccaatacgcgtaatggattttcatgaaggcggcgtttagagtcttcactcagctctgattcaaaaggtaaaagatagtcgatcaatgcttgacgataggcttgacgcgtttctttatcacctaatgaattgatgactagccggatttgcgtgatccccaactgtttgaagaaatcaagtgccatcaccatgctctccacatcagttgcagggttttctgatccaaatgcttctactccgatttgatggaattgacgtaaccgtcctttttgagggcgttcgtagcgaaacattggtcccatataaaaagttttgaacggtttcgcatactctgggccgaacaatttatgctcaacaaaagaacgaacgattggtgctgtaccttctggtcgaagcgtcacatggcgttcccctttgtcataaaaatcatacatctcttttgaaacgatatccgttgtatcccctacacttcgggatatcacttcatagtgttcaaaaatcggtgtacgcatttcattatactgataatctctgaataataaacgtgctgtttcttcgacaaactgccatttttctgattcgcctggcaaaatatcatttgttccttttggtctttggaaactcatagttttctctccctttcttagctatgtaaataaaaaaatcacccttgttcatcatgaacaagggtgaatgaaattcatacacggtaccacctaattttgaaagatttctctttcctcttacgaataacgctcgtacgcgggacggcttttcactcgtccatctccagagtgtctttaggctaatgaaactttagatcattttcagcctcgatgatcctctcttgtaaagtttcaaaaacttactcgctctttcattgacattcgatattacttataacctactaaaaaccagtctcaaagtcaagagatatctgactatttcccctcacaaaaacgttttagttcagctttttggtattttgttttagactagacaaaaaggaggaatcagctatggcagaaataagaatcggacattcacaagtctacgcagaacagcttggattaggagcaaatgccgttggaggacataatctttttgacggtttggaagatgagacaggaaaacaagtagttcgtacagctttgaatagcgggatcaatttgatcgataccgcttatgcttacggaaacggccgttccgaagaactgattggcgaggtactgaaggaaaaagaatatgatcgctcacgtgtcgtcatcgctacaaaagctgctcatgtaccaaataaagggcgaacatttgataattctcctgagtttctcaaacaatcggtggaagatgcactaaaacgtctgcaaactgattacatcgacattttttatatccactttccggatgaaagcacaccaaaaaatgaatcagttgctacattgtacgaattaaaagaagcaggaaaaatccgagcagtcggtgtgtcaaacttcacgttagaacaattgaaagaagcgaatgcagatggatatgtcgatgtagtagaagataaatacagtttgatccatcggcaggctgaaaaagaattattcccttatcttgaaaaaaacaaaatcagttttgttccctattttcctcttgcttccggtttgctgacaggaaaatatgaacttggtgaggaaaaacaatttggtgaaggagatcctcgaaaaagaaatccagatttccaaggagaacgtttcagagaaattttaaccgctgtcgatgtacttcgccccattgctaaaagataccaagccactcctgcgcaacttgttttagcttggtacatgaagaatccacgagtgtctgtagttatacttggagctaagcgtccagagcaagtatctgacaatgtccaagctttagatttgcatttatccaatgaagattatcaaaccattgatgaagcatttcgtggattttgatcaattgaccttatcaatttatagtaatatgaaaaaaggaagatcagcactgtttgatcttcctttttttcgataagtttatgctaatctaattcttgtaaagtagcgctcggctattcggataagtcggaaactgattgaatggaatcgtccaatcttgttcaggtacagagaactcaaacttatttactagctgatcggaaaacacacgtagactatgaagagtgatccattctcctgcacagcgatgcatttgtcgaaaatctcccccgccttgtgcaatcatctcatattcttctttataggaaatatcttttgctttccctacataccgtttgatcataaaggaatctggcgcttcaactgttcgttcatcatggtctgttccatataaatctaaaataacccaactgccttctggtatacgataaccatctacttctacttctttcagcgaaatcgcaggtagcattgggaagaaaggataatagcgtctcatttcttgaataaacggatcttgtaacgtcgaaaagtcattttttaattgctgatacaaatctggtctactgaaaagtgcatgtcccatcaatgccgcccacacagttagagcaaccgttggacggatgatgttcaataattcaacagctgccacttccagaggtaaaagctgaccatctaaatctgtggcattggcaaaagcatataatgccacattttcttttccagccacaggattttgtcgagcttcttcaatcaagccttgcgcccatttttctgattttttgcgattttcgacaccttttatgtgatcaatcggagaagtaaacgttccgctgatcatagagatttgatattctgctaatttttcgacctcatctttagaaatcgctgataaattgatacctgcccactcgcaaatagatgtaaagaaaaccatcttacttaaatcaaatagttcaaattgaccatgctgtgcttcaagtgcttgtgtcagattcttatctaagatacgatgataatcttccattctttccggtgtcattagatccataaaaatatttttccgatggtgatgagcagctccatccaaagtctgtactccaccttgaccaaaaagtgtcttcaatactaattttggcatagcaccttttcgtttgaaattccttggatcataaaatacttttgctgctgatgatccgtagatcgtgatagcttctttattgaaaatctttgctttgacgacgggagcgtccgcttcatggcgtaactcctccaacatgttgtatcctttttgatacaatttttttaaatctgtgattttgatatctactactggtacttctttcatcttcagcaacctcctataaaaaataacttgtataatttaagcttaactttttttccgactgctgacaaaagaagcgctttttgcagacaaaaaagccacttaagttagagtttatcagtctaacttaagcgacgtgtttcatagtttttactagtgaaaaccagattactttatttgtttttagaatcaataatgatcgttacaggtccatcattgacgagagaaaccgacatatctgctccgaattgtccggtagcgactgtgatgccgcgacttctgattccttcattgaatgattcgtataaaggaatagctgtttctggtcgtgcggcttccacaaagcttggtcgatttccttttttcgtatccgcaaacagtgtgaattgagagatacttaaaatttgtcctcccacatcttctacactaatattcatttttccttgttcatcttcaaaaatacgcatttgtgcaattttttttaccagatagtccacatctttttgcgtatcggtttcatgaatgcctaataaaacaagtaggccgtagccaatttttccaatttcttgctgatcgactgacacagcagctttacttacccgttgaacaactgctctcatatctgtcctcctatccattcgtccggcgtacactgtagacatcaggtactgctttgattttatccacgatactctttaggtgggataaattctggataccaaccgtcaaatggatcgtcgccattttatctttattcgtccgtgcttcaacgctgttgagatttttcgttagcgcattgactgtttgaagtacatcattcaataagcctgaacgattatagccgtaaatttccaaatctgcatcatactcttttcgtgtattcgatgtatcttcccattcgacttcaatcaaacgttctgctacatttggtttgtcaggctgaacattcggacaatctcgacgatgaatggatatccctctgcctttagtgatataaccaacgatatcatcaccaggaatcggattacagcagcgactgatacgaattagtaagttttctaccccttgaatgacaacgccaccttcatgacgtactttcattttgtcaggttcttttttcggctgattcatgatttcttctgcttcttgcttttgctgctcgattttttgttctttacgttctttttcagtcagacgattggccatcgtcaaggggctaacttctccataccctacagctgcatagagatcatcttctgtttgataattaaaacgatcgagtgcttcttgcagtttgttcttcgtcaaaatatctttaggcgtaaatcctagatctgtaatacatttgaccacggattcgtggcctttgatcacattttcttctcgatcttgggctttgaagaaacgtttgatcttatttcttgctttgctagtagcaactaatttcaaccagtcgcgacttgggccaaatgaatttggagaagtcatgatctcaatgatatctccgtttttcaatttgtaatcaagctgcaccattttgccatttacttttgcaccagtggttttgttaccgatatctgtatggatactgtatgcaaagtccaatggtccggatccttttggtaactcagtaacgtctccttttggtgtgaagacgtagactttatcactaaagatatctccttttacgccttccataaattcagaagcatcatagctttcgtcttgaagttcgagtatctcatggaaccagcttaattgtttcgtcataccatctggttctactttttcattttttccttctttataggcccagtgtgcagcaaccccgaattcagcgatttcatgcatttcctgtgttcggatttgaatttctaccggatttcctgccggaccgatcacggtagtatgcaaagattggtacatattagcttttggcatggcaatataatccttaaatctgccgggcattggtttccattttgtgtggattgctcctaatacagcataacaatccttgattgaatctacgatcactcgaatagctagcaagtcataaatttcgttgaactgctttttctgatctttcattttacgatagattgaataaatgtgttttggccgtccatagatttctgcaaaaatccccagctcttctgtcgctattcgaatatcttcaacagtaccacttacgtatttttcacgttcttctctcttcgtctgcatcaagtggacgatacggtaatactgttttggatttagataacgaagtgctgtatcttctaattcccatttgatccggctgatccctagacgatgtgcaagaggcgcatagatttctaaagtttcctgagcgatccttctttgcttatcttctcgcaggtgcttcaacgtacgcatgttatgtagtctatcagctaatttgaccatgataactcgtaaatcttgagccattgctagcagcatctttcggtggttttctgctagctgctcttcgtgggatttatattttattttccctaatttggttacgccgtccactaacatagcaacgtcatcgccaaattcttctctcagatcttctaaagtgatttctgtatcttcaacaacatcatgtaagaagcctgtagccactgtatggggatccatttttaaatctgctaatatacctgcgacttggataggatgaataatgtagggttcgcctgattttctaaactgtccgtcatgtgcagcagtcgcgtattcgcatgctttctcaacaaatgctacatgttcgggacccatgtattgactaacgagctttatgacaccgggtcccgttaaaatttcttcttttgtcacaggaatcgatccccctttcttttttcggtaaaacgggaatcgggacaaatatctgtttgataattgtcccaaaatccgtgcagttatacgtttttttacggaaatgttcgctttttaaaagctttttcaaacgatttttcgtatccattgtataaataattgtttctattatacaaattgttgactattttttcaattctttctgtcgatactcttttattaatgaagaacgttagctgaaagaaggattcattaattcccattgatagctagcagcacttaataaataaagaggtgctgtttctgtacgaaggattcttggtcctaatccacaaagtatccctttgtgttctacaaaataatcgacttcatcgcgggataatccaccttctggtccaaagacagctaagattcgactatctggttttgtttcactaagaattttggctgcatttgatttttcgccttgctttgctgattcctcataagcaaccaagaccacgtcataatcatctagccgctcaaataaatcttgtttcgtttccaataactctactgatggcacgatctgccgatgggattgttccgctgcctcttgagcaatcttttcaagccgttgttgtcgtttcatacgtttttttgcatcccatttaacgacagaggctgatgccgggaaaccaagaaaagctcgcgctcctaattcagtggatttctgaacgatccaatccagcttttcccctttaggatagccactcgctatggtaatcgaacttggcagttccttttgattttcttcttttttaatttctttcagataaacagcctcttcagtaatctccgtgatttctgcaacaatggctatttgatcattgaatgccaaaaaaacttcatcctcgggttccatcctcataacccgtacaatgtggtgatagttttccccttctaaaacaaaatagtcttttgattcatatgattcttttaaaaaataccgctgcatctattccacctctggttttttcaaaataattgcataccagtctttttgctggaaaatttgatccacgataaacccttgttctaacatggcatccagaaccatttgcttcttctcttcaatgattcctgaaacgatcagcgtgcctgtttgcttcagtaaacgccaagcatctgggatcatcaataagatgatatctgctaaaatgttcgcaacgattacatcactttcaatctcgattcctgtcaaaagatcgttagctgatacatggacatctttggctatttcattcatatccatattttctttcgccgaacgaacggctacttcgtctaaatcaaaggcatagacatcttttgcaccaagatattttgctgcaatacttagcacgcccgacccagttcccacatctagcaatgtttcaccaccacgcaagactgtttctagtgctgtcaatgtcaaggaagtcgtgggatgagtgcctgtgccaaatgccataccaggatctagtgtgataattttttctagaggatcttctgtctggtagttttcccagcttggcgcaaccgtcagcattcgcgtaatacgcaccggatgatagtatttcttccaggctgttgcccagttgctttcctctacttcactaactgttactttattttttccaatagctagaccaaactcaggtaattgtgtgatacgatctttgataaaaggcaagatttccggtaagaaagtcgtttccggaaaataagccatgactagtgcgccttctttcagcgatgtaaaatcatttttatctaaaatctcaccatattgatccgactgaaaatgttcaacatctaaagaatcttcaatcgcgacaccactcgcccctgcctccatcaaaatattagcaactgcttcgactgcttcactttcagtttctacttttacttcattccatttcatatctgtcactccttaataacttgggtacggtaaataagtatctgcttcattttgctgttttacttctactaattctgctagttgctgattatcccagtgaagctcgaatacagcttcgtcatcgtcttcatccaaaaaaacaagcaaatcgctttgcccttgagctaatacttcatttagatattccactaaagaatcagctactgattttgccaaccctttttttccttcataagggattactgctagataattgcgttcatcaaaaacagatttctgaggattaaaaagaagtacgccgtcttcaaattcgataattggttcttgcgaaacgatcccttctgcatcatcaatctcaaattgtgctttattttctgcaaacaagcgaacaacgatctcgatcgtatgattttttgtatcccaatctaaagctacatcatagtctgtcacttgtttttcaattatttcatctaaatatgttaatagatccttctttttcattttctttcctccaaccccaatctttctcgatttggttttttctttgtaaagagatataaggatttcccgacacaacaaaacgcaacggcttttctgtccatacacctttgtttgggataccgattctaggcaaagcattgatcttttttggtgtcttttttttctcaaaaactaagcgtaacgaactatctgctatagactgaccataaagttcttgaggaattgctaatgcttccactaattttcccggaccgttgctgatatctggaccagtttttccgccacgatttttactcatttgatcaatcattgcggcgggttcgattgcacgtatcattactccttgaggaatcccttctggctgagtaatgatgttcaaaatccgatgagtatgcatcgtgtaaaggtagatcgtacctggtttttcatacattgcccgcacacgcggtgttcttcttaaaccatagctatgggcggcctcgtcttctggacctaggtatgcttccgcgtctacaatatatccagctaatcttccttctggtgtgtcatgctccaaatacatccccaataaatcccgtgccacttctggcgtcgttttattccaaaaaaattcatctatcttttgtttatccgtcatttttctcacctactttatcatacacaatattagttggataagctatgaaaacaaaacaacagaaggctgttctttctaggcatcttgctaaatatgatataattaagggacgtaaaaacaagaaggaggaaaatcctatgcaacagccattggcttatcgcatgagacctcgaacgatcgatgaagtcgttggtcagcagcatctagtcggggaaggaaaaatcatacgccgcatggtcgatgctcgcatgctctcttccatgattctatatggacctcctggtactggaaaaacgagtatcgcaagtgcgatcgccggctctactaattatgcatttcgcatgctaaacgccgctacagattcaaaaaaggatctacaagttgtagcggaagaagcaaaaatgagtggtacagtgatcctcttattggatgaagtacaccgattagataaaacaaaacaggattttctgcttcctcatttagaaagtggccgaatcatcttgatcggagcgactactgagaatccttatattaccatcaatccagcgatccgcagccgtacacagatctttgaagtcaaaccattaacagaacaagacatccagttggcagtcgaacatgctttaagggataaagaacgcggccttggacaacaagcaatccagttagacgaagatgctcttcttcacctttcgcgtgcaacgaacggcgatttgcggagtgcattgaatgggctggaactggctacactatcgactccttcagataaagaaggaaggattcatcttacactgtcgatcattgaagaatgtgtccaaagaaaagctcttacccatgacaaaaatggagatgctcattatgacgttatttcggcttttcaaaaatcgattcgtggaagtgatgtggatgctgcacttcattatctcgcccgtttagttgaggcaggtgatctggcaagtatttgccggcgtctgatggttatcggttatgaagatataggtttaggtaatcctgctgctgcggctcgtacagtgaacgctgtattagctgctgaaaaattgggattgcctgaggcacgtatcccactagcagacgtcgtcgtcgatctttgcttgtcgccaaaatccaattctgcctacatggcattagatgcagcacttgctgatattcgagagggcaaagctggagatgttcctgatcatttgagagatagccattacaaaggtgcgaaatcactcaaccgtggcgtgggttatcagtatcctcatcattttgatcaggcttgggtcaatcagcaatatttaccagataaactgaagaatgctcagtattatcagccaaaagatacagggaaatatgaacaggctctgggtcaacagtattaccgtataaaagagtggaaaaagcatcctccaaaaaactagacaagaaaacggttctgtttctgcgagctctctcattgctctttttaaattcatatgctactatagaggtgggaaatctgtgatgttcgaattgtcctctttgtgtgttgaccgaacatttttattgatatcttgggacccgtcttgtgtcactgctggtaacatgccttatcatttggtagttcgaagctacgaccatgggacccacctgcttgaattcgcgggatcaatactacaggacaaacaacggcattaacggagattaccatcttttaaagaataaagcaatttgctcttggcaaattgctttttctatttgttgcttattttggaggatttgttcatgattaggattttaatgattatcgccactttagtattattattcgttagctattatttatttaataaacaggatatcttttttgtattgatcaacaaaaatgataaaaatcaaggattcctacaattttacggagctgcatatgctgttttaggcgtaatgggtattttaacagcttttttcaatcaacgctttattgccttggtctttttactgatcgtaattattgtttctgccaccttcagtatccgatttgcaaaaaaaattgctgaaccaaagcagtaaataattctctttttccctaaagtgttctacaataaaagagtacaatacgattgacttgaggagtgaatgcttatgttacaacaatacaaaaaaatcatggttgccgtagatggttctgatgaagctgaattagcttttaaaaaggcggtcaatgtagctatccgaaataacggagaacttctattagcacatgtcattgacacacgttctttccaaaccgtttcatcctttgatggaatgcttgcagaacaagctactgaaatggcaaagcaaacattggcagattatgaaagcaatgcgaagaaagctggcttgaataatgtaacctctgtcgtagaatatggctcaccaaaacaaattattgccagagaaatcccagaagataatcaagtagatttgattatgttaggagccacaggattgaatgctgtagaacgtttatttattggttctgtttctgaatatgttattagaaacgcagcttgcgatgtgcttgttgtccgaactgatttagaaaaccaattgccagctaaagaccacaccaaagcttaacacgtagacgacctgccaactatcggcaggtttttttgcacaaaaaaccgtgataaaaacaaaagacgcggcaagcactcatcggtctttataatgtttaaaataaagggaaaacagtcaatgagttcaagtaaaataaaaaaaagtgaacaccagggcgattagtcgccctggtgtggtttaaaacgacctaagcatgccaaagcttattggttcgtcaatgtggaagtttccgatgaatctgatacgaaaaaatatgaagtatcgatggcggataccgattttatcgccaaactaaaattttatttcgggttcgggtaccgcgagaaggcaagtgctacattcggtaaatcattcaagaattgatgaaaggctaccgcttgccattgcaaccacaacgatactcctgaacgcgatgttggtgagatttccaaagagaagagctgtttaatgcaacggtattaagcaaatggcaaaaggaagtcatgtagacaaagttttttatcaaacaccatatgatttcgcctgaacgctggtttagctcagaatacaatgatgtggtccacgagacattaccctcagtcagataaaaaaagctctctgacagaattacacatcgataaatattaagtaaatgtcagcgctagttgaactttctgacactttcaggtacactggaaaagacaactacacgaaggagggaaaatactatgatgcgcatgactaaaataacaagtaatgaaaattaccaacgataccatatcgcatttagccatgcaatcggttttacagttgctgttgacgggacaagtttgtccaaaacagttgaattcacgtaaaatcaatggccatctcaaggtatttttctcatgataatctgagtttaaataacacaggccatggataaccatggccttttttagtggtctcaaggagagagatcatgatcatacaagcaatttctattaaaaaaacaatcggcgggaatccattatttgaggatttatcctgtcaaattgaagctggtgaaaaaattgccttagtcggtatcaacggaactggcaaatcaacctttttacaaatcttgaccggcagagaaggtgtcgacagcggtgttatcagtcgcaaaaaaggcttaaagatcgggacggtcgaacaagaacttacagtttccgaagcgaccgtcaaccactacttgctccattctgccgctgagatacaggacctcaaacagcaaatgagtcgctacgaagcattgatgacagaaccagatacaaacttagagaagtgtctggcccgttacggtgagctgcagcatcgctttgaagaactaggcggttacgtattagaagaccggattgcagcgatcttgcaaggcttagggattccacaccgtcaggaagcacggttaacagaacttagcggaggcgaacgagttaaagtcgctttagccaaaattttagcagccgatgccgatttgcttttactcgatgaaccgaccaatcatttagatcttaacagtattcgctggttggaaaactatttacagaatacaaaaaaatcggttctggtcgtttctcatgatcggcaatttctcgatcaagtcaccacaaaaacatgggaactggaagaaggtgcattgattgagtatcccggaaactacagccgttttcgagtcttgaaagaagctcgcttggctgagctgacaaaaaattacgaactgcagcaaaaagaagtccagcggttgaaagtcatgattcgtcgttttcgtcagtgggcacatgaaggagacaatgagtccttcttcaaaaaagccaaagaactggaacgccgcctggcgaaactgacactcgtcaaaccgccacctcccccgaaaaatcggctgcaaagcttgtctaatggtggaaaatctggcaaagaagttttcatcattcaaaacttgcaccagcagtacgctgatcaagtactattcaaagacagcagttttgcagtctatcgtggagatcatttagccatcatcggcgacaatggtgcaggaaaatcaaccttactcaaattattactcggtgaggaaaagccttacggtggcaccatcaaattaggtagtagcttgcaaatcggttatttgccgcagcagctgcagtttgccgatcccgatagccgtttgctggcttacgccatcacattgactggaaacgaagaagtcgctcgacggcaattagccaaaagtggcttttatcaaagcgatgtgggtaaacggatcaaagatttatccggtggtgaaaaaatccgtttggcgttgctgaaactctttttagaaaaaatcaacgtcctgattttggatgaaccaaccaatcacctcgacagctatgctcgagaagaaattgaagaaatgctgcaagactatcaaggaacgctcctagcagtcagccatgaccgctactttttgcagcaacacttccaagaagcactcgttattgatcaggagcagatcagccgccagccgctcggccaactgattgactaggacgttttttcgcaacaaaaaacttgattttcatacctgtgctttcacgattcaggcaaagtacaggtggaaaatcaagtttttattattcgatcaatgaatgtttcggatcggttttctagctaaacataaagcgaagaataaagtcgacagcccacgaggctgatctaaaaatgttttttctttttacatatgtaatgtcccttataaagatgaatgaaaataaaatattgggattttcctgaaaatcaataaataaaatgccagtcttttcccttttgaccacttttccaagcaaaattccctaagaagatcctgtaaaaaagaagggaaattgaagttaaattaccattttgcggtcttctccgcaaaaaaaacacatgcaagaattccctcttgcatgcgtttcatcttttatcctaacgaatgctttggcttagccgcgcagacgctccacatcacgggcaatcattagttcctcatctgttgggatcactaatactcttacttttgattcttttgtagagatatctacttcttcaccacgcaattcattcaacgctggatcgatttcacaaccaaaccaagacatacctttgatgatttcactacgtacatgtccgtcattctcgccgataccagcagtaaagacaattgcatcaacaccattcatcgttgtcacataaccgccgatgtattttcggatgcggtccacgaaaatgtcataagctaaacgaatatgttctttttcatagttcttttcaagatcacgcatatcactagacaatcctgttaggcctagcagaccagatttcttgttcaaaacattgatcatttcatcaatatcaatctctaatttttccattaaatatgggagaacagctggatcgatatcacctgaacgtgtacccattgtcaccccagctaatggtgtgaatcccatagaagtatccatggatttacctccatcgactgctgtgatcgatacaccatttcctaagtggcaagtgatgatttttagttcttcgatcggtttgttcaataattttgccgcacgttccgacacataacgatgacttgtgccatggaagccatattttcttactttgaaatcttcataataagacaccggtaagctatataaataattttgctttggcattgttgagtggaaagatgtatcgaatacagccacactcaaaatgtcaggtaaaatctttttaaacgctttgatccccattaagtttgcaggattatgcaaaggagcaaattctgctaattcagcaatgcggtccattactttctcatcgatcactactgaatccccataagtttctcctccgtgaacaacacggtgccctactccggtgatttcatcataagagcttaaaatttgcagttcaatcaactgatctaacagcatttttactgctacttcgtggttttcgatatccatgatttgttcgaatttttgattatcgccgtacttgatggtaaaaatagaatcttgtaaaccgatacgttcgacgatccctttcgcaactacggtttcttctggcatttgatataattgccatttcaaacttgaactcccagcattgattgcaattgttttagacatatgactctccttctcgttgaatgattacagagcagatgatttccagtttttaaactcgttgaaaaattccgtcaccttctctggttcttttaatgaagcaagtttcacaagcaagacttcttttacttgttgtgcttgtggtccttttttctgtaagatcaaaatacttttttgcgattgtttattacggaacaattcatctggcaattgaatcattccttgaagataaccttcttctttaaaccattttttgatttcttcactttgatccgtttctaaaaatccactcggcatcaaaaacaaaccaaaaccatccggcttcacatatttcattgattgctctagcaataaatgatgtgcataactatggccttcttcggtacttgttaaaaactcttttgctttttcgtcattcggataataaccgattggcaaatcgctgattgcaaaatcgacaggatctattaataattcctgcaacccgtcttgatgaaagtattgaacatttgcttgtgtcaaatcacttgtagaagctgcgacagccaacaatgtatcatcaatatccacaccaattccttctgtttggtaccccgcattcgataggtttaaaagaactgttaataacaagttgcccattcctgccgcaatatccagaatcttaaccggtgcttttttatttgtgtatagttgttcaataagaaaaacaaataaaaaaccgatactatcaggagtgagttgatggttcgcctgcaaatgttctgtctggctgcccttcaataaaagtaattgagacagtctgcgccattcttctggctcgaaagaaagtttcttcaactcttcataaagagctgtgatccgttgcgttgtctcttttgtcggcactccatccaccacacgtacttgataatcatctattaaattttctgcattttcgacataggcttctaaaaaggaagttcccaatgcattctgtaaaagctgaatagcttccaggttttgattaaacccttgttccattttttctggtaacatggtgcacctcatttctagatatattataacaattttttcacctgtttaattctatcgaacaattgacaaaatttcaatcgttttcactgttttttatttgtgaaacggcaaacatttttttattaaaaacagtgttataacagaaaagagggcgttttcacgaacattccatcattctgtactagtatctgtatcattttttacttcttctgtgaaccgaaagataaacggtgagacttccacctctaagaatagggactgttgtacccactgatatgttacagatccagttgtgtagtaaaaaactccttccgaactttcggcaagcgtagactgttccgataaagccatctgcttcattatttttgctatataataatttttgattcgtatattaagatccattgacaaacggtagctttctaatgctgccatcaataaaaacgtacataaaagaaataaaagcaagacagaaaataaaatagagcccttataacattttctactgatcgttttttgtccatatggcatatccatcttctccattttcaaagtgtacataaaaagaaattgtgtgttctttttccaataattgaagctcagtgatacttgttaacataggttgatgtccaccggaagttcttcttttacgtatcattgcctgatatctttcgatgatatactgtttatcctcgatcgtgtagtgcagttgctgatttttcacagagacattgtgactgctcttgagttcttcttctaattgtgctaaaaatattagccactctttttgatctttacgctgcaaaaattcacttacttggatggtttgctgaatcaaaagattgaatgtgagcaatagactgctcaatatcatcagtccaattagacattcaatcagcgtaaatgctggaattacttgttttttcaatactgatcgcttctttctccatattgacaaacactttttcgattactccattattatcgacaatttggatatcgtatgggatcatttcttcccttcgctctggtcttttgtgatacatccgctgcgtcttgatatcttcataaatcattcgaataaatagcagttcctccccacttttcttttctgcctgaagcaaaaacagctggccaaagctcactaagtagacacagacagaagcgatcataagcgctgtaagggactccaacaaaacaaatcctgttttattcaattctttttgtatagcgaccactccctatctggaattgatacgtaatcgtccgctctttttcttcccaataaaattgataagcttttagtgaactttcattcccggttctagcagcaaaagtaatagaagtatggcgtttcaaggtaatctcatcaggaatatctaatacttcccaatttattttatctggattcggaacatgaaaaatgatttgattctcttcactattccaataaaagcctgtttggatctgattcacaatagcgattttttgcgtagaatagattcgtttttcaaattggccgaaaaattgatagactgccaattcattcttccatgcagaaaatgcgagaactggaaaagaaaggatcgttgtaagtaataaaatcagtaagagtgattcaaacaacgtatatcctgatgctaaaaccttaccttcaaggccgctgatagatttctgcatgttctcgtttgatatagccttcattcaacaattcctccacagtaggaactcttccattattttgaagcgcatagagctctttttgtgtgtctaccaactggatgatcgcttcacgactttcttggtctacatgattcctataacgcgacaaattagggacgaacaacaacactaatacactgatgatcagtaagacgattagcatttcgatcaatgtaaaaccgctataataagatatttttctctttttcatggcaaaacctcctctatgcttccgtaaacaggtaataaaacagcggcataaactaataaaatcaaagccgctacgcccaaaaaaatgattggctgaataaaatgcatccaatgatgaagacgtttgaaaagctgttttcttgtccattcgctgtaaaaaatcagttctttacctaaacttccctttgcctctccctgtaaaacaattttactgaattcttctgatagaaaacgataattctggaactgctcagccaatgacatacctgcctccaatccttgaatcaacttagaggcaagatgctgaatcagactttcttgtttcgtttcctttaagcagactatgatttgccttaattcgaaaccttcatgaaaaagctttccaatctctagtgacaaataagccgattgatacaaggaatatatcggtccaatcaataattgtctgcttatccattcactctgatcaacaggagacaacttcatcagacgataccttactagtaaagccaatagagtaaccgctaggatgaatagtagaacataccaatgaaagacttgtatcagctgaataccccaatgctcttgcatgaccattcctgaaccaataagctgaggcaaaacgaacaaccgcatactaaacaagatacctagcaaaaaggtgagcaatagcatcggatatgcaagcagctttttcaaatcattgcgaaatccttcaacaagccgaaactgtttggcaatttccaacaaagttgtcggcagattcccatgacgttcagctaactcgatctgtaccagttgctctgctccatatcctatttgcgaaagtacctcactaaacgcttgcccttcctttagctgatgttggatatttgccaaaataacaggtggaaacgaacggatcgtgagtaataaataaagggattcttgcagactaaaaccagataaaagcagttctcccatggtttgtgcaaactggttttgctggcttcttgttaatcctttagaatagttctgactgccaaatattttcctgagcttcttcataactttcctcccatgatttttttactgattcttcctccataaattgataactccataaaacagaaggatggtgattggcatcttccaaaagttcttgataaatgacaccagctaaacattcagatagctcttcttttttctttgtcagttcatggattctgaccaatgtaccttcaagattgcgtgcatgtacggttgcaaaaacccggtgccctgttagtgctgctcttaccgcagcatgtgcagttgattcatctcttatctctccaatgattagcaagtctggacgatgccgtaatgcgagtttcaaaagtgtatcataagtctgtgctattttcggattgatctgtagctgcagaaaaaacggttcttctatctctacaggatcttcgatagtaatcacttgcaatttttcttccaaagccaaccgatacattagagaagtcttgcctgatccgactggtccgctgaaaaggtataatccacgtctgacggttttctgtaaaatagttgcaaaatctcgagaactaaagcaacgatggggtgtttcaaaagtaccgtataatagccgaatcactaaactctctcgttgaaggtaatctcctacagaagacaaccgcagacgaacttcctgtttttctaaagaataagtaaatgcacctaactgagcttttcttttttctccgatatccatctgtcccaaatacttaaatcttgagatcagttgctgtccatctgccgaagagactttcttccagaatgttcgtttttttccatagcgaaaatagatgtaaaatacttctgaagctggcaatatatatacgtcttgggcatgtttggcaaaactttcacttatcatttgatccgataatcgttttatttccattattctcccctccacaaaaaacatacgtctttttgatcttttcgtttcaaataaaatgaatttacaaaaaaatattggcaaaagccgaatttatgttatacttataaaaatttatcttgggaggcactccattggaaacaacattaaggaaatatatcgaagtagcaagtaaaaaaaagcctgctgacctagtgatcaagcatgctaagatcgtcaacgtctttacgaaagaaatcatggaaaaagatgtagcaatctgcgaaggaatgatcgtaggaatcggtgaatacgaaggaaaaagcgtacataatgctaatgggcaatatctagtgccaggattcatcgatggccatgtgcatatcgaaagctcacttttatcaccaagcgaattttcaaaagtatccttgcttcatggagttactactgtagtgacagatccccatgaaataggaaacattgctgggagtacaggtcttgagtttatgatagaagatgcaagacaaacactcatgaatatcttttttatgctaccttcttgtgtacctgtaaccccttttgagaccaatggtgcaaatttaaatgcaaaaaaattagccccttttttacaaaaacccgaagttttaggcttagctgaagtcatgaactatcaagcagtagcaaataatgaaacagacatcctagaaaagatccaattgatgcaccagcataagaaaaaaattgacgggcatgcagctggtatcggcatggaagagttaaatgtttatcctgcagcaggtattcggacggatcatgaagctacaactgcaaaagaagctaaagaacgtttggatcttggtatgtatttaatggttcgagaagggaccgttgcaaaagatctggcatcgctactaccggcgatcacacctgaaaattcaagaagatgcttctttgtcaccgatgataaactgatcaatgatttagtaaaagaaggatcaatcgatcatatcgtccgtcaagctattgcacttggaatcgatccattacaagccattcagatggcaacattgaatgcagcagaatgttttgatttgaaaacactaggtgcgattgcccctgggtatcaagctgatttcttcttaacagacgatcttaccaagctgccaattcatgaagttttctataagggaacattagttgttcaatctgggcaactccaagaccatttatttgctgatcattcaaattcatatacgtgttgtctgccaaaactaaacgctcaaccattaaatccacattcgttagagctgcttctttcttcttcacaagcccatgtgatcgaaattatcccgaatagtctagtgactaaagatttggtagaaaaagtggaccgacaaggcgaacgattcattccttcaatcgaaaaagaccaattaaagattgcggtgatcgagcgtcaccatcaaacgggaaatattggattaggcatagtgaaaggatttcagctgaaacaaggagcgatagcgacaacgattgcccatgactcgcataatctagttgtcgttgggacaaacgacgaggatatgctgtatgctgctaatcttttgattcaaaaaggtggcgggatgaccgttgtcaacaaacagcaggaaatagcttgtgtttctcttcctataggcggaatcatgacacaggaacctttttcgatcgtctatgaacagttgaatgaattaataactaaagcacatcaactaggagcagctaaaacctttgatccttttttgacactttctttcttaacattatctgtcatacccgaattgaagatcaccgacaaaggattattttcattttctcgcttccaattgattccaccttgtggaaaaaccgatgaaataaatacattttaaatcaaataaatcccagaaaatacattacatctgtaatgttcattttctgggatttatttatggatattaatgtttttatgaaagcagaaagttagtttcgcagacttttctttttggtcttatcttgaaattgagcttctactcgataaatacgttgaccttttgaagaaaatttttcttcatactccgtcataatattgccttcaaattgactttgatgtaaatctaaccatacctgtttgaggatcatgccatattgagaaaaacttgccagagaatactcaaacaatccttgattatctgttttgaaatggatttctccatttggacgaagaatctgttcatctacagcaagaaaagtcttatatgtcaatcgccgtttttcatgacgtttttttggccatggatcggaaaaattcagatagatttgatctacttcgctgtcagcgaaatactctgtcaacgctgatccatccacatgtagaagtttcaggttaggaagcggttgttcgatcaacttgtctagtgcaatcgaaacaacactgacctgcatttctactccaatataattgatttcaggatgggcttttgccattccagtgatgaactggcctttccccataccaatctcaatgtggattggatgatcgttttcaaacaattcattccattttcccttccacaatgttggatcactaattacaaaattcgggtgagccgctaacatttccgctgctcccggacgatttcggacacgcattatttatctccattcctttcctctaattaaaaaggtctggccaaatctccgcagagtttgggccaaacctcagccactgaaaattcgttttaattgtaaaatttcttcgttcatccgtcgatgatcttcacgtttgcaatatctggtgatttcttggagcaaattcatggccgcataccaatgaaatttttcaagcatttcgtcagtcgggcgtatgccataactgatcagccactgattccagctagacagtggcacataatttcctaaaatcgttgcaatatccaccgcagggtctgcaaacatgattgaatcccaatcgactagatataaataatttttacatactaaccaattacgatggtttacatctccgtgtactactgataagttttccttatctattgacgggatctgctcacgaagaaaacgatggacaatttgcagaaattgatttttctggagttcttccggtaattctttttcatatttttgcagcatcttctccggcgtcatgacacgaccaccgatacgggtcagcatggttttaagagaatttgaatgatgtaaatggtacaaaacatcaatcacgtcgtttctttgaccaatctcattaggagtcagcaagcgaccttccagccactcttgtgctgtcaaagtatcgccattccccgttcgttttgtccaaacaagttttggtgtaattccttcccttgaaagagcagccaacatcggagtcgtgtttcgtttaataaagactttgtcctcatcacgcatgcctatgtatgtttttcctgtgtcgcctttgatgggacgtaaccgccactcttggtctaactgaaactccatcatgcattctcccgtcctcttactctttgttttgcagtacttattattctagtcgcctgaacactacacgtcaagcacatatacgttctttttcatttaattgccattcaaaaaaccagcttttctcaaaaaaaatagaacgaacagcattcttactgtcaacgctctatttttcattctcatttttaccctacacagctttgttttcagtctgacatcttcttcaaacgagttggtacatatagtttaacaaagagcatagtaacaatcaaataagccgctagcggaacccatcgctgctgcccatctaatacgactgcagcaatcaaaccaaaaataaccgacgcgataattaatacccatgtgagtagatactgaatcgcctgcttcttctgattcttatggattggataaagctgaacgagaaccatatagcggaactggttcgctaaaggtaacagttggaaaccgatcaaatataaaaataagaaaccgataatcagactaaaataaaagtcgactactccggcaatcaataacccacctataattactaatcggaaataaagaccactaaaatcagaacctcttgccaatcttcttgcaaacaagtaaagataagtgttttttgattctcttttaatatgagtcaatataggatccaaatagcgtcttcttttgatctttgccgtaatttcaggaacatctgtgaataaattgataaattgatagatctgatgcaacctatgttcttctacatgcaccattttctcccaatccaatcctttttcttgttgcttccacaaaaaccagtaatatagacttgcctgtactaatgcacctgctattcctgcccatatcagccaataaaatgatagaaacaaaaagatcagagaagaaaaaaaccagcctaatttccaataacgaataacttgttgatctagtcgaaacaattctgctctcttgatttgcagatgactgaatttcaaactccataatatgatcagatagacgaaaaacatcgaaaaggattgctccgtactaaccaccactaatggcatggccaatccgcatgccaatatcaaaaagatcaacggaaaaatgcaagaatagcgaaaagctcgttccaaataggtttgcatttctttttctttaggaagtaaaaaaacaatatctgctgcctctgcaaaagtagccattttacccacgaataaacagagcatccaaaatacagagattatgagccctccaattgcaaacggtggctgcagggttttcaaccaattagaataatataatcccacaccgccaatcaagaaaagacaaactaaaacaaaatgatcgttcaatacataacgcatatatttcatcattttcttttgatgtcttgctaaacgtttttgaaaaaaactactcatgtgcctgctcctttgttaaagcaatatagatttcgtccaaagaagaatccggcagctgaaattcttttctcaacatctcaagagaaccgtctgctcgtatctctccgttatgtaagaccacaaaacgatcacaatatttttctgcagtagctaaaatatgcgtagacatcaaaataccggctccttcttttttcatttctaccatcaattcaagcaatgcattgatagctagtggatccaagcctaaaaatggttcgtcgatgatatataaagaaggctcgatcaaaaaggcgcataagatcatcactttctgtttcattccctttgaaaaattagctgggaaccagtcaagacgattagataaccgaaaagtctccaacaacttttctgctcttttcattgctgtatccataggtatatcgtaggccatcgcagtgacttcgatatgttctctcaatgtcaattcttcatataaagaaggagtctctggaatatacccaatttgtttgcgatattcttccgtatttttctttaaggatagatgattgatttctatcgttccttttgaagcttccagcagaccgataatgtgcttgatggtcgtacttttccctgctccgttcagtccaatcaaccctactatctctccaggctgtacatcgaaactgatatcttttaacacagggagatgtccgtacccccctgtgacatgatcgataattaaactcattctttttcctccgccatttatttttatttattataccacgaagaaaatgacggtattttgtttttttccttacaatagctttaacttatggtaaagttaagctgaagtatttattctttatagaaaggatgttttatatggaaaactgtattttttgcaaaatcatcaatcaagaaatcccaagctataaaatatatgaagacgacaaggtctatgcttttttagacatctctcaagcaacgaaaggacacacattagttgtgcctaaacgtcatgtagcagatatttttgaatatgatcccgaacttgcaggagaggttttttcgcgtgtgcctaagattgctcaagcattggaaaaagcttttccagaaatgaaaggtcttaatatcttgaataacaaccgtgaactagcctatcaatctgtttttcattcacatatccatttagtccctcgctacagcaaagaggatgatttttctattcactttggcaatcatcaagatagttatggatcggaagaactaaaagctattcaagaaacaatcgtaaagcaggtgtcctgcgatgattaaaaactttttcaaaggactgttatttggagctgctgctggcactgtcggaggtctgttattggcgcccaggagcgggaatgaaacaagaaagaaactgatcgaagaattggaagaagcaacaactctgacaaatgatttaaataacagcctgaatcattttaaaagcgcattgatcgaaacaaaagaaacagctgaatctgtgatccctactttccaagaagcaatcaaaaaagatatcgaagattttaaattccaagctgaaccacgtatcacacaaatcaatgaacaagtagaaaaactaaaagctgatctgccagagtatcctgaacaaatataataatggttattttctcaacagatttaactatataagtgagaaaagtttgcgtatttcctaggaatgtgatgaaattttgaattttgtttgaaactaccacgacaacgtttttaaaggaaatgggatatggtatagttaatatataaaaataataactaattacaggagtgcaaattttaatgaaaaaaaaatcaattattttggcagctactagtgcgttggctgttttaactctagcagcttgttcaggcgatactaataaagatatcgcaacgatgaaaggcggaacgatcactgtatctgatttctatgatgaagcaaaacttgaatcatcgaaccaatccttagtacaacggatgatcatttataaagtattcaataacaaatatggcgataaagtaaccgataagcaagtggatgcagaatacgacaaacaagcgaaatcattaggtgatacttttgaatcacaattagaagctgctggatatacgaaagatacttataaagaatatattcgtaacaatttagcttttgaagctggcttgaaagctcacgtagatattacagatgacgatttgaaaactgcttggaaatctttccatccagaagtagaagcacaaatcatcaaattatcaagtgaagatgaagcaaaagatgtgaaaaaatcagcggatgatggagatgatttctctaaattagccaaagacaaatcaactgatacagagacaaaagaagatggcggtaaagttaaatttgactcaacgacaacaactattcctgcagaagtaaaagaagcagctttcaaattgaaagacggtgagatctccgatgttattactacaacaaatcctacttcttatgcgacagaatactacgttgtcaaaatggtgaaaaaccaaaataaaggcaatgacatggataaatacaaagatcaactaaaagatatcgctactgaaactaaactaagtgacaatgcattcacaactaaagtaatcggtgaagaattaaaagatgcaaatgtaaaaatcaaagatgatgcctttgaaaacgtgttgagtgcattcactacaacttcatcaagtacgaaagactcaagtgaaactacagcttcaacaaagaattctcacacaaaatcaactgattcaacaaaagaatcttcaactgaagaaacaactgattcatcaaaataaaagaaaacaaaaaaagcgaagacttatgtctcgcttttttgttttgaatgaaaaaaataaatttttgctatagatcttttggtacatagaaacttcggttgtccataccgaaaatccgatcggtgtattttcctggttctgtttgacgaatcgaagtcaacatcatctgcatcgaagcatcgatattgtcgatttgatgtaatatttctgcttccattattcttggacgtacaggtgagccatattctaataagccatggtgtgctaaaaccatatgacgtaatacgagaacatcttcgtcagcttcgctgattttcaacgcaagacaggctttagttatttcttcgtcaatcaataccagatgaccgatcaaatttcctgcaagcgtatattctgtcgacataggaccggaaagttcaatcacctttcctaaatcatgcaaaatgataccagcatacaacaatgctcgattcagctcaggatattcatcggcgattgatttccctaagtgaagcattgtcaaagtatgataagctaatccactggcaaatgcatgatggtttctttttgctgccggaaactcaaaaaattgtttttgatatttattaagtagatagcgaacaatacgattccaatgcgcattggtgatctcaaacaacaattgattgatttcttcttccatttcttctttcttcaaaggggctctttccatgtataaactaggctctcctggctcatctacccttgttaagcgcatatgaagaatctttacttgagggtttccttgataaacctctcttttaccgtttagaaaaacgactgtgccggctgtaaatttattgatttcctcctccgaagcatcccagtatttaccatcgatagtacctgaagtatcttggaaagtaaaagcaataaatttttttccgtttttagcgattcttacatctgcacttttgatcaggacaaattgttcaaactgctcatcgattactaaatcacgaatttttttcattatttgctccttctaattgttttacgatttggttcatctcatggtaatagcttaccatttctttatcagaagaaaaacaaattatttgatacttttctccaaatttagctaaaagttcagctaattgatactttcgctgatgatcataatgaagccagccatcatcaatgatgatcgggcatatcgaacggttagcttctaatgagaggtaagcaaatctcatcgccataatcagctgatctttcgtacctgtagataactcatagatgggaaattctgtatatccgtctgttaaagtcagtgtatcatttttcagtaatatcttctgataatttccttttgttaaaatacctaaataatcacctgctgctcttaacaactggggtaattgtctttcactcatctctgttgaaagatcacctaagaatgtcccggcgatttcaagtgctccccattcctccagtaattcctgtaattttgctttttgccggctagcttgttgataaagttcgtccaatgtgccgtctctttgcaactcttctacttgaagttggagtcgttgccgattttcacttgcttctttttcttcttgctggagttgggattgcttttctttcagttggcgcagtctcacagataatttctcttttgtcagctcttcaggaaatagtggagtaagcatttccgataattcattgtatcttttcatctgctgttcggcttgtttggctttttgtaaaaagacaggtacttccgaaggataagataagcctgcttgagtcaattgttcgctgtattcttgtatccatactttttgtttctttttcagttgattgatttcttgcttcaataaagtattttgctgatagcttctggcaaatttcatctgttccatctcttgtataaaacgggaaagcaataccattttttctgaaattgtcttatcttgtatcggtaaccattctttaacaaactcaaatttttggtcgatttgtcgtagtttttcttgtatttcctgttctcttttatgtttccgctcaaatacgccatataatttctgataatctatgacttcctgtccatattctttcatgagtttgagcgtatccatctttcctaagtgccgatgatccgcaaaacgatatacttcttgccgaagaatctgtttttcttccccagttctcttttgtttttcttctgcttcagctaattgagctaaggctagatcaagttgtcctagtttttcttgccacattccttttatctcagagaaatcatttttagttttaatttttggttgccttttgtagaagaaatagccaatcatgcctgcaccaattagtaaaaggatcactttcaagggcattggtacaaatatacctgcaatgattattgctccgccagccatcagcatatacggtttagatgaagagactggtgctatctctgactgattttgtaataatgctggataggtctcttccaagtcattcacttctgcttcaatcatctcttgctgttctttagctatttggagacgcacagaaatctggctttctagatcagcaatccttctttcttcagccagaagatgcttccattcttcttcatataaaaattcttccggtaacggatttttctgccaatgccacctttgttccaaaatcttcaattctgaatttgtttctctagtctcaatttgtaatctttgccattcttcgtttaattgttccgctgtaaattgaagttgctggagatcttttagttcctgctcctgctctaaataaaaataatatctggctgactgctgatccatcccgctatgcttttccagtgttgcttctaattcttccaaacgctcatttgtttgctgataccgtttggagaaagactccagatctaaaagaagttgctcatcaggaaaacctgtagtgctgttttttttgagagattgccattcttcatataaagaaaaattaagttcttgctgtctggctaatgaaaattgtttgttcgcctcttttaattgtgccaataactgctgctgttgcgactcgtattcctgttcttgttggatcaacttgccaaaataagcttcctgttcttgtttttgatgaattttttcttgcagctctttccattcatttaatttttgattgattagtagtttttggccttttttcttgaataattgttgtgctttctgataatattcttgccgcttttggaatacttgagaactgcccgtgatgcctaaagaaatcagcgcatcatgtagctctttttctctcaaatgatctagttccatcaactgttcctgctggaaagtaaatacttgctggaataactctttcgttaaaggcgcaatcaatttttctagtaactcatcacttcccacttgatcccccagccacaccttcgattttccgcgattttgctgcttgtagcgctcgacagcaaattcaccatatacaggatgtttaagccatattttgccgccataggctgagccgtcttttggtgtataatccttttttttacggccttttgaagggaaaccaaataatattgcttgaataaattgataaatcgttgattttcctgcttcgtttcccccatagatcagctgattgcctgaataaaagtcaaaacttttttgacgccattttccaaaagcagcaatctcgatccttaaaatcttcattcctgatcctcctcaaataaaaaatcttgattaagcagctgcttggctttttcaagtgtttcttcttggtattccggcagttcgctcaatattctagccgcttcttgatgactatatacttcatttaaaatttgttggaaatcttgaggtgtctgatagtattgaaataactgttccatcaatttagcagaagcagcaagtgggatcttcgtataaaaggtatcctctatgagagaaatacgccaaataaagaaatcatttatcctatctgagaattcctctaacaaatagtctaatagctctcctgattgtatccgttccaaaacatctgtattgagatggtcataatcttttaattttatttcgattaaactaaaaccatactctacttttgaaagttgctgacgaatgtgaacaatgacctcttttgtcgttcttgctttcctcaatgatatttcctttgtcttccaatagacctctgctactttaatcggatgtatttggcaacttcctttacttaattcaactagtagaatagatgtagaagcttgttcctttttagtatgaccttgaggcgcacctggataaacaattgtttgcttttcatttaagaccgttggcacatggatatgccctaaagcccaataatcgtatcccttttcttgcatctttgagggttggaaaggagcatagtttcctttttgagagacgccaggttccccgtggtacaacccaatatggtaatctgtgagttctctagaaggaaattccatcactttgtctttttgaatccacggttgacgataactaaatccactgagagagacagtttctccactttttatcgttattttttttgtctctaccgtttcggatgtaaataaatggacatttttaggaaaggagaaccaataccgctctttttgatagaaatcatgatttccgaatattataaatacaggtatatggttcttttctaaccgtttcatctgttctgaaaaatgtttctgtatttttaatgaaggacgattttgatgaaaattatctcctgcaagtaaaacaaaatcaacgttatttattattgcctgttcaatgatatttgataaaacggtcagattcgtcttcaatagtttttcctgtacagttttatcaagagttgtcagtccttcaaatgaccgatccatatgtaaatctgccgcatggataaatttcaccattaaaaatttcctcctttttttcttttatcataccattttcaatagcttttttcattaataaccgaaaatttgttcgtattatgcaaagaaattacgataaatggccggcttcaaaaaatgagtttattcgaaaaaaagattgtgacatgatttttgtcacaatcctaaatatctatgttatattcgcttcgtttgacactgaagaagtactatttgtactggaatttatgctccatttttccgtatttagaattctatgttctatactaccttaattagtttatatggtaagaattctttcaaatgcttgagatactccgtctttatcatttgaaacagtgacataatcagcttttttcatgatttcttgatgactatttcccattgcaaaactaatatctgcactttcaaacatagataagtcatttaaactatctccgatcgcgattctcaaaggtttctttaaattgtagattgattccaaacgatcaaacaccacgcctttagatacattttgaggtacgatttcaatatttacaggtgccgattcagtaacagacacatttagcatctttttcaaatggttaaatatattagctttcaattgacgattaggaataaaaataaaaaatttgtaaatgctgatagcatccttttctataatttcctcaatattattataagggattgaacaaatagatttttcatactcaagctcatagtttagctctttgatagaaaattcactccctacctcgtgaaaaatttttttcattttatttttataattctgagattcataacttccgagatttgtatatattttggttggaaatttcgataggacagaatcaattttttttacatcatttttatcgaaggaagactcaaatatctttttttctccatcaaatccaacagaaccatttaaccctactgctggtatccttaaaccagattttttgagaatattattaatgtcttctacttctcttccagaacaaatgaatggaaaacagtcttccggtaaatgtttcattgttcttgcatttttttgactaatgctctggtcagaattcaaaagagtaccgtctaaatctataccaattagtttcatttcatccatgtctcctatacgttgattataaattcactgcttattgtaagtctaaatttctcacaaaacatatactaattatacctaatttaagtaagtacaaacatcattttaagattaggaaaggacatttatatactattctctgtatttttgatttataaataaatatgaattgaatccaaatcagctatattactattttataataaccaactataaaaaacgaagttaggtgaaaaactaacttcgatattcataaaagactctattagttcaatttagcaaaagatttaaacggagtgtttcccgattcgtttttggctgccgtagcaacttttatatcatatcagagagacaagcgattgtcaactcttttttaaaagtttttttcgatttcgtttttcgaaatctttcagcaactcatttatcataacttatcgttcgttatttgtcaagaacttttttgaagtttttttcgatagaatcaagcttcgcaagtggttcttttttaacgactcagttatcttatcatgtcgttagtaacatgtcaataactattttttaaattttttagaaatgtgatataacatccacttcagaatcaacgctgttaaatttatcatgtatttcttccttggtcaactataaattaagcattactttgtgaaatgatttttcgatcaattattattattcgttatacaaccgttttcaacatattttgaaaataaaatgcactaaaaaactatctttagcagaacatttcattgtattttttggaccaaacaataaaaaaagaagtttgaaaaaaattcaaacttctttgttcgcttaatctgtattttagaagaaaggcactccctctacttcgtaagttccaagaacagagcgcatttgacctggttcttcccaaatatatccttcgcctaattcttctctttgattcttttgttcagtttcaaagacaaacaacggaacattttcctctttaatatgtgtatttgtcaattccatcaaactaatcttgctaacatcgatatgaactatttcttttaagaaattaagtatattcgctaaaccagtctttccttcagaaagttccgctaacgcaaattccaacttgtcatcaattgaatggaccaaaaattttttagtaccatcctccaaatgcaacataattgtaccagcaactcttttgcttgccaaaatttccacctcgatcaacttgttctatggcttacataaaaattctagcacattttcagaaaaaatacactttttatttcttattttctttccgttctagttcagataatgcttcttctatccaaataggtaactgctccgcaatagtggtaaatccgatcttacgatttttattcgtgaaatacctttttctgcgatatggaacagctggatttgttttttctaacgttcttaaagataaactgatttttttggaatattcatcaatgtcgatgatctgaactgttactggctgtccgacttttaacaatgaatggatatttttcgtataaccggattgtacttctgaaacatgaataagtccttgcgtctcgttatcaagagaaacgaatgcgccataaggctgtatccctgtcacttttccttcaattatttgtccaattttataagtcatctacttccctctcttcgcatttatcattatactgtaaatagctcaaaaaaagaagcgacgaaaatgactggaggtcttaagatgatcgaatttgataaacagatttcaagaaaagatacagaaagtgtaaaatgggacgcaattgctgagacatatcaaatggatgacttacttcctttgtgggtagcagatatggacttcttgtctcccggtggggtagctaaagcgtttagttaatacatcaaacatggaatctttggttatgccactctgtctgataaactatatcaggctatcattcattgggaacgccaacaccatgctgtggagttgacgaaagaaaatatcgtttttacaagtggtgtgttaactagtttagctgcagcagtacaaacttttacaaaaccaggcgattctattttgattcatgacccagtttatcctccgttttcctctattatagaaacaaatcaacgtcacatcgttcgaagctctttgctagaaaaaaataatcatttcatcatggacttgtctgacatggagaaaaaaatcgaagaaaacaatgtaaaagcaatgattttatgcaatcctcacaatcctggagggcgtgtttggagcaaagaagaattgaaacagttaagcgaattgtgtttaaaacatcaagtgattctgtttagtgacgagatccatcaagatttaactttattcgatcatacatttacttccatgctaacgattgatcctaatttagatgatctactagttgcttttacttccgcaaccaagactttcaatctagctgcaatcaaaaattcaatggtatttatcaaaaatccagagatgaaagctgattttgaaaaacatttagtgatgaaccaacagcacgaaatcaacacttttggactgattggaacccaagcggcttatgagatgggtggagaatggttaagccaactgattccttatctagaaaaaaatgttcaaacagttaatcagttttttgaacagtatcttccgaaagtgagaataatgaaccctgaaggaacttacttaatgtggttagattttaccgcctatatttcagacgaccaagaattggagaacactcttgttcggaaaggaaaagtcgtattaaatcctggcatcacgtttggtccttccggtcatgggcatatgcgcttgaatattgcttgtccagaagaaactttactggaaggacttaatcgaatcaagtatgctttagagacaatcgattaaatcatttattcaaaataaaaggacgagaccttactaggtttcgtcctttttcataattactccgtaccataccaaactattctgaaatttcaattgtttcaatcactacatcatgtacaggtcggtcttgtggaccacgttgtacatttgcgatttcatctactgtgtccatcccttctagtacatgtccaaagactgtatgtcggaaatctagccaaggagttccgccacctttatacgcttcaatgatttctgatgggaatccagcaccttctagttgtccaagcatattagctggcacatttgtgttatttacaataaagaattggcttccgtttgtgtttggacctgaatttgccatagataaagctccgcgaaggttgaacagttcacgactgaattcatcttcaaaactttcgccataaatactttcgccacccattcctgttccagttggatcgccgccttggatcatgaaatcaggaataacgcggtgaaaaatcacgccatcataataaccttttttggaaagttcaatgaaattttgaaccgtcttcggtgctagttcagggaataattgaacagtaatgtcaccacggtttgttttgataacagcttttggtcctttttcactttttaaatctagttgtgggaatgccatattgtttcctcctaatatttgcatacttcataataataataacataatacctaacctctcgtaaaaatactagatttgttttcttttatttttcatcactagatacattctataacttaccgtttcgatttcgaattcaaacatttttgagaagcattctcaattaaattctgctatagtgtgaaaagggaggaatttttatggaaatctatgacattacaatcatcggtgcaggtcctgtagggatgtttgccgctttttacgcaggaatgcgccaagctaaaacaaaaatcattgacagtctacctcaacttggtggtcaattagcaactttgtatcccgaaaaatatatttacgatattcctgggtatccagcaataaaagcaagtgaattaatcgatcaattagaaaaacaattaactacttttaaccatacattccatttaaaagaagaagttctctcgcttactcgtgaagacgaagttatcgagattactacaaataaaggcatccattattccaaagcagtcattttagctttaggaaatggttcattccagccaagaaaattgaatttagataatgctgaatcatttgaaaaccacggattggattatttcgtgaatgatttgatgaagtatgctggaaaaaaagtcgctattgctggaggtggtgattctgctatcgattgggcgttgatgttagagcctattgcaagcgaagtttacttgattcatcgtcgcccggaatttcgtgcgcacgaacatagtgtatcacgcttgaaatcttcatctgtcaacttgcttactccctatctcatcgatggattatcaggcaataatggggaactgacagatatccggttaaaaaaagtgaaaagtgacgagacgattgatttgatgattgattctctgatcgtcaattatggattctcttctaatttagaacatctttcttcttggggacttgatagtaccagaaatgccattactgtaaaatcagatatgtctacttctattccaggcgtttatgcagctggtgacatctgtacctatgaaggaaaagtgaaactgattgctactgggctcggtgaagcacctactgcagtgaacaatgctttacactatattaatccaaaggaacgaactcagcctggtcacagcacaagcttatacgataaaaatcttcgtcctagttgattttttatatctctttgcatttcaagttaaacccgaaagcagtttcttgcatttttttcatgttccgttaacatgaaatagagaaagaaaaaataaagggggagcaataatatggtcgtcaaaactgagactttagaagaaaaggcaagagaactattgaaggaacgtggcgtaactgtagaagatatcgcacaacttgtcatgtttttacaaaaagactatatttctgatttgactttggcggattgtactgaaagtgtcaacagcgtgctaacaaagcgtgaagtacataacgccattatcactggaatccaattagatatattagcagaaaagaaaaaattgatgagtccgttgcaacatattatcgaagatgacgaaggcctttacggtatcgatgagatcctagccttgtcaatcgtgaatgtttacggtacgatcggctttacgaattacggttatatcgacaaggtgaaacctggtattttaaaagaactaaacagccacgatggcgttcatgtccataccttcttagatgatatcgtcggagcgatcgccgctgctgctgccagtcgattagcacacaaagaaccagaaaaaagaagtcgccttactcaataattcaacaaaaaaagaaagaaaacgtctatttagacgagttctttcttttttgtttgtttcaagctattttttcctaagaaaagaaaaacagcaaaaaataattctaataatacaaaaaataagataaagctatgcatgaaaaattcttctggaagtacattgatgattggatcagtaacgggatcgaataaccagtcatcgttgttgaaaaacgtttcatgaaaaaggataaaaaagcgatcaaatcctaccatcatgaaaaaaccgaaaacaactggcagtaacatgccgatttgaaacggacgaatcaaccgccaaagccgatcattcttttgcaaatatttgataaacaaaatactcgggatcaaagtgatgaaaaacacagcataatccactaaaaacaaaattttcacttcataaaagtgatgggctccgctagcagaaactgggaaatctggcaagctgaggatggttttgaagggattattgagataattcattaggtgatcaaaatttttcagtaatgtctcttgatctaaagaagtataatccaaaatttgcaaatgtccgatatcaaatacgtatagtggtcgaaagttgatcgtcacaccaactgccagactgatcagtgtcagaaataggctgaacaatccagcatattccatccactgccatctcgaatttttcatattagaagctccattcatccagtgattgtttcacataggtagctgggataggcaacccaggtacatcttcttcttttgtaaaacctgataaaacgagcaaagtatctatattattgcgtatcccagcttggatatctgtttcatagttatctccaaccatgattacttcttctttttgcagccctaatacttcaacggctttatccataatgatggcttctggttttccgatgtagatcggcggcgtttgggttgctgtctctacaaaagagatgactgaccctgctccaggaagaaggccgcgttcagtaggtatattcttatctgggttcgttccaatgaaagtagcacctttttgaatagcaagtgttgctttaactactttttcataggtcagataattatctaagcctaccactacatagtcaggagcctcttcttcccatgtaaatccggcagctaaaatcaagtcaatcaatcctgcttctccgataacatagacttttttcccttttccatctgctttcataaaatcgattgttgccaaagtagctgtgtagactgtctctggagctacatgaatgtcaaactcatctgctagacgattagctactgtttctggtgacttagtcgtgttattggtaacaaacaagaaaggtaattttcttttttgcaattcttccacaaatcgtttaccggccggtatgggttgtgtcccacgataaatcgttccgtctaaatcaattaaatatcctttatagtccattcatccactactcttccctttttcttatcgtaaatgctgtttttgttttttctacttgtttaggttgttcttgtttttttactttttcagaggtttttgctgactctgtttttcgatttttaataaccggttttttgcgattagatgcgactggtccttttttctcatcgatatacgcacgattatggttttttttcttttttcggcgctgagttgtcttttcttttttaccgccgattctctcgatgacaaaatacgcacaaccaaaattgcaatattcgtaaagatagtcttccaaggaatcgattcgctgatctggatgcgcccgtcgattatccgcttggaaaaatccttttaggcgtagttgttcataaccccaatctcctacgatataatcatatcgggctagtacatcactgtaacgttctccaagcttttctgcattaaatccttcacgataatcggacacaagccgataatgtctttcacctatcaaaaaattactgtcatctaacagtgtcactagctcgcctttgactttttctgctttaggctcctcaacgatttcttccaaagcagctgtcagttcttcggtgactgttgtttcctgttcagctgatgattttttcttagcaatttctgttttatgctcaacgttctgctgttcattttgttttgcagacatgcgttcaccacctatcttttttattataccttgtttttatttgattgggtagtgagctttcaagtaatctcctaccacacttcggataaattcagggaacaaaaattcattttttccagcaatctcaatcgttggaaaaaatggaacaaacatcaaatgatctacggtagtaaaagtataatttttattcagatcgattggcttgttcttccaaaagacttgatggttaatagaatcatatgtgattccattatagaccatctgcccaaaaatcttaccgcgaaatcccattcccttcataggatagttacgtaaaaagttacgatttttttctatttctaaaactaagcggatcagatcatttccacccaatgtgacatttaacaagtgcatcggatgcggcaacgcagtgtgaagctgatcctgattgacccgcccttttggaatttcagttaaaaacagaccactgtttaatattgctgcttccgtctttcctcgttctttcaccgcctcaagggctacttggataaacgaatgctcattgaagatatctagactcagagaaaatggcaaatctgctacttctttttcttttaataattcatgcccacgttctagataactatttatttcttgttcatcttctgtaaaagctgtcattgtttcggtagggatggctttggctgaatgcttaaggatttttttctcttcatcgatggttaaatggacttcaccgacatactgcccgtactttccagcggctgctatttggacatcattgattacgtgaccttctctgaataaatgatgggtgtgcgatcctaaaataacatcaattgctggtatttcttttgcaatttggaaatcatcctgaatcccgagatgactcatcaaaactaaaacatccacttgtgaacgtaaatcttcgactaattctggcaaaatatcataaggattccgtatgtcccagccattcggattataagtaagcggaaatggagcagtaaatgcaattagtccgattttcgtctggtgtttcgttgtaatgattttatatggtttcgtccatgccggtggctggagcgtatttttatcgaataagttatccaggatgatatcaaactcagcatgatcgtataaatgattcaactcttctttggaatttcctacgccttcattgtttcctatcgtcgctgcatcataaccaacttcattcatcagcaagatattttcctgtccattcgttgcttctgacaatggatgccaacgatccacaaaatcacctagatctactgcaatcgttgtcgttttttctttcttttcgttttctcgtttacgttgatccaaaaaccttctgatccttggccaattttctaaatgagaatgcagatcattcgtatgtaaaatcactattttttccatgtaccctctcgcctctctttatctttatcataccataggcagctttttcttccattgaaacaagctctatttcagagtttttcctgccttgaagcaaattgtataagtacaatattcgataaatcagtctggctaaaaaatcaggaacattcatttttacagtactataaaaataaaaaaaacagacccgaaagtctgttgtcgtttcattataatcagacacatggcggaacctgcttagtgctgcttccttccagacctgacacgcttcacaagcccaccattgtcctagcctttcggcaaagaatagtataccttatttttcattcgttgaccagtctttttttaatttcttttttcgctggcggagctttcggaaaaagtcagtcaaaatcatcccacattcgtcttctaaaatgccaccttctacatatgcttggtggttaaaccgctcgtcctccaaaagattcatcaaggtaccggctgttccgccttttggatcatacgcaccgaaataaacttctgctacacgagacaaaatcatcgcgccgctgcacataggacaaggctctaaggtaacaaaaagtgtggcatcttccaagcgccagcttcccactttttcacaggcttccttgattgcaagcatttctgcatgtgtagtagcatcttgcgtggtttccctaaggttatatcctcttccaaccacttttccatccaatacaaccactgctccaatcggaacttcatgaagcatttctgccttctttgcttctgccaatgcaaggcgcatccatttttctttttctactgcatcaagatttgtatttaccaattacccttccctgcctttgttttttcttgttttactttagcatatgataaaaaggctgtaactaacttttttttctatggtaaaataaatacaagaggtgaacaagatgaaaatggataaattacttgctctttacccacaagcacagaaaaaaaactctccagcatcagaagcggatatcctttcttttgcaattgatgatgcttttatctggatcaaacaagattcattatctcaacaagaaaccagccttttgaaagcgttattccctgtaatcaacgatcaaaaaaaacacccatggtatcaatatctttttaaagatgcttcttgtgttcaagaaaaaagctttcgtttgatccagcttcacgtcgaatcaaaaggagaattcttaaaaaaagaatggcaagatactattttggaattatttcgctattctgctgatttctttttttatacagacacagatgcgctcttagtcgaacaaataaaccgtgattatcttgatgctactgaaatcaacggtatttttctatctttagatgctgattttgatacgacaacgtctgtattcgttggttctttccattcacctggcaccgacctcgtccctttgtttgctgaagaaagaaaaatttttttaacagagcaaaacaatctttatactcacagccgtactttttctatgcaagatgtggctttacattactatacaaaagatactgtaaaagatagtaagttgatcaaaagttacatagaactgatcaaacaaaatgaaatggaagtgatcattcaagaattatggaatgaattaggcaatgtcagctctgctgcaaaaacactgtttcttcatcgtaatactctaaaatatcgaatcgaaaaatttcaagaacagactggtttcaatctaaaaaaagccaacgatttactgttttgctatcttttattgattcatgaacataattaaagatagattaaaggggttgtgacaataattttgtcacaaccccttatttcgaatgaatagtgttcaaaagctagtttctcttacatcattttttcaacaaaatgcattagccggtcttttacatcttcggttgaatctttgatcgaatcaccataaacagagattttcttttttcctgatttgatttttgctaacattcccatcaaagaatccaagtcactatctgaaagaccatctacgatttctagtaatttttcatttccatcaaatttgtcatagacgaatttttttactttcgtccgagtagtcatatgatggatcttttccattacttttcccgatacaacgactgctgtcgctacactggcagcggctgctacgcttaatccgattgttacttttgttgatgttttcataagtatcagctcctttttatctatctccatcatagcatagacaaaaaaataaacgaactaatccactcagtgaaatctcaatcctttagggaaaaagttctttactgttccttttacttgtttcccaaatccgacaggtatcttatctaatactagcaaaacccatccttgattcccatcacgttgaaatgtttctcctgctgtgtaagattgccattccttttgagtgatcggcaagcaaggtatattctctatcttttttgtagcaagcgctaatgcatagctaggttcaaatcgattctttttgaaatctcctaaatgcaaacctgtacgtacgacttttaaaccatcgagagaaggggctaactcaggaacttcccaaagatggtcgttgaacactaaaagtcttccagtagcttcataatgaaaatcatttgaaaactccgtccagagtttttcctgctcttttgtcatttgcactttacttttttttcgtgtcttcttttctttatgcatctgattttgtccatgaaaagtcagctttgcaacaaaatgtccttcaccctgatctttatgaggccatatacgtattgttttttccaaaccagctacgcttccccattcagaacgtcctgaactaacggattgagtcaaaggaatctcctcaatcgttactggataattttctacaagccagctaatgatctcttcattttcttctggtgcaaacgtacaagtcgaataaatcagttgtcctttattttttagcatttttattgctgaagacaaaatctcttgctgacgtttttgacagtatagcggagattcttctgtccactcttttattgcatttggatcttttcggaacattccttctcctgaacaaggagcatcaaccacgatccgatcaaaaaagcccgaaaaatgagggacaagttctgcgggtgcatgatttgtcactattgcgttcgaaactccccatcgttctatattttctgataaaatcttcgcacgtttcggaaagatctcattcgtcactaataaccctttccccttcatttgagcagctaattgggttgatttaccaccgggagccgcacacaaatccaaaactttttcaccgggttttgctgcagcagctgttccaacgatcattgcacttggttcttggctatattcatacccagcttgatggaggaaagactttccattgacagtgccaagaaatccctcattgctgtagggagcgggttgtaattcttcgctatggtaagtttggaccatgtccaatcctgccggttttagtggattccaccgaaatccttttttcacgcttccttgttcaagcgcagaaaaaaaatcggatgcttcttcgcctaaaagaagacgatattttttgataaattgctgtggtaacgttgtcgcttcctccttcattccaatgtttcgttagacattttacaatcttttttacgaaaaataaaggtggctgatctactttttcatgttgctgcctaaggtgactgttcctttaagatattttccaagtattcatccgtcacctcgtttttatcccaaacagcgttcatcatttcaagaaaatcttgagaagaatcatctgagcgcaaacttcccaatgcattaagccataccaattcaagcgacttttcttctttgatcttcgtgtgacctttgacatatgagaaaaatggccgcttaaatagcgaatccatgtctaaatcagattttgcaatgatttcacgaatactttcatggatagaaaaaaaatctttcaataagtagacaatgcttaaaacatcatcggaactgcattcagctaagtagttttcaaaataaacagtgatttcttctaatatcttctcttttaacccgctgattgatttgaaatgtgtataaatcgggtatgtagaacaaccgcagaactctgctaactctcttgcagtaattgacttcattccatattcttccacgtataccatacttttgaacagcaaatattctttactataatttgttactctccccatcattcttacctccgtctcttttcatctacccataaataaataacataaataattctaaaaatattattgataattatcaaaacatatttagttatatccattaaaaatcaattttttcgccttaaaaacaagaatatcttgacaaaataccctaggaaataaacaatagaataaacaaggtaacaaaaaaattaaataacgttatataaaaaagaaggcgacactctgtgagaataacacagactgaaatgactttccactcacagtttttgtctaactatatacaaaaacagaataaaaaggaggtatttatgctaattgaagcaagaaaaaaagagttacttgttctacaaatggtcattcaaaaaaataattgttctttacaagaattatccaatgacttacatattccaaaacggacaatcaaagaactgatccgaaaaataaatgtatcactcaagcaatttttattgattgatgaatttatttattctaatcataaaggagagatccaaaccaaagaaaccgatcaaactaaaaagttagctgttttttctaagttaaaattatgctacctaaaagaatccaatcgttttaactatttgatgttactaatcaattatccacaaactgctgtaccaaaaaaatatttacttgaacaactttatatatcgccctcctatctcgaaaaactgacaaaacagctcaatcattccttaaaaaaattccatttacggatcctatctgtaaaaaattgctgtactcttgaaggaaatgagttatctatccgtctctatctttacttttttctttcagatacatttggaggtaacgattggccattttcctcacttgaattaaatgcactaaaaatgaacagtacagatgagcaaatagaaaaaatttcaaaacaagaaaaaaatatctacttgctgttaactttattcatattacgaaacaaacaacaggcatattttccaaaaacttcttctgaaatcactgaattgatggacttattgcagcatacacatgattattcagaatactttacttctttttcagtgagttgtccttgtgaagagacagaaacagagagagcctactttaattattttttctattgtttttttccaaatcaaatctcttttcgacaaaaacaggagattggtttcttattttccacaagcaaaaaccttatttgtcgacaagtcggtcaattgatgacttacttaactcaacagtttcctctcaaccatttagaaaataaaataccaatttatttttattttcttgtgttggcagttgtttttttcgaactgttgggtgaatccagcagtagtttttctacactttgctttccagaagccacgtccaatcattctagttcttttatacaggaaaagaaattaagagaaaaaatcgatacaattttttcaaaaaatggggaaagaaaccaaatcagtcaataccttagtcaattgatccaacacttactacaaacagaaacgaaagagcagttactcatccatttacagataaccaaacagtttacaggaaattatcatcttcaaagccatttgcaggagttatttcgcaaagatgctgttaaaattaccgcatattcagaacatgctgatttgatcattacagatcagcatgagaaaatttcagatgaaacggagactttctatctggatacaacgcacaatacagtgttatttggcgagttaataaaagcggttcatgaactgtatatgaaaaaaggttatgagaacaaaacaaagaggatgtgacaaaattcttgtcacatcctcttattccaaataaacggtattcaatcagctaactctcggtattagctcagatcaaagcgctgatttcacaacctctttattttaatctcttcggttgccgccgaacaataagatcaagcgcaacagctgcaggaatgtcgaaagtgctgctgcaacataagtcagtgctgctgcaaataatacgtgtcttgccatcggtacttcttcttccgtcagtagtccgccttcactcaaaatttggattgctcgccgagacgcgttaaattcgactggtaatgtcaccaattggaacagtaacgctaaagaaaaagcgaaaatcccgatattgattaacgtagagttccagctaagcaatacacctaccataatcaatgggaacgaaatcatcgaaccaaagttagctgctggaacaagtgctgcacgaatcttcaatgggacataacccgaagcatcttgcaccgcatgtccgcattcatgagctgctacacctatcgcagcaactgaagtagattgtgcagttgcttgagacaaactcaacatcttattacctgaattgtagttatctgtgagatctccggcaatttgttgaacaccgacattatttatctgttgactttgtaatatatattgtgctgcttgtgtaccagtcacattgtttttgcttctcacttgatcgtattttcggaaagtactattgacgtacgctgacgcaattccagaaataactaatccaagaatgaccaaaagaaatgtcggatctaaaaaaccatacattccataaccatacattgtcgtttcactccttttcgtttactttattttatcattagtagtaggaaaagaatgtgaaaagaccttgaatattctttaattctttttcacaaattccgatttcagtttcatcggtccaaatccttctaccttgcaatcgatattatgatcgccttctactaaacggatgttcttgacttttgttccttgtttaatggcacctgacgcaccttttactttcaagtctttaatcactgtcacgctatcgccctctaacagacggtttccatttgcatctaataccactaatccgtcttctatgacagtttcttgttcttctttgttccattcgttcccgcattctgggcaaatcaacaagcctcgatcttcatatgtgtactctgagccacattctgggcaattttgtaatgtcatcttctttctcctttaaaatctttagtgagcactattgtaacggaaaaagaagatcttgaaaagatacatttgtgatttttactacaaaaggcacgttttcgaacgaagtatcattctgtttttctgctcttatacgattggcatatatcttggatctctttatagatttcctctacttctgctaaatcttttgcattcgcaccacttgctaatggatggcctcctccatgatggcgtttagccaattcattgatgatcggccccttagaacgtaaacgtacgcggtaataccctgaaggctgctgaacaaaaatcccccaagccagcacttcgtcaatcactccaggaagtgaaacgatcgaagctgtctctgaatcatcgattccatatttatcaagaatttcttgcggaaggattattcttcctgcaccattttcatccacctggatattttgataaagataaccggaaagtttagcgactttcatcggcatttgttcaatctctctgttcaaagcacttgcatcaaatggataatttctcaatatcgaagcaatctctaatgtacgggacgtcgtggagggatacaaaaagcgccctgtatctccgacgattcctgcataaagtaaccgtgcagccttaacgttcatctttaaagattcaggaaacatcaaagcaaattctgcaatcatctcactacagctacttgcttttgtatttacccacacaagatctccataagggtcatcattgggatgatggtcgattttgatcagtttttctgccaactgatatctttgatcactgattctgggtgaattagctgtatcagtcacgatgactagcgctccttggtagaagacatcttcaacttcttgcatttctgctaaaaagcgaagcccttcaatcgtttcacctacttgacgtatttctttttctgggaaactttcccgtaatagttcggctaatcctacttgtgatcctaatgcatcaggatcagggcgcaaatgcctgtggataatgattttatcgtatttttttattgtatctactatttcttgctgtactgtcatttcactcctgctttctaagaacgttccattacttgacaaacaacgattgctttggaaacgatggtgttttcaataaacacttcgatatccagtttagcggaacgtctgccgatttccaatacacgtggacgaatgtctaattcgctttccaattggatcagccgcaaataatgtaggttcacttgttcaatcaagatatttcgtttttggttcatcaccattgttttttgtgcgacatcagaaatgatttcgctaagtacgccaaaagaaatggttccaacgccattgaccatttgtggtgctactacgaatttgaacttagggttttccaaacgatttccttcacggtcagtatcaatcgtatggatatttccagatatctgatccgaaatcgtatctgcaatctgcggttgtcgctggacaagctgcatcgctttcattacatcttgccgggtaatcaagccttccaatgtcaagtcatcggaaacgaccggcatgacttctagcccatcccagatcatttgatggctaacagaggcaatactcattgttttctttacactgattggttctttcgtcatcacccgatcgatgatctggtttggcgatttccctaaaacatcttttgccgtaacaatccccatcaaacgatgatggcggttgacgactggaaaacgcgaatgctgcgtttcttctgacaaacgctgataatcagaaatcgtatctgtctgctgcaaataatgagtcttttcagctggcatatagatatcactgacaagcatgatatcttttttgatcaattggtcgcttaacgctcggttgatcatggttgcgactgtaaatgtatcataagaggtgcgtaagatcggcatttcaagatcatcagctagctttgcaatctcagcagtcgtattgaatcctcctgtgatcaatactgcggcgccatcttccaatgctaatttttggacttccgcccggttgccgacgatcattagtgatcctggcgtaatatagcgttccatggcatgtttagtcatcgcgccgatgacgaatttattcaagaccttgtctaatcctgccgccccgcctaaaacgtccccttcaatgatcctgacgacctcgccaaatgtcaaacgttcaatatgtttttttaatttgcgttcgatacggatggtccctactcgttgaattgttgaaactagtccgacattttctgcatctttgattgcacggtacgctgttccttcactgacattcaattcttttgcgatgcttcttacagaaattcgattgccaacaggtaaactttcaatatattctaaaatcaaatcatgttttgtcgccattttctgcctacacttccagcgtttccgagacgctcattatttttccttcactatcttccagtaactctacaaaagattcgggatcttgttcaatgacagggaaagtattgtaatggattggaactactttcttggcacgaattgtttgcgcagcctttgctgcatcttctggccccatcgtatagttatcgccaatcggcaagaaagcgacatcaatatcgaattcttctgcaagcaatcctagatcactgaaataagcagtatcccctgcatgataaatcgtttttccttctgcttgaataataattccgctaggctcgcccatatactgaacgataccgtctacttcatagcttgaactatgctgtgcatgtacgaattttaccacgccgaatggaaacgcatgttttccaccgatattcataccgaatgaatctactcctctgctgttcgcataatcagcaatctcaacaatactgataattgtggcttgattttcttttgcaataggaatcatatctcctatgtggtcactatgaccatgagtaatcagcaaccaatctgtctttacttcttctgcagttaagtctgtcaatggatttcctgtaataaacgggtcaatcatcacgcgttggccattttccatttcaattgttaaacaggaatgtccatgatacgtaattttcatattttacacctcgcgttttctctgtatcttttttattaaaaacgatttcatcacttgcacatcaatgaaaaaatatagctgctaaatatattttcattggattgatagtacagtatgtacaaagcaattgtaacagataatacaggatgcaccaagtaccaagcagatataatctcaagtttgaggtctctgctctgcttagcttctcttctcgtcccttaactaattaaatcagcgtaaataggatggacgatcttttctaaatcggctacttttatccgaaggcttctcccgatttcaccgcttgacacaattacttcttctttttcttttaaagaactgtctgctaaaaaacaataatcaggatgtgcgagttttattccaataggggtgtttgctccgtggggatatcctgtatgcattaatacaaaatccattccaggaaaaccaactttacgatctttcgtcacttgtctcgtttttttgtaatctaagtgatcgttcaaaggaatcaatgcgatgatcaccccagttttgtttcctttcactacgagagttttacatatcaaagctggatcaatccctcttttttgtagttcttctgtgaaagattcttctaccacatgactaaaatcaagtggttgatagctgatcttttgttcttctaaataacgttcgacttttgtttgactcatcattgattcactccctttattctatcgtttattataaagcgagggatgctgtattcaaaaattatttgtttttcgcaaaaaaagagcaagacgagcactctatagagaggttcatcttactctttttgtttattttttatttcgacgttgagtagcttccataatgactggcaagatcactgggcggcgttttgtttgttcaaataagtaacggcctaattgatctcggatgtcttgctttaatttgctccactcaaaatcattgctttctaaatgtttctcaacgattgtttcaatcatattgctgctttctttcatcagatcacggctagcttttacgtaaacgaatccccgtgaagtaatttgaggttttgaaatgattttcttttctcgccgactgatagtgacaaccgctacgaaaatcccgtcttctgacaagatttttcgatcacgtaaaacaatgtttccgatatcacctatgcctaatccatcaatcattacattttctgcacttgtagttcctgcaacactcatacgcttgttcttatattccagcacgtctccgcgtccagtaatatagatatttttgtatggcatccctactgcatgagccaaatctgcatgagcagctaattcacgatactctccttgaactggcacaaaatatgttggtttcatcaaattgatcattaattgcaagtcattaggattggcatggccagaaacgcgcatattctcagagatcaacttcactgttccaccagctcgataaatgatatcttccgttttcgccacgatggtttccatcgcgatgcttggcgtagtagtgatataaaccaaatctccttcttcaatcttgacattacggtgtgtaccgtttgccattttttgcagagacttgatgggttcacccattcggccagtttctaaaatgatcagttcttctggattatagtttttcatgtctttcaacgtaacaagcagatcttcacttggtaattgaagtttttctaaacgcatcgctgtgcgaataattcgttcgaaatcttgaccagtcaagacaacttttcgttgtgctttttctgctgcgtccaatacttgttgcactcgttgcaaattacttgctacacaggcgacgatgatgcgtccttcccaatatttgatcgtatcaaatacttcatctgctatttgggcttcagaagctacaggctgaggattctctgcatttgccgattcactcagtaaagctaagactccttctttgccgatttctgccaatcgtgcataatctgtttgatacattgggatagccgtttgatcaaatttaaaatctcccgtataaacgatactaccttcttttgttttcagattgatccccactgaatctggtatcgtgtgagtggtacggaaaaagctcactactgtttcaccaaagtcgatttctgtatgctcatctaccacatggaaatccttaaatcctttggctgcttcgttacgactgacattcaattttgctaactcgatcgtcaactccgttccaaatactggtacagaaattttcgacaacaagtaaggaagcgccccgatcgcatctgcgtgcccatgtgttaaaaagacaccagctacacgatcaatgttttcttctaaatacgtaaaatcagggattacgacgtcgatccccaacaactcattttcaggatattttagcccacaatctaaaataaaaatatcctcgcccacttctgcgacatacatgttttttccattttcacgaacgccgcctaatgggataattttaatggtactcacaaacttcacctcttcttatgacatccaagtttaaagatgtcgattttcttctttatctaaatatatgagccattccaatgaagcatatgcaaaattactatttctcaacttatggagaatcagcaggaaaattaccatcacatccgcgttctgacagttggatgggcattttattttggatatacttctttaacaaaatggatcttttgcgaaacgctatagccagaatacttatataagtattcagctgttccccattattatacaacaaataaactaaatcgctagtatcagcaattgttagaacaactatgcacgtaaaaatccctctgtagcatctaggatttcttttgctattcctctttcatttcttcttcgtcggtttgaaacatacttttttcattttaccacattttttgcaataactatagtgacttttgatatatacagaacctcatgttgatggtgtgcaaacagcataagatttaagctagctttaagataggttatctattatcaaatgcatctactaggagggatgcaaaatatgaattttatgaaacgtgcatggaaaagtacaaaagtaaaatggggacgttcattgttattgtttgccgtgttcacagccattcttatttttgtgctagctggccttacgattcgaagcgctgcagaagaagcagcgaatcaagcacaaaaagaagttggagcaacagtgactttaagtgccaatcgagaagcttcattaaaaaaacaggaacaaacttcttcaagcggttctaccactgaagaacgtccagatccaggcagtttttctcttacaccagtttccttaacggacgcggaaaaaatagctgaattagataatgtaaagagttattcctttgaaagttccgcctcagctatggcaaaagatggaataactgccatcactagttctgattcaagtgaagacagttcagaaactaccgatgcaggcggtgaacctgccggaggaatgggcgggaatccgcaaatgactcaagcagactttcaaatcagtggtgtgtcagcaactgcacaaaatagtaatttttctgatggaacagcaaaaatcacggatggtgaaggaatagatgacagcgacaaaggcacaaacaatgtagtcattgattctactctagcagaaacaaatgacctggcagtcggagatactttcacaatcacgagtactgaagatgaagataccacttatgaaatgacgatcaaaggaatttatgaatccagcgaaacaagcggcagtatgggtatgaaattcaacttcatgaatccgtcgaatacactttacacttcttacacttttgcaaatgaactaaatgggacatctgacgataacacgatagattctgctatttacactctatctgatccagataaaatggatgagtttctcaaagaagctgagaagctgatcgacacagatacatttagcttacaatcaaatgattccatgtatcagtcaatgttggaacctttaaacaacgtggcaagtttttctaaaaatgttgttttactagtggctgtagccggtattatcatacttactctgatcattatgattaccattcgggagcgtcggcatgagttaggcgtcttgctatctttaggagaatccagaagtaaaatcattctccaattgtttaccgaagtggctatttgtatgattcttgcattaggagttgcttcgcttagcggaaacgtcgtcgcgaatgccgtgggacagcagctacttgaccaacagacagaaaccacgacacaaaaccagcaagctcctggcggtggacaaatgccaggtaacagacaagaacaaggcggtcaacgcggtggtcaacaaggaaccccgaataatccatttgctgtttctgatcaagtcagcgaattggaaatcaatgtcaaacctgcacaattgggactattagccggagtagcatttggaatcagtctgttttctgtctttttagcttctatagggatattaagattaaacccaagaaaaatcctattaaactaaaggaggaatttgatgttacggacagaacaattgggattttggtatcaagatccgcaagatgcgctttacaaagatgtaaaactgaatttcgaagctggaaaaatgtacgctattttaggagcaagtggttctggaaaaacgacttttctttcgcttatttctggactagatacaccaaaagaaggaaaggtatactatcaagatcgttcactgaacaaaatcgggttaagaagttatcgtaaaaatgatgtctcgattattttccaagcttacaacttgcttccttatttatcggctctagacaacgtcatagcagcaatggaaatcactaagaccaagcaagagaattatcgacaagttgctttagatcgactggctcgtgtaggaattgatgaaatattagcaaaaaaacaggtgaccaaactttcgggaggtcagcagcagcgagtcgctatcgttcgtgctatctgctgcgaacatcaactaatcgtagcggatgagcctactggaaatctagatgaaacaacttcacaagatatcgtcaaacttttccaagaaatcgcccatgaacaaaatcgctgtattatcatcgtgactcatgagattgaagtagcaaaaagctgtgatgaagtctttgaactaaaaaataaaaaatttcaaaaaatcgaagtttaaaaaacaggataatgatcaaataaaaaatccgaagcatatctgcgagacagatatgcttcggatttctatttgcttgattcaattagtaataagtggtttttattttttttcgtcttttcgagaaaacttgtctttgacttcgtcgcctaaatttcgagctttttctttgatgtcagcacctagtgattgtgcttttccttctgtttctttgctcttgtcgtctgttgctttgccgtatgcttcttttccctcaccgactactttatctttcatatctttagaacgtccttttaaatctgccattgtgcttcctcctcttagtttgtttattgatctaccttcagggtaacatcaacaacagatacagacaaacagaacgctcgttttctaaaaaagatagttagagctgttgattaaaaacttttttcgaaagtcccccatactttgacttctttttcttggaccattatttctcctttagcgataactgtatcaatatcaagcgtttctttatccaagatacacagatctgcatcagcaccaatttcgatttttccttttttatccaatttcaatatacgtgctggattactggttatagctcgtaaggcgatttccaaagggatactttctttttgcacagcttctttgatccctactagcaatgccttggcacttcctactcctaaccctaggaaatgattgttttcatcaaaataaggcaagcttccttgtccatctgaggtcatcgtgaaattatctaaagaaacatcttcctcgatcaatcgtttcagtgctttgctgaagcgaacttcaccatctgtcttctcccaaaaatcaggatcttcgctagcagtgaagtcaatcgtgccaccacgtttggcaaatgccacgcaagcttcaaataattctggtgtgcgatttgcatgagtaggcaaaaattgtgtgatcggaatttctgtttcttctacgattcgtgtcaatagctctagctttctttttcctccgcctaagtggacattgatgatcccagcttttccggataacatgcctcctacacgagcatctgctactgcacgagcgaactcttcaaaacttggctgagaagaacggtgatcggatactgcgatttctccgattccgataattttatcaattgtcaaaaagtctttgatgatagaatctgttactgtttttaccggcaatcggtacgaaccttcgtatacataagtggagattccttctgcttccagacctttcgctttgctgatcaacgcagtcatatctctaccttctccgtctgttcccaaacaaccgacaactgtcgttacaccagctgtagtcaattggctcaatgtgacttctggcgttcgattttgataaccgccttctcctcctccacctaaaatatggaaatgacagtcaatgaaacccggggttagtacttttccctcacctgaaagttcttctacttccactccttcgtagccgccttctagctgttcttctacagccaaaatcttcccaccggcaatcagtacatccatttttcctaagtaatctggtgcaaacacttcaatttgtcgaatgattttcatacatttttcctctttctttaagtataactgatgataggatcttaaaaaataatccaaacgatagaatctttactcctttgattttaccgtaaaatgacggttcttggagtccttatctactgtttggattacttttttatttacaggtctccagtactactgcagacctattgcaatggcaatcatgatgaaaatagttcctaaaacaaacaggaatccttgcatcttgatttggaatcttgcccattttgcccattcgatccgtgcaacacctagcacaccaatcaagctggctgatacgggtgtaaaagcgtccataaaacctgaaccaagctgataagcaagaactgctacttgtctggatacacctactaaatctgccagtggagccatgattggcatagtcaaagctgcttgtcctgaatttgatgtaacaaccaagttgaacaaactttggaagatgtacatcgcccaagcaccaatgacagctggaacaccggtcaacgccgtcccgatcccatgcaaaatcgtattcaaagctgaaggaacagatgcatcagatcctcccaagacaagaagaatccctttggccatacctactacgattgctgtaccagctaaatcagctgcaccagattggaaagaagaagcgatgtcattgactttcattccatctaatttgaaaagaacagcaatgattccagcaactaatcccatcacaaagaattgagaagcgatttctggaatgtaatagcctttttgagtcacgccccaaacgatccagacaaggacaactaacatctctaataagatcaatttatgcccaagcatgaattttttattttcatcagatgtctttttgatatgagaacggaaataatcatctgatttgtaagtcaacgaactttctggttttttacggattttttctgcatatatcatcatataaccagcggctaatgcagtaacaactacccacataatcaatcggaatgtcgcaccagacaacacggggattccagcaatcccttgagccaccgctacgctaaacgggctcatccaagaggtcgcatttccgacttgagatgcgacataagtcacggttactgctacgatcgagtcatatcctaacgcaatgacaaatggaaccatcaccattgaaaatggaattacctcttctgccatcccgaatgtagcgccaccgaatgaaaaagcaaagaataatagcggtaaagctaaacgctccagtcccttagttttactgataaacgcatagatacctgcgtcgatcgctccggtacgcataataataccaaaagcacctccaacaacaaggatcaatgcagcgatccctacagcagatccatacttatctccagatactagtccttcaaaaacaaaatttaagaaaccaaagccgccaaaatcatctgttccccatattttggctgttttatgcaattttttagaagtatcatagatattttcgccgtactgatcgtaaagcacatcatctgtcaaggagatttcatctagtttttcctgcgtaagatttttttctccgtcagcaatgactttttccaatcctttttccggaacatccagtttttcacgttctgctggatgatcttgcagttcttctaattgatcaaacacatacgacttatccagctcgtaagcataacggaaggaatcttgacgtaaaacagtacgagtacttgtttcgccatttgcatctttgtattcaatatcttgcgtgctgaactttcctgctggaacgacaaaagtcagtatccatgcaaagatgactacaccaaaaataatgacatacgtatggggtgtcgataatttagtgaagtcgcgtttcggttttcctgaagaatttgttttcttcaaatttatttcttcctttcttttttcagtaattttgatgaataaaaaatggataatcaaatgaattatacagtaaaaatgacatttccacatgaataatttattagaaaatcacttttttctattttgctttttttctcctatgtatgattatttttttctctttccatttatattaagtattttatttctctgtttttccttaaaattctttttttatttttagattagagaaaatctcgtcctgttttttttattttacaatcattgaaaaattgaatttcattgcaaaaaaataataaacacttataaatatccattatctatccttcaatttttgtgtattttatttctattagaaaaaggtatcctgttggacaattttgttatatcaggtaaacttcattgcaataatgataacaaatgtactataattactttgtaaagagttttggggaagactctttcatcaacgtgtattaagagacaagaaagaatccatatggattctttcttgtctctttttccactactttttatttttctgacactacatattcttataactcatttctcataactgtgaaacaacttataaaaataacaaactttaaacaaaacaagcttaaaatcaaagatgatccatcttaaaataactaaaacaaaaaaagtagtcgttgttaatcctcattaataatcgttttctttttttcaaacgctccatttttatgtggaacattatttttttaaggaactttgtcaacatgtggataactattttccacttgtgtcctggactagctgttttgctgtaaaatacaaaacttgctgcagcaaaaagatcgttgcaagagaggctgttccgcagatcgctggatctagatttggcaaagtcaagactgcatcatgtaaattggcgtggttgtccaaaaccaaatcagcaaattcaaataatcgcaaaccactgctatgttgcgatttgatacttcgtgacaaatcaaatccagtaacaatgattaatggatgaccattttctttgatccactgagctagttcgatgattgccgggtttcttccttcattcgaaagaagaagaaaaatgtcttctgatttgacagaaagctgatcaataattgcctgtcctgcaccttctagcgtttcatagacacctccggctggattttcaatcaatatacttggtacaagatccggggtttgatcccaaaattcaaatgctacaccacttagtgtgcggctagcatatatctgcaatctaccaccttgattaatttgtttcgcgatccaagtgccagcttgaagcatcagcggctcttctatccttaatttctcttccaattggtgataatagtcaaaataacataaactcatttatctctcccgcctagctatacttgacatgaatagaaacagctgcctaatctaaggaagtacataaaaaaacagtagttagacagtaacacatgtggtctttgctatttcaaacacaaaaaaggcattgaacgaatacgcccaataccttgacatagcaaataaaacaacgtgcagaccatggaaaatatctacataggggtagaattttcaccctagattaggtacaataaattaggtcgatgcactgcattgactatggcaaaatgatcggtcagggtgtatgtgtgtgactggtcattccctgattcttagcgccaactaagggtcagggagcctttttttattcagctgtttctatctgaatttattgtaagtaatctcttatccaagtgcaagcacgaaaatacaaaaaaacattggtatgatttatatatatataaataacataaaaaaaggaatggcttatcccgatacaacaagcattcctttaaaaaagattcttttatataagtgaaaaaagcttttttccaccaattaaataaatctctcatctcaatagtttatccattattttatctttttttgcgtatacctactaaatattaccgtcttcttctcgttcttctactttgttcgagagaatctgtactagaaaaagtagttgtatgtctaccttttctgcctatccgagactttcttttcatatatgggatataaatgattagatacagtacagcaaaaaataaagcaaatacgcaagcttcccaactacctaacgccaattcaaccatcaaggtagcaaccccaacggatgctgcataccagataaaaatcagaaacgtttctttttttctgaccatgcgaaacatgataaatagactaataagcaatagtggcaacacaaatatccaattgcttccttccatcagccacttgagtatatcaagcagcgactgtgcaacagcgactaattttcccatagtgaacacacacctttttttataattaaaaaattcgcctttttattctactatgaatcttctggcttggctttcatttctcttatgtaatcattttcttttatacaacttaaaaaaaaattaaaccattagcagaatattttctgaatctattcacgaaagtctttttctatctttcgttttccacgactcaactgatctagagtcaaaaaactaaaacgacagttgcgcaaatgacgcacaagctgccgctttaataacaaatagcctttcattctcagcaggccacttatttccagttaactttctgttcttagctttttactcaactggataatatatgcacttaatgaagtcccaatttccgaatgttgaagtccatattcaatatttgtcttcatatatcctaacttatcgcctacgtcgtatctttttcctttaaactctctcgcatagaccgcctctgtctggttaagagtctgaagtgcatccgttagctgtatctcgtttcctgctcctggttcttgagtttctaatatctcaaatattttaggagtcagtagataacgtccgataatggctaaattacttggtgcttttcccatttcaggtttttctacaaacccttttactctgcaacgacccttttcgctatctgttttaggatcaataattccgtatttagatgtttcattttctggtacacgcatgacggcaacagcggaagcttgtgtttcttcataatccatcatcaattgttgagtcaatgggatatcatctttcatcaaatcatcccccagcatgacgacaaacggttcatttcctataaatgcttttgcttgaagcacggcatcccccagtcctcttggatgagattgacggatgaagtgaagattgacttgagtcgtttcttcaactaaagcgagtaattctgttttttccttttcccgcaaattgttttccaattcgatatttgcatcaaagtgatcttcaatgggtcttttttcttttcccgttacgatcaagatgtcttcgattcccgaatccaatgcttcttccacaataaactggatcgttggtttatccacgattggaagcatttcttttgccatggcttttgttgccggcaaaaaacgtgttcctagcccagcggcaggaatgactgcttttttgaccttcacttgctgttcctcctaaacgacgattaactattgatcatctatttaacgaagagaaaattcattctccatttttccgtcacgtaacatgatttcttttgctgcttttttgatatcttctccattatacaaaacattatagattgtttgagtaattggcatctcaacacctagctgttgagctagctctactgctgcttttgtcgttgccacaccctcaacgaccattcccatgttttctagaacttcttccagcttatgtccctgtcctaacaagttaccggcacgccaattgcgagaatgaacacttgtacaagtaacgatcaagtcccccacaccactcaaaccgataaatgtcagaggattggcacccatcgcgacaccaagacggctgatttctgccaatcctcgagtcatgattgctgcttttgcatcatctccgaatcctaatccatggatagcgccggcaccaattgcaatgatatttttcagtgctgcaccagtttctacgccaatcacatcattatttgtataaatcctgaaataatcattcatgaacagtttttgtacataggctgctgctttttgatcaatacttgcagctgtaattgttgtgatatcatgtactgccacttcctcagcatggctaggaccagataatacaacaattgcctgtcttttttcttctggaatttcttcagccaaaacttctgagattcgtttatgcgtatcttgttctagtcctttacttgcatgtataatgattggcttagtattcattttaccaataagttcctgtgcgactgaacgaatcgcttttgttggaacaacaaataaaatagcatctgcgttatccactgcttctgccaattctttatatccgataatcgattctgggatcgtcaaatcaggtaaaaaatgctgatttgtatgatacttattgatttcatcaatctgttcaggtacatttccccaaatacggacatcatgcccgttttctgccaatgtttgtgctaaagcagtgccccaagatccaggaccaagaactgcgattttttgtttcatggatattcctccaaataaataattgataatttccattatagtatacatttcttaaagttgggactaatttccattgtttttaagtgtttgtttacttcttttatcgtttttacttgaaataatcaatgatatgttacaatagtctacattttatttttacactcgttatgctttgcttgttcctaagaggaagcagttttgacaatgttactaccagcattactattaggaggttaggaaacttctcctagtgagtattgatttaaaatacataagagacagattgaacatttctaaatctgtcaggtcctgcaacggacagattgtctctgttgacggttgacataggaacttttgttttagtcaacattctggatacaaaacgctatgtaaactggcgcaactcgttgtacttggacttttactacggatccatgcaacaactaaatagtactattgcataacaaaaaatggttggcacccacatgtcccattaaacagattataagttgaactgtagataatgcaaaaaatgtgttttataacgtaattgatgccaatattttaaaaaaataaagggagcagttatcgctgctctctttattttttatattctttttatccagtctatcctaataatcaaactgacgatagtagcggcgtatctctaatggatggcagttcaactgctccacatgagcatcgatgcgttgtgtcactacatgcatcaataagaaagacaaaacacgtccgcgatatttttcactgataccttctactggatagtcttttgtgtctatcaatgtataattgctgcaaatttttggcaaaagtttagccacacgttcagataacactctctgttcatcttcgcctaaaaataatgtgactggggttgtttcttctacgatctctaacgtcccgtgaagaaactcggcagcatggatagatttcgatggaagccagctttgttcttcccagtaacacatggcatatgaataaacagctccccattgattccctgctccaataaaataatgcatactatcacgtcgatgtttttctgcaaatgataagccaaatgcatctgcttttttctctgcttccactaacccttttggtaaataacgttcgagctgttcatagtattctgaataagcttcgaattctccattcaaatacatcaatcgatctgctgccataaaaaatttgatttgttctgttccaggagctggataagtgaccacaaaatcgcatagctgagacaacttactgttcgctttatcgataaatccaatcagtgtcgctcctactttcttgatttgttctactgctttcactacttcttgagttgtaccggtaacagaggacaaaataacgatagaatcttttgttaatcttttgtttccagtagtgtaatattctgcagcatgctgtacaaagacaggcaagttgcttttcccattcatataagtgacagcttgcatcgaggaagcatacgttccaccgattcctagataatagacagcgtcaaatttttccgcataaagtttatcgatgatttcttctacttgcggacgtaaagctagtgcgccttttattgctttgatttgttcttcttcattgaatttcagcatgatttccacctcttataatttacttttcaagactgtatcaaagtcttcaaaaatctttttgttcaagtcaatacctttagctactgcggttttataagcgaatagttgaaacggaacgacaagcgctaatacagacagatattcatcacattctattgctaatccaagtgttttctcgtttcttgctttttttgtggtaatggtgagagtctctccaacgtaccgactcatatatctttgcaacttttgcgaacgttccttatttacactttccccttcaataaagaatagcaaatgcgaagcatctgcctccaggtatgggccgtgcatataagcttctaactcaaatccttgtgacggaacgcggattgtttcagtcaatttcgtctctgcttctttagctgttccccagtttggaccatatccaatggtgacgaaacgctgtgctaaacgaaataaactttgatatccatcaaaaaattcttccgttttttgaataatcgctggtaaatggttgattattttgcgcaactgttgcatgtagtcttgttctatttttttgctgattttatttttacttattccaattcctatccctaagagtagtaactgtaaaacagtcgcagaatagccttttgtaacgaagcctactgactctaccccggcacctaaatcaataatttgtgcagcttctaaagcaagtggactttgcacgtcatttgtgatagcaacaacaggtaacccttgtttttgtatcatttttactgcttcaacagtagaagcacttttcccgctttgtgacacagcaatcacagtatcgattgaaggagaaagttttccataatgggaaaaataaaaaggttcttgaatatcgacagtaagatcaccataagattccaatgctggcttcgctgctaaacaagcgttataagatgaacccgttgctaagatcagtaaattcactgttttttccatatgttctcttgtcgaaaaatcattctttttcaagatcgtacttagtacttccttttcttcatagatataatcttgcatcgtaaacattttctctgctccttttttaaaaaatccctatccacgaaccaaaaattccaaagaaagctagtccgatcaagatcgttaatggtttcacttctttcttcaatagataaaacactatgccaaatgctccaagacataagatatttggaacgatatcatcaaaaatactttgaacagtcacagaattttctcctgaaccgatttttaaaggaatattgatggtgatcatcgtggcagtcattgctccaacgaccatcagtccaataatagacgcgcctaatgtcaaactttccatcataccgtttgcctggatctttttcaaaaaacccgttcctaagcgatatccccaacctgttgctagatagcgaaacagaatgtgcggaatattgaaaatcaaaatgaacaagatagggcctaaaatatttccttgcatggctaaagaggtacccacacctgtggcaatcaatcgcaaagttccccaaaagaaagaatctcctaaccctgcaagaggtcccatcaaagatgttttgatactatcgatcgcagtcacatcaaattcaggatcatccttattttcttcctccattgcagccgtgattcctaaaatcagtgtaacgatatgtggggtcgtgttaaaaaactctagatgccgtttcaaagctgctgccatttcttctttcgactgatataactttttcaaaatcggaatcattgcataaacataagccatattcatctgacgttcataattccaagaaaactccatttgaaaagaacgccaaaatacgtgatttagctcttttttcgttattttgctgtttttgatctcagaattcttcatcttcttctacctcccctgcagttgtttgaagtggtagttgacggacattcataatattgactaccacaactgctaaaatcgcgccaaaaatagctactccggtcacaggaatctctaagtaagaagctatagcaaaacctaagaaaaaatatggtgcaacttgtttgttgatcagcaaacgagcaagcatcgcaaaaccaagagctggaatcaaccctgtagctactgacaaccccttttgaacgaagtcaggaatcatatttaatagatttccgatcgtattgcttcccaccatataagaaaccattaccacaacaccaagcatcaaggaaagaccgataccggcaagcaagtgcatatgctcgactcctttataatttccttcttctgcataattgtctgctttatggttcataattggaatcaaaagccctaagtaaatatttttcaatatcaatgtcaacgtagcaatcggcaaacctagtaaaagcgcggtttctgtaccggctccagctgtaatagcaaaagccgtccctaaaatcccaccggtcacaacatcaggtggaatcgaagcacctactgagaacgatccgataaatgctaactctaaagttgcgcccataatgatcccagtttttacatcacctaacacgattcctgtaaacagccccgtcacaatcggacgagaaagcaacgatgtccctagtgcatattctgattgtgcgacaaatgcaacaattcctaataagactgcttgtacaatcattgaggttcttcctttcttacaaaacttctcttacatccacttttttatctgctggtacttgacggatttctacttctatttgtttgtcaattaatcgtttcaagcgttcctcctcttctggtaaaatatttaccgcttttccgatgctgcgagtaccaggttttgccttgatccctcctaagttgatggttttgatttctggatacgcttctgccagcttatatgcatcctcgatcgattccactacgatgaataacttatatttatctgtcaccccgcttttcaacgcggcaatcgagtcatcaattgatttgatcactagtttgactccttgtggcttggctaatttgatcgttgtctttcgtatctcattcgtaggtacatcatcattagcaatcaaaatacagtctgcgcctattgtttgtgtccatgaaaaagctacttgtccgtgtaataaccgatggtcgactcttgtcaatacaatcatttttcttcctcctaaaattcgtcttcttctattttctgattgagccgctcgttacaaaactggatcattttttttgaatcagttagcacctgctggatcaaaacagttgtctctacttcagcgtccaaccgagatactagctcaatcaatagtggcaaattcaatccggcaacgagatagacatgatcctgattgatatattgtaagaattcgttgttgacacttccgccaaaaagatccgtcagaacaatgatttctttatctttgtacctcataaaaagctgccttactgtttccgctaaatcaaaattctcatcagtatagcaatccaatacagtaatagaatgatttttcccatagatcagctctaatgaatctaatatccctgaagcaaattttccatgggaagctaagataatttctctatccactttttcatctcctcttttcacttacacatactaaaaaagcaagttgcatgccaaaattagtggcaacaacttgcttatgttcaaaattcttcttctatcgagagaaactctgtatcttcactcaaaatatcatagatataggcaatctcagaattggggatcatgacactataatgctcttcaatgacactaaacgcagatttaatagcagataacccttctttttgacactgcttccatttctctaatccttgataggtttcgattggcatttgtcggatcaatcgttcaatgagacagctcacatggacatacaacgctaattttttgggattgctgatgcttcgattcaactgcacctctaattctctcataaaatgatcgatttctcccatcaccttctctgtatctagaatagtcacggaatccagtactttttccaatgaaaaattacgaatgatgcgctgattgaatatttccttctctgaagcattcatagtagtgtccaaccattcagctagtacagacatcttttcccccgagatgaggtcttctaatgaaagatagtcgatattggtgatatcaggatctgtggtgccaatcattcctacgacttcgtatatggaaaataatgggtcactgtttttcttatcttttaattgctgatattcatatgggatgattttcaactgacaagccgtaggtaagcttttttctagcagttcacttaagtggaccgccgtaccgattccagtgaagcaagtagtaatgagtgctttgggtttgttttcctctggatagagcagtcgccattctggctggatctgtcgaacagtctcttctgctatctcttctaatgatacatttttttgcaggcattcccctactgtgattgctaaaggtgtcgtcacattattcaaaatcaaaagcggtacggataactgttttttaaaaaactgatggatttctttcagagatcccatgtctactaatatgatcaatccatttgaaacatcgctgttttcgcaataatcaaggatttctgaagcaatctgctgtggtgtgacatctagtggcatatcaaatgattcaaatagatcctcttgtaataaacgatttactacatttgccatactgctagcagttgcataaccgtgagcagcaatcatcgcttttggcagtcgtttttcttttgaccatttcgctttttttagatagatcgtcagtaaaatccgatccatacttgtgtcttcaatatctaatttgatcttacttaattccagaattcgttggacatagtgataactagatggataagactgagaaacttgttgttctaattctttgattagttggataatatcatgttcttccggtaaccatttgatagtgcttcgctgatagagatagtaactcaaggcatagacactgtttccatcgaatttgatttgataggcagtttccatttgtcgaaaggtctctcggatagattgtgtccaataaaccagcagctcgtgtttttcttgtctactggtctcaaacagcaaaaaatcaaataattgaatcacttcttgctttaattttccttcgcaagaatatagcagacagttatttttcttgaaatcaattaggatttgctcaaaacttttaacgattcgctgctgttcgggctgttgcttctccattaattgctctaaggtctggtcttgcgtaatatagattccttgctgtgctgtatttttagtaataggctgcgcaagtagttctttttgcaaatgatggatcgtgacatggatttcaggctgttcacgctgttcagcatatgcttttgctgctgaaactttgacgatatttttcagctctcctatgtttccggataatttctgacttgttaaaagtgacaaagctggtccactgactgacaaagggctccccatttttctttgttcttcgagaaaaaaagagtaaatcagttctagccgttcattacgactacgctgattaagtgcaggtagttcgattcggataggtattcttcgaatgaaagttgttaagaaatgactagtaatctcttcagtcgtagcaaaaaagagacgtgttttgatccggcgtgacaaattaggttctcccatacgataaatcacaccttgatcaagataggtgaacagtttttcctgaccttctggtgttaagcgatgtacctcgtctaaaaacaagatcccaccatctgctgcttcaaaagccccttttttattttcttctgcaccagtgtacgctcccttaacatgtccaaacaaattgctagtcaaaagttcaggattatctgcatattgtgcacaattaaaagtgatgaatggtgcagaatcttctagcagatcatgaagcagacaatactgatagaccaaattaactaaataacttttacctgtgccactttcgcctgtaatcaaaagtggtaatccgccatctggatagtaaagagctgttttgatttgttcgatactttctttcaaactggcgtcgtatccgatcataaaagagaataagtcttttggttgcgcgaaaaaaggctgttcctctttgagatcatcgatagaaaaataaaaattcgtgcgtaacttaaaaaattgtttttcaaaagcttctttgtggaaataaatcactggtcgagaattgattttgactagtagttgctcatcatttaactggttcaaataatgactgactgtgtttctttttaccccaaaatgatcagctaacctttgtgctgtaaagacctcgttcatatgttctaaatcgaaaaaggctgtctggttctctaagtaacataaaatttccttcttcaacaacttattcacccctcctccatcatagaaaacggattcattttgtcaataaaatctttaataaagaattgaaaaatatatcttattatagacagcagcctacttatcccttataatttttattctaaaaaacgtacagttccttccagtttttatactggaatttcaacatatgaaagaataaggaggctatgactattcaatgaaatcggataaatataaaaacaggaaacatacttcctggaaaacttttcgagaaatcatcggatcttatctcgctgtagttgtatttttgcctttgctttatatggctatgacagaacaaactcgttttattggcgtagatacgcaatatatagccgaaacaggatttttattcatctttatcttgatttttgcgttctataaatccttccatacaaaataagattcacagatttcaactttcctgtctgtttttagctattacaaatccttatatgtggtataacaacaatttattggcataatgaggaaaaacgagttatgatgctttcagagagtaaagaggtactgttgtcaccatcctttttattgattacgtacaccactcttagttttttcccattgattacgaaaacaaggtagaaacattgatgttcctaccttgttttctttttttattttcagatcaaaatctcaagtagcttttgacttgatgtcgggaggttgtcttcgttccatcaaacctgatagaatctgcgccaaaccatagttttctccactattatttattcctctaagatagtacccacaataaacgaataaatatttttctcattttcatactccttctttgaaaatcaattagatttctctcaacccacttttttacaaaaattacgtagcaaaaaagattgcaagaacaaattaaaaaagaagtaaatagagtttcatctataaacatttacttgatatattttttatgcagaattcatttatagaaaaattaagtaaaatagacgttcctatgaatgaagagactggcatgttttctcattttcttttttttaaaaaaaatagtctattcaatttctaaagcttcttcataataaaactttcatttatgaaaaggcttgttctcttttcattctaaatttcctaagctacaatgtggtagtacttgttttttcaattgtggacaaataaataataggaggaatcatatgattcagttattacgttatgcaaaagactatcgtaagcaaatcattttgggcccgttcttcaaatttcttgaagctgtcttcgaacttgtcctgcctttaatgatggcttccttgatcgataatggactaaaaatgaatgaccgaggaaaaatcattgaaatgggcttatggatggtcgctatgtctgtgattggtctgatttgtgctatcatttgccaatactatgcttcagtagcttcacaaggatttggtacagagttacgtaatcagctaatcaaaaaaatcaatactttctctcacaacgagttgaatcattttggaacagataccttgatcacccgaatgacaaacgacatcaatcagcttcagctagctttagcaatggtcattcgtttattgatcagagcaccgtttttaagtatcgggtcagtggtcatggcttttgtgatcgactgggaagtaggtctgtttttcttagcattattgcctattttctcaatcattttattttttatcatcaaaaaaaccgttcctctctaccaaaaagtgcaagaaaaactagatcagctcaatgaacacgttagtcagaatcttagcggtgttcgtgtcatccgcgcatttgcgcagacaaaaaaagaaacagagaagttcgataaaagcacaaatgatctagcgaacaattatttacgtgtttccaatatctctgccctattatcacctgctacaaccttgatcatgaatgtcgggatcatctgtttgctgacagttggcgggatcaaagtaaatattggtagcttgcaacaaggacaagttcttgctttgatcaattatatgaatcaaatgcttttggcactgatcgttgtttcaaacctcgtcgtgatcttcacacgtgccgaagcttcaggaaatcgggtgaaagaggtgctagacacagaaaattcgattcttgaagctgaggtcagtactactcccgatttttcttctgaagcaattatcgcttttgaccatgttgacttccgttatactcctgattctggtctttctctccaaaatattacatttcagctgaagcgaaatacagtccttggaatcattggtccaaccggaagcgggaaaacgactttgacacaattgattccgcgtttctatgatgtcagttccggtacagttataatgaacggaatggatgttcgttcttggcagctggatcatctccgtcagcaaattgctcttgttccccaaacttctgtactatttaccgggactattcgtgaaaaccttcaatggggtaagaaagacgccacagaaaaagaatgttgggaagctctgaaaatcgctcaggcagaagaatttgtccgtcagcttccaaatggtttagatacaaaagtcatggaaaatgggaaaaatttctctggcggacaaaaacagcgactgacgattgcaagagctttgattgccaagccagcattactgattttagatgactctttaagtgcgttggattatcaaacagacttggatttgcgtaaggcgctacagacttatcttggcagtacagtgattattatctctcaacgtgtccgctctattcaagaagcacatcatatcttagtgatggatcaaggtaagattgctgctcagggtacccatgaagaattacttgctcaatcagcagaatatcaggaaatcgtcgcatcacaggaggaagaatagttatgaaagtaaaaaaattatccttgcagacgctccgccgattcattccttaccttactgcctatgcaaaagacatttggctagctgtgatactaggaatcatcaatgggattgcaacagttgtgatgacgttacaaattggtcaaagtatcgatcaaatgattggagaaggacaggtccgcttcaatcgactgttccatttacttattctattcggtggtatcgttttaatcaacgtagtcagtcaatggctcatccaagtgttaagcaatcggttagcttacttatccgttgcaaaattaagaaaagatgcatttgctcatctgaatcgattgccacttcgttattatgatcaaaactcccacggaaatatcgtcagtcgatttacaaatgatatggacaatatttccattgcaatttctgcggccttcaatcaattattttctggagtggcaatcatcattctttcgtttatttttatgatgcgtctaagtccacttctgacattggtcgttctttgttctacaccaattattttccttgtgagttggatcgttgctcgtgcttcacaaacaaatttcgatagacagcaaaggattattggggatatctcgggctttgtgaccgaacgaatcggtaaccagaaaatcgtgaaagcttttcagcaagaagaagctagtcaacagcaatttgaactgctaaatgctgatctatatgaaaaaggacaacgggcacaattttcttcttccttgacaaacccgtcttctcgttttgtagatcaccttgcttatttatcgattggtttagttggcggcctattggcattgaagagtggttcgtcaatcactgttggtgtgatttccagctttacgatctactcaagtcagttttctaaaccatttatcgaactttctggaatcacgacacaactgcaaaccgctttttctggtctagaacgagcatttgatttgatcgatcagccagaagaaaagcctgatttgccagatgcctatgccttggaacccaaaaatatcaaaggaaaagtctcttttgatcatgtttctttttcttatgaccccaaacagcgtttgatcgaagatttcaattttactgcttatccaggtcaaaccattgctatagtaggaaaaacaggagccggaaaatccacacttgttaatttgctgatgcgtttttatgacacaacaaaaggaacaattacagtcgatgaccatgacatccgctctatccaacgtgatacattacgtaaaagttttggaatggtgttacaagatacttggctatttgacagtacattgcgagaaaatcttcgttttgggaatccggaagcaagtgacgcagaaatcaataatgccttaaaagcctcttatatgtatgaatttgtagaacgtttgccggaaaaattagatactaagattggcggtcaagggttaaagatatcagatggacaacgccaactgttgacgattgctcgaacgatgatcagtaatccccctatgttgatcttagatgaagctaccagctcagtcgatacattgacagagaaaaaaatccaacaagccttcttagcaatgatggaaggaaaaaccagttttgtgattgcccatcgcctgtccacaatcaaaaatgcggaccagatattagtgatggatcagggagccattgtcgaaatgggcacccatgatgagctgcttcaaaaagatggttattaccgacgactctatcaagcacaattcacagcacaataaaaacaagcagtcttctgggatgggaagactgcttgttttttatttagcgtggatcgctaaacttcttaaaatttttttgtaaggaatactacgtcctacgtaataaatggcaattgattgaatcggtaaccatattactgtttttaacaggcggggcgcccaaacgacccagctgaacaatggcacatggtacatcaacgcaagccataatggtgtcaaaaataagttgatgatcagcgtgacactgagcgtagccagaatggcatttttccaagtgatctcttttcgatagaaaaagaatccgtagattgctccttcaataaatgcattcaatgtaaatccaataaagaatgcagatttcgagaagagggccattcctactaaatcagctaaaactgcgcctatccctgaccaaaaaggaccaaaaagaatgcccatgatcacttgcggaataaatgtgacactgattttaataaatggggtctcgattgctaccagtcgggacaaagtgaccatcaatgcaatcaataagcccataatagcaatcatacgtgcgtctaaccggtgtttcttcatttttagcatctcctttaagagctgctacatcgtatcatgcagcgaatgcgaaaataaaaccgcgaacattacgtccttcgtccaagaggcaacatcccatcctcttagcacttaacgctttattttctactctgtattatttttgggatcttttcccacagaaactatagcatattttcacatttactgcaaatacgaaaaactaatattattgtttatattatccaatacgttcgtattgtatcgcatattatcagtttgtttagcttttatagctacatataggcgaacattaaacgttatttttccatacgcttatccatcaaaatgaaagtggacgcttgtctatttcatggacgattcttcgaaaatctaggaagccggcttccagtcctcttagtagcacctcagctgttccgatattcgtagctaacggaatctcatagacatcagataaacggataagtgctgttacatctggttcatggggctgtgcagccagcgggtctcgaagaaaaatcaccaaatctaactgatcctccgaaatcatggctccaatttgctgatccccgcctaacggtccggatttaaaccgatggatcggcaagccggttgcttccgtgatcctctgcccagtcgtcccggtagcaaaaagttcatgtttttccaatattgttttatacgctgttgctaatttcaccatcatagttttttttcggtcatgagcgatcaaagcgattttcataagagacactccttttgatattgttaacatacttatttactccagtgtatcagtttttatttcttatggatatttattaaagcttaaaactagcacattgacaaaaaaaagaaaaaattcttgttcaacatgacattgaagccagttaacgctttcatttatactttaaatagttaataaaactaaaaaagaaagtgtggaacgtattatggtagaaatggctctgaaaaacgtatataaaaaatatgacaatgcagaaaattattctgtaactgattttaatctatcaatcaaagaccgtgaatttatcgtttttgttggtccttccggttgtggaaagtcaactactttgcgaatgatcgcgggactggaagatatctctgaaggagaactaaatatcggcggaaaagtcatgaatgacgtggcacctaaagaccgtgatattgccatggttttccaaaactacgcattgtatcctcatatgactgtttttgataatatggcttttggcttgaaattacgtaaatatgataaagcagacatcaaaaaacgtgtggacaatgcagcagagatcttaggtctgacagaatacttgaaacgaaaaccagctgctttatctggtggacaacgccaacgtgtggcattgggacgggcaatcgttcgggatgcaaaagtcttcttaatggatgagccattatcaaatttagatgctaaattacgtgtagccatgcgtgctgagattgccaaacttcaccagcgtcttgaaacaacgaccatctatgttactcacgatcagacagaagcgatgactatggctgaccgaatcgttatcatgaaagacggatttatccaacaaatcggtacaccgaaagaagtttatgatacacccgtcaatatgttcgttgccggctttattggatctcctgccatgaatttctttaatgtgacattgaaaaatggtgttatcacagatggacatgggcttaagcttcgtattcctgaagggaaaaacaaagtattagttgaaaaaggttatgaaggaaaagaagttatcttcggtattcgtccagaagacatccacagtgaacaagtagcccttgaagcttcacctgaagccgtagtgaaatcagaagttgtcgtttccgaattacttggagctgaaacgatgctttacacaaaaactggttctactgagttcatctcaaaagtagatgcaagagatttccataaaccaggcgaaatagtcgatcttgccttcaacatcagcaaaggccacttctttgataaagaaacagaacaagtcatcaaacttccataaattgccccctgttagagctgtgccagaagatgttggtgcagctctttttaggacaaaaaactctcatcttagaggatttattatccattactagatgagagttttttttttgagagatcatgtctaatatgtcgttttcttcgcgtacccttgaatcgactctttccgattttctttttttgctgccgtaaatacggggatatcaaaatatttgctgagtgttcctgctataaaataagcaatattataatcaactaaactgtggatgagcccaccaatccccatcaagatgaatactgtataaaaatatccttgagaataatatgtttcaggcatattaccaataaagtaaaagatgcttactactagcatttctgctaaagaatgaatcacaccgatcacaaaattgaacccttggaaacgccaattagcaaaagtaaactgtccattttttaaaacgatactcggatgcttttgcaagtaccaagccccaatcaacgcaaacacaagatgtgacaatgctcgcaatgcgatgataaccggcgttgttaaaaagaaaccaaatgtcgtacctagcgcaacagccactgcaactcctggtgtaaaaaacatcgcaataaataatggcacatgagacgccaaagtaaaggaagctggtggaatcatgattttaggcatgaccattgggataatgacccccatcccaatcaataaagcagaaatcgttagttttcgaactgaattttttctcattttttctctctcctaatatgtcttgacacataaatgtcgacttagtataactcacttactaataactgtcaagacacatattcttttctaaatccatacaaaatgagtgtgagtatcaagtataagaattttttgatcaagaaacaaaaataggagatgtgacaaaatttgtgtcacatctccttgttcggcataatagtggtcaaaagcttgcatcaagtaataagaccaactaactcaaaaacatgagaagctgttttttgaaattgttccttgtgacttagagttaaacggcaggcccacaacctctttcttaaacggtgttcaatcagctgaacctcggtattagctcaaaaaacggcaaaatatgaggaactattttgccgtttgtttctctaatactcaggtcaaagcgctgatttcacaacctttccactaaacggtgttcaaaagcttgcatctgcggtaataagcccaaacaaacgaaaaacatgaggaactatttttgtttggttgttcttattacttgatgcaggacagctttttcacaacttctgtcacaacctctttttttactgcatattttctgacatcgcattgcttaatgcggcgaattcttgtaatgacaaagtctccccacgacgttttggatcgattccagctgtttccaagctttttgctaaccatgcttttgtctggtcatctttgccatacgaatgctgcaagttattccaaagcgtttttcttctttgctgaaatgccgcttttgtcaatcggaaaaatgctttttcgtctgtcacttcgactgccggtatatctcttcttgtcagtttcaaaatcgctgaatctacatttggctgagggacaaatactgtttttggtacgatgaatgctaaactggcttccatataatattgaacagcaatcgataatgaaccataagctttcgttcctggttcagcagagatacgatcagctacttctttttgcatcatgacgactagttcatccacaaccaaatctgattcaagaaaatgcatcatgatcggtgtcgtaatatagtaaggtaaattcgctacgacttttaacggaagctcctcatgaaatgtttctctaacagctgttgacaaatcggtctttaaaatatcttgatgtacaatagtcacattgtcatagggttgcatcgtatcagccaatacagggatcaaacgatcatcgatctcaaatgctacgacttgttttgcatgcttggctaattgttccgtcaatgcaccgattcctggtccaacttcgatcacgttcgtatgttcatctatttgcgcagtttctacgattttccttaaaatatttggttcagtcagaaaattttgtcctaaactttttttaaatgaaaaaccatgtttcaataaaatctcttttgttctagagggtgtcgcaatttcacgatattcactcatgttgttcctccactattttcattgcttgggcgagttctttcggcgtaatacgaaacatcttcaaacgtttttccaattgtttgccgttcgtgtaaccgatgcgcaactcgtcacctagtttttctcgtttttcttttgcttgtgccccagctattaaaccatagtctaaaaggtcttgtctagtgatttcagaaacagccgtttgggaaatgtctggcgtcacgacctttttcaatgcttctaaaatagcagcatcacttgcatgctcgacaccaaggcttccctttttctttggtttagcttgtgtgcgcggcaaaaaagcatgttttgcctgaggaacagcttccataatgatttttcttattttttctcctgaaaaatcaggatcggtaaaaacgatcactccacgagtctcttgggcatgttcaatttgcatcaggatctcttcattgattgcagaccctattgtttctatcgtatctgcatcaactacttcccgcagccttcttgtatcgtcttttccttcaacgactataatctcttggatcttcaacttatccatgttcgcttagaccaaataatcggtgcgcatttgtccatgtttgggcagccacttcttctgtcggaagattccgaagttcagcaatcttttctactgtataacgagtatagcctggttcatttcgctttcctctaaaaggaactggtgccagataaggggcatctgtttccacaagtaatcgttcgattggtacatttgctgcagcctcttggacgtctaatgcttttttgaaagtgacgacaccgctaaatgaaatatgcatccctaagtcaagaaatcgttttgcccattcataatcaccactgaaactatgcatgattccaccgatatctcgaacatcttcttcttttaggatttgatacgtgtcttcaagtgcttctctagtatgaatactgattggtaggttcatttcttttgcgatagcaatctgtctgcgaaatactttatcttggacttctttcgggtcttccatccaatgataatccaagccaatttcccctaatgctacaacctttggtaaagtcaattgttcttgtaatttattttcgatttctttcgtataactgccagcctctgtcggatgccagccgataatactgtatatatttggatagtcatggcttaattgcaaagacttttcaatcgttggcgtatcgaagcccacgaccgccattttcgttacccccatttcttgtgctcgctgaatcgtttctggaatatcttcattgaactgttcagcatttaaatgggtatgagaatcaaatatcatgtttatctctccttttcattcttactttagcacataagcactacttgcagaagtagcaaaaatcagaatagaagaacttgttttattgaaatagaaaaagcacgaagatctagaggacctagttcgtactttttctgtctgttgttgaaatattttactcttctgagcgttttttctttttttgataatagactgggatacctatcaaggtaacacctataccgatcaatgctaatttcgtttgcgtcatcatcgtcatacctaaaatgaaaatagcgccgagaatcgcaataatcggaacgattggataaagtggtactttatatggacgtggcaattccggcgctttttttcttaaaataaagacaccgataaaaatcagtaaactgaatagccacatcacaaaaatcaacatgtctgttaaaaagtcgaaagaaccaaggctcatcataatacaagctactgctaactggaaaatcgcaggaacataaggaaccgtaaacttctttgaaagctttgtcagctgtttactgaaaggtagctcgtcttctaaagccatcgcataaggcacacggatcccagttagtgtataaccgttcaatgcaccgtataccgagatcaagatcccaatagtgaccagctttccaccgattcccccaaaaatgacgtctgatgcttcagaagctgcattcaaattaccggcaagatgatcaatcggcaaagttttcaaaaaaacaaaattgatcaatagataaacgactgttacaaaactcaaaccaagaataattgctttaggcaaatctttttccggccgtttcatttcccctgccattgcaccgacacctaaccagccgtcataagcaaacaacgttgctaacaacgcactgctcaatccttcgacaaaagtaacatcttttccagcttcgattggaaataactggacagttccttgtcctggggtcaataatccccatatgacaatcacagcaattggtattaatttaacaatcaacgtcactgattgtacagaagcaccgacttttgtccctaacaaattcaaccctgtcacagaaacagcggtgatcactgcaatcaacaaaagataatcggtagataattgtaataagttcgtcaattgtgtcgcaaagataatcgataatgcagcaatattagcaggaaagtaaatcaagctttgcgcccatcctaataaaaagctgggcaattttccatacgcagcttcaatatattttacagctccaccagtttccgggattgctgtagctaattcagccactgtcaatccagcacagatcgttaagaaaccacccaaaagccaagctagcaatgtcaaacttgtagactgagtactagcagtaacagcagcagttttgaagaagacgcctgcaccgatcacggttcccataacggtagctaatgcgccaaacagattgatttctcgttttagtttgcctttcattcccatcctctttcttctttgaaatttggtataattttcagtataactgagaatattttaatttaccattcttttttctccactttcagtgaaaaactccctcttaagacggatgtatttcttttttatttttcgtatactaaacctaccttttccacgaaggaggaacagtttatggattttaagcgttcttatccgaaattagcagattatttatccaaccgggtcgatttttcccgtaaagaacaacagcagtcccgttggcattggttcacattaattttatttggattaatgactgttgcaacgttatcacaaaaactaatattgctgactttgttcatcgcaatcgttgcattgatcaaaggtcctgtgatgatcttgtgggggatgttgtattcctttttggttgggctttttccgcctatcggtattttgctttcagcgattttctttttattgaatatcggaacatttacaaagaactggcggatgaccttagtcgggatctatttttatttctatccttttggagtgatggcacttagtgaagtcatgcattgggataatcattggtttatagctggctccttgcttttagggttgatcttgttacacgtgatgttgacaaagctctatcaacattatggtatcggacgtacgattttctggtatgtcttttcgatcccatttgcactgcttactgctctcttaccaagccgtttgaagacaaaaataaaaggttaccataaaatcaagtgataggatttttacaaaataaagaaaacaatcatcgaagtcaaaaccgatgattgtttttttatctatattttcaatcacacatataagagcacaaactaattgaacataaagtgatagaacttagaattaacacatcaacgctactgttagatataaatatagatgtaacaaagtcattgcattcaaactttatgaatgtaaggacaataaaaaagagtaccagatgaatcaattaaaatctgtccgaccctttatcattatgctttttttctgtttttacgattcctattagtattattctaaattaacaaaaatcagcgaagctcgtacttctttttctaggatttattttggatagttctctgtttttgtattatatgattggcttcaagtaataagaaggaatttacgaaaattgcttctcaaatttcggaaaaagggggtatgacacaactagtgtcatactccctttgaatttctatgcgatttctgagccatttggcatggattttggtgcttcgattacttgtaaagagccatctggtgcttctgcagaaaggatcattccttgactgatttgtccacgcatctttcgtggtttcagatttgctacaatgacgacttttttcccgatcaattcgcttggatcaggatagaattcagcgattcctgacaagatttgacggtcttggctgtctccagcatctagtcggaattgcagcaacttatctgccccttctactttttgacagttgatgacttctgctacttttagttctactttttcaaatacatcaaatttgatttgtttttctttcgttgaaacaagctctgtttcttctggatcccatttgactgtatcttcgtttgtttgagtaccttcagacattttttcttgaataaaagcaacttcttcttccatatctaaacgtgggaagattggtgtaccttttgcaactacttttgttcctgaaggaaattcgccaaagtgtaatccttcaagattcattgtttcagagtccaatcctagttgattgaagatcttctctggcgtttctgtcatgattggctgaagtaatatcgctgcgatacgcaaagattcagctaaatggatcatgacactattcaattcagctttcttttcttcgtcttttgctaatacccatggttctgtttcatcaatgtatttatttgcacgagaaatcagcacccagatttcagccaacgctgtattgaattccattttttccattgcatcatggtaacgtccgacaacgttagcagccgtcgtagacagttcactgtcaaatggagtgacaagtgaggcatagtcaggaacgagtccatcacaatatttgttgatcatagcaatcgtacgattcagtaagttccctagatcatttgccagatcataattgacacgagaaacaaaatcttctggcgtaaagacaccatctgacccaaatggaacagcacgaagcaaataataacggagtgcatctaaaccataacgttccacaagcatttcaggataaacgacatttccttttgatttagacatttttccgtctttcatcaatagccagccatgcccaaatacttttttaggtagaggcaaatcaagggccatcagcatgattggccaatagatcgtatgaaagcgaacgatttctttaccgaccatctgaacatctgcaggccagtatttttcgaatagactttcatcttcggagccatatcctagtgcagtaatataattggataatgcatcgatccatacatacaccacatgtttcggatcactcttgactggtactccccaagtaaaagttgttcgtgaaactgcaagatcttctaatcctggtttgataaagttgttgatcatttcgtttttacgagattctggctggatgaattcgggatgttcttcatagtattccaacagacggtctgcgtatttgctcatgcggaagaagtatgattcttcttttaccaattctacttcgtgtccacttggcgctttaccaccgatcacgttaccttcgtcatctttgtacacttctgcaagttgtgtttctgtaaagaattcttcgtcagaaacagagtaccagccttcatattcacctaagtaaatatctccctgttctaataaacgatcaaatattttttgaacagctgctttatggtaatcatctgtcgtgcgaatgaatttatcataactgatatcaagcgttttccataatttcttgacatcagccgccattttatctacatattcttgcggttttacacctagttcttctgcttttgtttcgattttttgaccatgttcatccactccagtgagataaaacacatcaaagcccatcaaccgtttataacgagcaattgcgtcacatgcaatcgtagtatacgagttgccgatatgaagtttgccgcttggataatagattggcgtagtgatataaaaagtttccttttctgccacggggctcttcctcctttatcgcatgatgcgaattcgtttccttgctagtataccataaaaaaagcatgctgttagctttttttcaaaatgaaaaagtctggataaacgacttctatctatgttcaatctatcctttaaaaggatgaataggttgaataaatgcaggtttttgttttgtttcatatctagtaaaaaacggctttttatttctcctctcacacgtggtataataaagactatctatcttagtaagggactggaacaatcatgcagaagaaacatcttttttttacacttagtattgcttttctttcattagcacatttaatattcagctatttttatattcgtatttatggttattttaacctccatgggcatttgaacagttttatgacagcagcttggattttgcgttttatcattgacgtatatatcgttatttgtggcttctttgccattcgtgaagagcggtataaagtattgccgttttatctgcttttctttttattcaatctcatacttccatttatttttcatatttaaatgataacctagattttccaagtaaatccttggttttttttcagagtctgctacaataaggtaaaaagtacttttactgtcaatggaggtggtcagatgaaccgttttgcttctaaagaagaagaaaaattatattatgaacatgaagctagtgaagaagaatttcttaactggtatcaaaaacaggaacgtccagaatatgacaagccctctttgactgtcgatatcgtactgatgtgctataacaaagaagaagatcagctgaaagttttgttgatccaaagaaaagggcatccttatcgaaattcatgggcattgcctggtggctttgtccaaaaggatgagtcaactggagaaagcgtcttaagagaaacaaaagaagaaactggtgtggttatttcaaaagaaaatattgagcaactgcatacattcagtacgcctaatcgagatccgcgaggctgggtcgtcacagtcagctacttagcctttattggagaagaaccgctaatcgccggagatgatgccaaggaagtacgctggttcacactagaacgtcatagtaacaagatccatttatctagcggagaagtggctatctcgcttgatttagtcactggagagtcttctggcaaagatactttggcttttgaccatagtcaaatcatcttgaaagcattcaaccgtgtagtcaataaaatggaacacgagccgcaagttctacaagttttaggtaaagatttcacgattacggaagctcgaaaagtatttgctaaattcttagggatcgattataaaacgatcgatcattccaattttaagaaagctatgctccaatatttcgatgagatcggtgaacgtcctgtaggaatcggccgtccttcaaaaatctatcagctcaagtcggggcaccatgaataaggttgtgaacaaaagattcagacctaatcattcaagaaagaacgcaaaaacaactctttgtgagttacgttttttgtttcagaattttgatgtattcgtaaactttctgaataaaaaattaacaatagcagaaaaagctcgtacgaactttttctgctattgttttattggtttgtcataattagtgagcttttcttcaaaagaaaaattcctagaaacaaaagtcattaagactttttattaacaaggcgaaccctaacgctcctatcagtttcattcattttttatcccttgataagcgaatgtctgcccatttcttctactacttggctctttcttacggaattgctttcttctgctccgtcggtattgatcaaaagaaattttttattataccattgggacttataacgcaattttgttattaatttatgccagtcatgaatagaaaaatcagcatgtgcttcttcttttggaaaagattctacaaataagtagtcatattgtttgaccaatttcccagataattgttcaagataatcttctcgctggttcttttgtttcagataaagatccattacttttctcttttgtttctgataattgcttgcctgatctaacctgatctttctatggtgagcggagcggactttcacattcaatttccgctgtgcatgttgcagcttttcttctgtctggtgaaattttggtaaagatacttctatgggctgcgatgtttcgatcaatgtttttggatgataggcgatcccaatccatttagctgaagattctttttttattgatgaaacatcacaaagtagtgcgacataaaattcttcattatatcgagcagaaatcgtagcggagcgaatcgatccttcaactggccgatgctgatttatcttgattagttctttttgttttggtaactttaagtagccattttccagatagatcgtacgggtttggttgttggtcgtataagattgccacatactttttttcgttttaagctttgggaagctggcacgtcccttgaaataattgcgaaaagcccgatccaaattaagctgtgcatttgctaaagcaagactgtctacttcttttaagaatgggtattctttttttaatgtagcgggtgtaagcgaaaaattggctactcctgtttgttgccaacttttctgacgctttttcagcaaatggttataggtaaatcgagcacatccaaaagtacgaatcaattgctgtttttgttcttctgtcggatacatacggaatttaaaagcttttagcatctatgtccctcctagttagcaaccagaagagattccttttgtcgttttagtttttttgcgtaatatgggacttcctgctcagttgcatagacaaaatgttctggtgcgatttcacgaagttgacgtacttgtccgtcatctggttcaggttgatatttgattcttctgcgttttctctcatggtctggatctggtagaggaatagcagataacaaactttctgtataaggatgaacaccgtgattatagatttcatcacttgttcccatctctaataacaagccgttatgcattacaccgattcggtcactaatatgtttaaccatcgacaaatcatgtgcaataaatagataggtcaattgatgttctttttggagatcttgcaacaaattgaccacttgggcttggatcgacacatctagtgcagaaattggttcatcacaaatgataaaacgcggttttactgccaatgctcgtgcaataccaatacgctggcgttgcccacctgaaaattcatgaggataacgagtaccgtggcttggattcaatccaacagttctcaatagatcatcgactttttttgcacgctcttcagatgatttagctagtccattaacatcaattccttcggcaatgatatctctgactttcatacgaggattcaacgaagcgtatggatcttgaaagatcatctgaacatcatgccggaatttcgtcaaaccttttttatctttgatcttcgttatatcttgaccgtcgaataatatctcaccatcagtaggttcattcaagcgaatgatcgtacggccagtagtggattttccgcttccagattctccaactaaaccgaatgtttctccttcataaatgtgaaagctgatgtcatttacagcatgtacttcattcttttttcctacattgaaatactgtttcaatcctttaacttcaagtagtttatttggcatcagcaattcctccttgaccgtaggtatgtttttgtttctctttaaagatagcccagcgacgttggatttcttctggcggtgtcactttgggtgcctgcggagcaagtagccaagttgctgccttgtgtgtttttgatagttcaaaaaatggtggttcttgttctgcatcgattttcatcgcgaattcatttcttggatagaatgcgtctccttttggcgggttcaataaatccggtggagaaccaggaatagcatacaatcgatcgttcgcactatctaatgtcggcattgaaccaagcagtccccaagtatagggatgttgcgggttgtagaaaatttcttccgatgttccaacttcaacgattcttcctccatacatgacagcgacacgatcagcgacattcgctactacaccaaggtcatgagtgataaagataattgatgtatcgatttttgtctgaatttctttcagcagctccaaaatctgtgcttgaatagtcacatcaagcgctgttgtaggttcatcagcaatcaggatttccggataacataccagtgcaatcgcgatcacgatccgttgacgctgacctcctgagaactgatgcggataactgttgatacgtttctcagcttcgggtattccaactaatttaagcaattctaatgcagctttttgtccctctttttttgaaactttattatgctttctaagggactcagcgacttgcttcccaatgggcatcgtcggatctaaagaggtcattggatcttggaaaatcatcgctatttctttaccacggattttttgcatctctctttctgattttccaacgatatcgttacctttaaagaggatttgaccagcatctatattggcgttgcttgacagcaagcgcatgatgcttctggtcgtcactgattttccacttccagattccccaacgatcgccaatgtttctcctttattcaaatgaaaattgacaccgcgaatcgctcgtacctttccagcatacgtatcaaaagagatttctaagtctttcacttctaaaattttcgtcatcgtcttcactctttcattttaggatcaaaggcatcacgcaatccatcagcaagtaagttaaagccaatcatgataaccgataaagttactgccggaatccataacagataaggcagatacaggaatgtcttgtacccttcgctcaacattgttcctaatgaagctgacggaggcgtaagacctaaaccgataaagcttaaaaaggcttcgaagaaaatagcagatggaatactaaacatcatttgaataataatgacactagagatattcggcaaaatatgtttgaatgcaattttcattcttgattcacctaatgtcaatccagctaaaacatattcttgatcttttaatttcattgtttgtgcacgaacgatacgtgccattggtatccagtttgtgatggccatagcagccacgattgaaaaaattcctggttcaaaaacgaccaacatcaaaatcatgacaacgaggtttggaattcctgataagatttccaaaaaacgttgcatcacgttatcgacacgtccgcctaacaaaccagaaaccaacccgtaagctacaccaatcgttacatctagtaatgcagcaataaatgcgatcagcaacgagattctcgttcccataaataagcggcttaatacatcacgtcccaaaccgtctgttcctaaaaagaaatttacgtttgaagggacgtttgcttgagcatatttatcaacaagttcaccaccaaccattgcttttccattcaatccatcgatattgattcccggaatacgaggaggcaaattgatataagccacgttttgggcagttggatcatgaggagaaacaaagattgtgatcacagagatcaaaatgatgaccaatagtaaaaccattgaaataacggcagctttgtttttctttaaacggcgccatgaatcttggataaaattcaaagaaggtgcagtaatctgttcacgttcttcttcggtatttttttgtaatggaagaaactcatccgcagggatatctgcgactgtttcataacgctttggtatcatttccatttatcctcggctcccttctgaaacacgaattcttggatcaactagaccgtacaacagatccacgatcaaaataacaaaaatcagcataaatgagtaaaggatcgttacagccatgatcgtaggataatcatttgttgtgattgacttaacgaattgttccccgataccaggaatagcaaagatattttctactaccagtgatccggtcatcaatgctacagctaacggtcctaataaagtcatcaatggaatcaaactatttcgaagaccatgtttaaaggcgatttcccaacggctcaatccttttgcttttgctaattccacataatcactatgcagtacttccaccatttccgtacggataaatcgagcagagtcagcaagcggcgacatggccaacgcaattgttggtaagattgtgtacacaaagccatcccattttgcgattggcaaaacttgtaatttgattgcaaagatatattgtaataaaacagcaaatacaaagtttggaatggaacgacctaatatcgctacgagtgtagaagatgtatctgcccatgtattttgcttcatggcagagatcgttcctaaaatcgttcctaggactgttccaaagataattgcctgtaaccctaactgcaaggatggtccgattcttccagctagcaaatgtgcgactggctggtttttaaattggaaggaaattccaaaatctccttgaatcaaattagaaagataaatcccatattgtacgataactggtttatccaaaccgacttgtttatttagcatctcgattgtttcaggactcaaacgttcctgattcgtatatggcgtgcccggcagcaattgcatcaagaaaaaggtgattgttgcaattaaccaaagcgtgatgatcatgaaaaagacacgttttaatacatatttgatataactattcactaatgtttccccctagcttttgacttctgacagatgtttcgctacattattagataatgaaccaaaaataaaggagcaatcaaatgaaaaaaaaatctatcccctacgcagtagcttttctactgattctggttattttaataaaaaatctcatcaaccattcctttacactcattcaattatctaatgatctattcttatggtcattgccgtttctgattatcggcggttttttatgggtcttttcttcgggtttcttcgatcattttcagcgatcggtccatcttgcacgaacaaggaaccgaaagaaaaaaccagaattttcctcgctctcgtctgccagctacggtatgtacagcttttggctgatcattgccggaatactaattgctctttctgctattttcatgcttttttctttgttaggataagtgaatatgagaacgaggttgcgacatttgccgcagcctcgttttttctcatgctcacggtattaacgattattcttcaacgtatgtccatttgtaatcccatgaagcgcctgccgcatggtgaacgatacctttgattttttcattcactaggtgaccttctgctttttggtacaccggaacgacacccatatcatcagagatgatcttgattgctttttggaaatcatcccaacgggcttgttcatcgccagcgtctgttgatgaagctgctttaactgcttcgtcatattctgcattgctccagcgaccacggttgtatgaattacctgtgacaaacaaatcagtaaagctgcttgggtctgcatagtcagcagcccatccgcctagtactgcgtcaaaatcacccgaagttgagcggtcaagacgtacagagaatggaacaggtgttggtttgactgttacgccatccaagttttcttggattgagttttgaacatattcgattacttttttcgatgaatcatcatcagaagccatcaaatcaaattctaaagaatcaacgcccaattcttttttcgctttttcccaatattcttttgctttatctttgtcataagaaactaattttccagcttcttttgcaaagtcttcgttcgttgttggactttttaccatatctgatgggatcaatcctgtagagacaactgatccgtcacctagtacttgttttactaaagcttcacgatcgatagaataagaaatagcttttcttaggttcacattgttgaatggtgaattcttttcacgttgattgaattcgatatagcttgtccgcgcttctttaacagaagtataagctggatcgtttgcgttttgctgtgctaactcaccagacaagatcacgtcatctgcttggccatctttgaataagttcaatgcagtagaagattcttttactacactgactttgatttcagaaagttttactgtatctttgtcccagtaatggtcatttttcttataagtccattctgtatctgttcctggtccatcaaaatcttctaatgtgaatggtccattataaacagctttatcacttgcagatgcataggcatccccattttcttccactacggattgtttttgtgggaaaaatgatgggaaagcaagcagatattggaaatatggtgtttgtttcgtcaatttgatttctaattcatagtcaccaactgctttgatccctagttctgatttatctttctttccagctgtgatgtcttctgcattttcaactggcgcatacaggtaagcatattcagaagctgtagctgggtctactgttcgttgccagccataaacgtaatccgctgctgtcacaggatcaccatttgaccattttgcgtcttctcgtaatttgattttgtaagttaatccgtcttcactgacttctgccaactcgctagctcctgccggctgtggtttgctgtcttcatcaagacggtaaattccttcataaacgttattcaatgctgtaaaactgattgtatctgttgcaactgataagtcagctgtaggcatttcttgaggcacgactaagttaaatacgcctcctccatctgctgaaccgctttttgctgaactactgttgcttgtggctgaactgccgccataacatccagcaagtacaaggccgcataccgcaaccaaaccaaatgtaaatttctttttcattttacgtacccctttattggaattttcagaataattaatattttctgaagttgtttaagagtttaatgaataattattaaaaaatcaacacttttttttgtctttttcataaaataatgattttttcgtgaggtttcaaggaatttttcagaaaaaatagctttgtacaaggttttccatggtcttccaaaagccattaaataattttcgttatattgtctattattgccatacaaagataaaaaagaataaacaaaaagaaactgtgacaaaagtcttgtcacagtcccatatctgaataaacggtgttcaaaagcttgcatctgcggtaataagcccaaccaaacgaaaaatatgaggagctatttttgtttggctgttcttattacttgatgcaggacagctttttcacaacctctggtacacggtgttccaaaagtagcttcttcggaaataagttggaatttcacaaaaattcaagaagtaattttcgtaaattccttcttatttcttgaagctgattacttctgtcacaacctctttttattattgagaatctggtcgaggaataatcgtttttgccatccaaatatccggtttgtcccagccatttgcatttggtaagacacctacgattttataacctaatttttcatagaattcatacggatgttcacgaaggttctggatggaagccactttatcaaatgtatgctcatacaggtccgtttgacttaacgttgttccatggtctaaatcatccgtacctaaataaatcgtgattcctcctctggaagctacttctttttctaagtaattgactaatcgagtacctatttggttctttcgtcgggagctttctacaactaatggatgcaattcccaacctgtgataccgtattgagggattgcaccaataaatcctactaactcatcttggtctaccgctgctaccgcgattcgttctggattcatcatttcttctacttcttctgccgagctgtctccatattcttccggccaagtcagtctcagtaaatcagaaagctgatctttcaatactggattattacggtcaaattcactgattatcatacgtcttcccccttgttcttgcttattctaacagtccttttgaaaaaacgaaatgttctcgctcaaaaatctttagctaccaatcagtatctctattctttcattatttatcttacttataaaataaaaaaattatacagaaacactttattcaaaataggaaagatcaggaaagccatcaattggaggaaaaaactctgtttgttcatcatgatatagattatcttttgctttaaaaaaaaccaattatgaattgacaaataaaacctgttttcatataataatcttaatttttagaatttttagataattacaaaaaagtaaagggaatcggtagaaatactaagaggaacaaaaattcattattgtcgttttcaatgtttttgtacttgttcgtttttaggatacttattgatgatttcaaggtgttcatgccaccttattcatcacttatcctgtcttaggttcacctctactccatctacagccgcagtcagatcgatcactctttaaaattttaacccgtttcaacgaagaaagaaggaaatgaatatgagtcaaagtgttttcttaccaaattataccattggaacagatgcgtatgaaaaagcaaatggaatcgtcaaagaatatgggacaaaagtagtgctgattggagggaagactgcactttcaaaggcagaaaacaaaataaaagcagctttgacacaggaaatagaggttgtcgccagtctctggtacgggggtaattcaacttatggaaatattgaacagttgatccagcatgaaagtgtccaaaaagcagacgtcctgtttgcagtcggtggtggccgtgcttgcgatactgtaaaagtcattggtgaaaaactagctaaaccagtcttcacctttcccactattggttcgaactgttcgcccgtcactgcggtatgtgtcatctataacgaagaaggcgtaatggacggactcttctttccttcaaaaccacctgtacacaccttcattgatacagcaattattgccgaagcacctgataaatacttatgggcaggtattggcgatgctttatccaaagaagtcgaatctactttttctgctcgtggcgatgatctaggctacacggatagattaggaatccaaatcggaaaaatgtgcattgatcgtctcttgacttatggtacgcaagcattgaaagatagtgccgacgatcgtccctcatatgcaattgaacaagtcgtttcggatatcattgttactaccggattggtttctgttttagttaacaataactataattctgctatggcacactcattctattacggtacgactgttctagaaaaaatggagggataccttcacggagcatctgtcagttatggtgtactgaccttattgatgatggatcagcagttcgatttgtttgataaaatctatgtgtttatgaaaaagaaccaacttccagtatcgttaaccgacatgaatctcaatgtcacgaccgatttagaagcaatcttagataaagccatggcaacaaatgatattaaacatgtgccttatgaaatcacccgagaaaaatttaaacaggccattcttgacgtagaaacttatcatgctacacaagaaagccagcaaggatataagaaaatcagttaaataattgctaaaacccccatcaagcaggctgtcatcaaattgaggacatttctttgcttgatgagggtttttcttgtcaaaaaaagctttatagctttcgctatagaatcttttctcttatttaagttgaacagttccttaattaagaaaactgctccttttatggtaattgaaaaaacgagtaggctacgattatttggcaactgtttttttcatttgcttgcttcgcaattgtccgcaagctgcatcaatatctgtaccatgttctttacgtatcacacagtttacgccgtttttcttcaatacatcataaaatctcaatacatcagcttttggactgcgagaatattgatcatgttcactgactggattatatggaatcaagttgacatatgctaattttttcttatcttttaatagatctgctaattgttgcgcatgctctggtctatcatttacttgattcaacatgatatattcaaacgtgattcgacggtttgttttctctaaatactcatccacagcttccatcaatttctcaattgggaaacttcggttgatccgcatgatcgatgttcgcacctcattattcggcgcgtgcaaggaaatagccagattgacttgcaagccgttattagcgaattccttgattttgtgtgctaatccactagtggaaactgtaatgtgccgagcaccaattgccaatcctttggcatcattgatgatatgcaaaaagtccattacattgtcgtaattatcaaatggctcaccgatccccattacaacgacatgtgaaacgcgttcgccaagattgcgctcatcaaaataatgttggaccatcatgatctgtgcaacaatttctccagcagtcagatcacggttctttttgagcagcccgcttgcacaaaacgtacagccgatattacatcctacttgtgtcgtcacacaaactgacaagccatattcttgtctcatcagtacagtctcgatcatgtttttatcagggagttcaaacaaatattttactgtaccatccgaagcttcttggacgaccatctgttttagaggattgatgataaaatgctccgataatttttcgatcaactgtttcgatagattcgtcatttctgtgaaattacttacacgtttttgatacaaccattcccaaacttgggcagctcggaattttttctcgccgttttctataaaccaattgattaattcttcattcgtcaagccataaatggactgtttttccaaagtattttccctctttttctcaaagtttcgctacatactatacatgattcatttccttaatgcaatacttcacaaataaatcgaatagaactttaatctcacaaaaactaaaaagacaagacatcataccgtattagaaaagatggaaaaaaaccattttttcttttggtatcatcatgccttgtctttttattggttattcgtttttcaacccttcatcacacaagttttacatgtcattatcgtccggcaacgtttctgatgtttcttcctgctcaatgaatactttccgaggcttgcttccttctgacgggccaacaactccatgagcttccagttcatctactaaacgtgctgctcggttgtaaccgatccgaaatcttctttggagaagggaaatacttgccgtttgcatttcaacgacaagtgcttttgcttcttcaaacagctcatcttgtggctgttctggagcacctgtcgtttcaacttcatctgtcggcatcattttctcttcataatgagcttcttgctgatctgtaacaaattgaacgacccgttctacttcgtggtcagaaatgaatgctccttgcacacggatcggtttattctcacccattggcaagaatagcatatctcctcgccctaagagcttttctgccccattagaatcaatgatcgtccgagaatctgtaccgcttgataccgcaaatgccattctggaaggtacatttgctttgatgattcctgtgataacatccacacttggacgttgagtagctaggatcatatgaatccccgccgcccgagccatttgcgctaaacgaataatcgcatcttcaacttcattgctggctaccatcatcaaatcagctaattcatctacgatcactacgatgaatggtaaggttggatgtttcgttccgttttccaagtttttctgttgaacaaattcattgtaaccagaaatatttcttactccggttgccgcgaatttttcatatcgttcttccatttcttgtactactttttgtaaggcttgcgctgcttttctagggttcgtcacgaccggcgtcaacagatgaggtatgccgttgtacatattcaattcaaccattttcggatcgatcatcatcagttttacttcatggggcttagcacgcattaatatacttgtgatgatcccattaattgctactgacttcccactaccagtcgaaccagccacgagtaagtgaggcatcttcgaaagatcagccgtttgtacccgtccagaaacatcacgtcctaaaggtacttctagtaatttatctgggtggtttggttgtgcttcgatgatttctctaaaggaaaccatactgatctttccatttggtacttcaataccaatcaatgatttacctggaatcggtgcttccatccggacatctttcgccgctaaagcaagcgcgatatcatctgttaagttcacaattttacttacttttacccctacagccggctggacttcgaattttgtgacggatggtcctaagctggctttgacgaccttggcatcgacaccgaaactttggaaagtttgttctaatacgccgatatttttttcaatttttttatactcatcactttgatccacagttggtatagaatcaagcaaatcaactgtcggtaattcatagtcttggttttcctgttctgcttcaatctcaaattctaatgaggtaccgtcatcctctggcaactcatctgaaaaaccttctgctgtattggtctgttttggtgtatctggtactggtttctctagattcgcaggatggatattttcttgaaaactgtcgattggaacaaaacttagctgctccggctctgtattttctggttcctgccattcatcagcagtatcttccctttgttggctcaccgcttttttcttctcatattctgcagcttctttttctgcagcttcttttgcagctaagcgccttgcttctttcgcttctgcgcgctgtttcattctctcttcctttgccgcttgctttcgagcttgcttggcaggatcaccttccaataattcctgtactcgttctccaattgattggataccatttaacagctgatagccttccagattactgaacaggaatgctcctcctgccagtaatagcactgctgctaaataacttccaggctgtgcaatcaagaagtaagtaaaatgataaaggattgccccaatcatcccaccaccaacgttattgtctacttgactttgttttatatcactggctaacaaatcccatgtcgtccccatgatatttggttccccagtatggagtttgccaaataaatgggcatgtaacaataataagataccgaaataaaagagtatgccgccaaaccagcgtcggtttttaccaattgaaaactctgtattcttaatgacaatccaaaatcctaatacggctaataaaagacagaggatttggtaagtatttcctgcaatgatccgaaagccgtttgcaatcaatattcctaaaaaacctaattttaaaaagccgaagacagcaaataaaatcaaggcaaacccaacaccaatcgtcagcatttgttcctgctgctgtttttgctttttcgtttttttcgtctttttcctttttttagtaggccgtttcttttgtgccatttattatccctcatttcatcaagtttcattatacaaaaaaaagtaagggaactaaagttttgtttgaaagaactgacgctttctttcatttttcagcttattttacagtttttcttaatttctaaacgattttatcaaaaaaggatacggccatatccagccgtacccacttgttttaagtatgtgaactaaaggttctctccattttcttcaatcagtttttggtaccagtaataactgtctttcttgtatcgttccaaagatccttcttgtgtttcatcttgatcaacatatacaaatccatatcgcttttgataaccgttcagccagctaagcaaatctgtataagaccaggtgcaatagcctaggacttctgctccatccgaaattgcttctttgatggctttgacgtggctttgtaagtaattgattcgatagtcgtcatggatttgtttatcttctgtcaacttgtcatactctcctaagccattttccgtaatcagtaccggcatgcggtaacggcttgtgatacgacgcagtccgatccttaatccttctgggtcaatctcccagtcccaatttgttcgttcgacaaatggattctcaacttttttatacattccaggaactccagtttcttctgatgaacctttttttcctgtcgtattcatttttcctgcaccaactccgtttaatggattgaatgcattcgtcgccgtttgatagtaattgatcccaagaaaatctggtttagcagattctagcaattctgcatcgccagcttcaatcgttggtgcccatcctttttcttctaagaacctcatggcagcaatcggatattttccccacatatagacatccatccaataattggccatcaggtcttctgcattttcagcagccagaacattttcaggattactgtcaattggataatttggcgtatacgcaaagcttggtccgattttcccaggcatttctaactcgtgaaatttattgatgacagatgcatttgctaaattagcaatatggttaacttcatacattcgtttcgggtctgtcacacctggcggatgtgctgctaacaaataacctaatgaagtgaagatattttgttcattcaaactaatccagtaatggactttcccgcggaatgcctcaaataatgtttctgcataatgagtgaaatcttcaatgatctgacgtgattcccaaccattatattcatcttgcaatgcttgtggaagatcccaatgatataaagtcaacataggttcgatatcgttttcaatcaattcgtcgatcaatctctcataaaaagcgagcccagcttgattgacttctcctcgtccattaggaaaaatccgtgtccaagctacagagaagcggtaagctttcagaccttgttctttcattaaagcaatatcttctttataacgatgatagtggtctactgccaaatcaccgttcgttcctttaaatgtctttccaggtatccgtacaaatcgatcccagactgattctcctttcccatcttcttgccaagctccttctacttgatacgctgcagaagcagagccccacagaaaatcttttggaaatgaggtaagttctttgtgttccattcatctcttcctttcctataaccttcaatcgttcctcttttagaataacacgaaaccccttccacaacaaaataaaattatgtaaaggaggttgtgacagaagtggtcagcttcaagaaacaagaagtaatgtacgaaaattgcttctcaaagttttgtaaaatttcggcttatttttcgaagaagctacttctggaacaccgtgtataagaggttgtgaaaaagtcgcttagtttcgagtagtaagaaaaattttgtgaaaatggctttctacatttttgcataaatttggcttaataccgagaaactggcttttgaacaccgtttaccaagaggttgtgagcctgccattcagctccgagtcacaaggagttggcaggagaacactgtttattcggaaaaagggactgtgacacgtcttttgtcacagtcccctatttgttaatttctcggcgtaacatcttcgccaaaccatttatcggatattttttggaattcacctgttttctctagttgatctagggcttcattgatttttttcactaatgtactatctgacttgcgtgcaccaactgcaaaatcctcactttcatatgaaccttttgttatgttgaagtcttctagttcgtttctttgtttcaaataatagtctgcgtatactttatccatcagcagaccatcgacccgtctgcttttcagatcgatcaatgcttcattaaaactatcatacaaaacagcatcttggtttttgactatctcttttaatacttctggttgtttcgtaaatacatcataaccagatgacccattttgcgcacctaatctcttattattcatttgtccaaagtttgtgattcctgattctttaggtgtgatcagcacttgatcgttttccatataaggttttgtaaattgcactttcttttctcttgccggcgttttggaatagccgttccatatcaaatcgatcgttccattgttcagttcaaattccttcattgaccagtcaatgggctgaaagtctaccgtaatcccatattgttcaaagactgctttggctaaatcaatatcaaatcctgtgagcttcccgtctttatctctaaatcccataggaacaaatgtatcgtctaaacctataacgatttttttctcttcgttgatagtcgcccaattatctgctgaagtttttttgttcgaacagcctgcaaaaagaagaagacctgcgatcaaagcgaatagaaaactggtttttttcatctctatcttctcctttcttaatgaattggggaaacttttagtaattgatcaccgacattttctgcaaatactaaatcatgggtgacaataatttgggttaccccatcttctttcaatgataggatcaaacgctcgacttgctggcgtaattcaggatctaaagcacttgttggttcatcataagccaatacccgtggattcatagccaatgctctggcaatcgctacccgctgtttttgtccgccagaaagctgataaggatagttattcaataaatcactaatccctaatgaagccgctaattcttctgcttttttggtgtattcttcttttgtctgtttcaataccatttttggtgctaaggtaatgttttcaaaaatattcagatgtggaaatagctggaagtcttggaatacgactcctacaacttgttctttcattttaagctcgaatgggttgaacggtacaccatctaaataaaattctccgctgtcagaactttctaagccagccaagatacgtaaaagcgtggttttaccgccaccggaaggacctacgatagctaatgttttcccatctggaatgattagattcaaatctttgattatttttttttcaccaaatgctttgttcactttcttcaattcaatcatatttcttcctcctatcagttagcggtaataatttaattttccttcaacttgtttcattacgattgttagaataccagtcaatgtaagatagatgattgccacgcctagcaaaggcagtaaagtcgcgtcgcgttccatcgcgattttcccagcacgcattacgtcacctaaacctaatatatagatcaaggaagaatctttgaccaagttgataacttcattccctacagaaggtaaaacaatctttgtcacttgtgggatgacgattttcgtcaccgtttgaaagggacttaattgcaaaacttgcgctgcttcatattgaccttgaggaatcgattgtatccctccacgaaagatctctgcaaaataagctgcatagtttaagataaaggcaatgagtgctgcttcgaaacgatcaaaaacgatcccaatcgtcggcaacccataaaaaataaaaatcagttgcaacaacagcggtgttccccgcataacccacacatatgtttgaagcaagtagcgtagcggcttaaaatgcaaagacaatcctaatgctaaaacaatccctaatggtaatgagccaatcaaggtaaataaaaataatttcaatgttgtgagtgctcctactaataattgcggcataacttcaatcaaatactccatcttcttttcctcctttaaaataaaaaaatcctcttggcaaatgccaagaggacgtattatacgtggttccacctctgtttattttttccttgcagaaaaaacctcacacagtcgttgccgttcagatgaaaacaaaaagtcctttgatccgaagatcaaaggacgttaatcacgtggttccacctttttttaccggctcctcacggaaaagccagccttatctggtcatctagcaacgaccgcagctgtaacgggctccccggattttcctactatacgcttcagaaaatcgactccaagatgtgtttcacggttaactgctgcctctttccaccaaccagagactctctaaaaacacctaacggctactcttcttttcgatgtcatttattttaactttacgtgtaatttacatgattatttttcatttgtcaactcttttttatgatacactaataaaaaaaggagggtgatgcgcgatgagtcgtgcaaccgaacaagaagcttatgaactactaaaaaaactggatatctcttttcaaaaagtcgatcatcctgcgattacgtcagtcaaaaatgtccctttttccctacctggtccgcaagtaaaaaatctattattgaaatcaagaaaaggaaaacaaatctatcttgtcatcttgcctgatgaaaagcatgccgatttaaaacaactagctgaacaattaaaagaaaagcgcttatcttttgtttctgaagaacagcttcctgacctcctaggcattccagcaggtacagtaactccattagcattgatgcacgacaaagagaaacaaatccaagtcgtgatcgatgctgctattgatcgtcaagataccgtaggctttcatccaaatatcaataccactacgttgatcatagattttttcgactttgaaaaaatacttgcttacttagaacattggccagtttatgaaaatttgtagcaaaaaattccccaaagttagataaatccatttaactttgggaatgaatagaatcatttgaacctagcgttatttgaaaaaactacaattgaattagtagaaaacttttgattgatacaaatctttttataaatgcccaaaagtaatcggtgccgaagccattcctcgacctaattctttttcaaattttcctattgttgatatctccatataaaacggtgagactggtttagacaattcccccttgattgctaacggtcgtaaactacgttccaaattattcatgactttaggataatactgacctttttctaagcctgtttttgcttctatcagaagtatacgttccttttcattgatctctggatttaaaacgagatcatataattttagtaccatgttttctatttcttcacttttagacatcacaatttcctcccagaaatatatttctccccactacattctataaacaaagtatacgctatttttaatgatttttaaatcacacagacataaataaaaaagacagatacccgaccagggtatctgtcttttgctttatgccagctatagggatcgaacctacgacctacgcgttacgagtgcgttgctctaccaactgagctaagctggccttatccaaaagaaattatatactctatttggctgattgtaaagagtccgatggaaaattagtttaatttcatgatatttttcataaaacgtggtataattgatgtgaaaggcaggttttatgaaaatggcaacttttggaaaatttgatacaactatcgtaccatcggaaattggtgaaaaattcaagatcaatactcacgtaatgttcacgattcacggcaagccgcaaactggaacgatttcaaagcaattgaaaaattccgctgttgttgagattgatgaaactgcagaaaatgcgaacttgatgacgcaaagtaagggtgtagtaatcgttaactacaaagaactaaaaaagatttgaatttgaccatctctgcatttttgggatggtttttttatatgcaagcgaaagctgtgaaaaagctgttctgcatcaaacgttaaaaatgaccaaaaaaggatgtgacaaaagctgtgtcacaccctttttcgtatttacttattttgtaccaaacaaacggtcacccgcatcccctagtccaggaacgatataaccatgttcattcaatttttcatctagagaagctgtatagatgtcaatatcaggatgcgcttcttgcaaagcttttactccctcaggtgctgctaccaaacaaacaaatttgatgttcgacgcgccacgttctttcaatgcatcgattgccatgattgctgatccgcctgttgccaacattggatctactacaaacaactgacgtgcatcaatgtcttctggaagtttgacgaaatattcatgtggttccaatgtttcttcatctcgataaagaccgatatgtcccactttagcagctggaatcaattccaagataccgtcaaccattccaatacctgcgcgcaagattggaataatcgctacttttttaccagacaacgttttttgtgttgtttcagtgatcggtgtttcgatcacgatgtcttccaacggcatatcgcgtgatacttcatatgccatcaacatagcgatttcatcgactacttcacgaaaaacctttgttccgcagtttttgtcccgaataatagttagtttgtgttgaatcaatggatgatcgatcacttgaaatttgcccattttttaagctctcctttgttctgtcgtttctttttaattgtaaaacaaaatcaagtgattgactagtcaaactcgccatttttcctaagaaaatccgtttttgaaaagaagttttcctgcggacaagcaaagcttattcttttttcttgatccaagaagtagataatgccattgctgcacgcgttgcctttgtctgatccatagcatttaccatgacaaaatcatggatgattccttggaagcgtacttgtgtaacaggaacccctgcatcacgaagtttgcgcgcataagcctcaccttcatctcttaatacatccgcttctcccgttaaaatcattgctggaggaagatcatttagttcattcaggtctgctctcaaaggcgaagctgtgacttcagcacgctcttcctcattcgtcgtgtattgatcccaaaaccacatcattccttctcttgtcaaaaaatagttttccccgaattcatgataggaatctgtatcaaaatcagcgtttgtgactggataatacagcaattgcttggatattgggaggccctttcgttcttttgttaagatcgtcatgactgtagccatgttaccacctactgaatctcctgcaacgattagattctcgagatccagattttttgacttggctaatttattcagctgttgcaacacagcataattttgttcaattgctgttggatattttgcttctggtgatcgactatattctggaaagacaacgacggaattcgtacgaaccgcaagttctctgatcaatttatcatgggtttgagcactgccaaaaacccagcctgctccatgaatataaaaaataactggtaatttatccatattcccttctggtcgtacgagacgaatattgagttttccccattcgccagtatccaccatcaagtcttcaatatcgacggaatatttgttcacaggtgattcttgtacttcttctagtaaagctcttccttcttccggtgctagttcatagatacgcggatgaggcgcatttgcatcactgaatgctactgcttccttttctaacgagatacgatcagtcatgacttttcctccctgagatttagtgtgaagactaaaattacacctcatatactagagagcatcaccgatattgtcaaagaatccgttttcccaaaaaataaacagaaaaaaacagaaaagcccaacattgaacttttctgtttactaatggaatttaaatttttattttttatgcaacggaaatttttcagttaattcgcgtacacctgttttgacttcgtctagttgaacgttatcatcttttgcttgtaatgctttgacaactagttcagccacttttacagcatcttcttctttgaacccgcgagtagtgattgctggcgtgccgattcgaataccgcttgttttgaatggacttagtgtttcaaaaggaatcgagtttttatttacagtgatattcacactgtccaaaatgctctctgcttcttttccatttatacctaactcgcgaacatcgatcaacatcagatgattatctgtcgcccctgaaatgactctggttccaattgcttgattgaaaactttgaccattgcttttgcattggcgatgatttgttcactatattctttaaatgcaggatctaatgcttctttgaatgctactgctttacccgcaatcacatgctctagagggccgccttgaataccaggaaataccgcactatttattttttttgctaatgcttcatcgtttgtcaaaatcatgccgcctcgaggtccgcgcagtgttttatgagtggtagtcgttgtgatatctgcataaggaactggattaggatgaagtcctgctgctactaatcctgcgatatgtgccatatctaccatcagttttgcgcctacttcatctgcgatttctctgaatttcgcaaagtcgatcgttcgtccgtaagcactggcacctgctacgatcaattttggttgatgttttctagctaaaatacgtaccacattataatcaataacttctgttgtcggatcaacaccgtaagcaacaaagtgataggttttgccactgaagttgactggtgatccatgtgttagatgtccgcctgcggaaagatccattcctaagatcgtgtcccctggttctaccaaagcgagataagcagccgtgttggcttgagagccggagtgaggctggacgttcgcaaatttcgctccgaataattcttttgcacggtcaatcgctaaattttcaacgatatcgacaaattcacacccaccataatagcgatgccctggataaccttctgcgtatttatttgtcaagatacttccttgtgcagccatcactgcttcggagacaaagttttcagaggcaatcagctccaaattatgttcttgtctttcttcttctttggcgatcgcagcccaaagatcagggtcaaacgttttgtaatctaccacaaacaacagctcctttttattttcctacaattttatttttcccatcaaaaacaaattgccaaatattcgtatctcttctattacgattagttacgcttagtttttcgttcactgatagaagatttacttgatagcattgtatcatactaaaagaatgcgacaataaccaattgatcatttttcaaaataattttgtcctgctgcttttttcaagcggttcatataagcattccccaatccagtttctggatatacttgtacaaaaatcaaatctaatccaagtgttggttcatctaatcctcttagacctgcaaacaatcctttagccgccgcttctactgagttgtcgttatacatataaacagctgcagtatctgtccgcacttgatccgcaatttcggggcttgctatgacacctgcacggatcttcttattttttgcccattgaactgcagttgaccaatcgccatctctgaccatcagaacacgtgtatcgggtgagtagtgtttgtatttcatcccaggcgcttttggtgtttcattttcttttacaagatgctgatcaatagcaacaggagattcgatgactgcttcgatttgttctttcgttactgcacctggtcgtaagatcataggcatggctgttggatcacttaaatcaagaacagtggactctacaccaattcgcgtagcaccgtcatcaataatcccggtaatttttccttgtagatcatgatatacatgatctgcagtcgttggacttggttttcccgacgtatttgcacttggaccgacaagcggaacaccggaaagttcgattacttctagtgtttttttgttatccggcatacgaaatgcagctgtggataatcctcccgtcacaactgagggcaaagtgtcttttttgatcttaaatatcaaagttagtggtccaggccagaagttcttcacaatcttctctgctgccggatgaaagttgtccacatactcttttacttgttcaaaagaggcgacatggacgattaatggattatcttgcggtctcccttttacagaaaacactttcttgacagcgtttggtaaaagagcgttggcgcccaatccgtatactgtttcggtaggaaaagcaacaagttctccttctttcagtgcttcggctgcctcttgcaattctgtttcatcatatcgtttcgtttccacagtttatccacaacccctttttcatacattcttattttgtctgagtttatcctcaagttttccactgtttgtggataatctatttgtcaatagtggataaacttgttgataaaccaaaaagtcgtttacatccttgtcaaataagtgtttttttataataaaaaaacaaataaaaaatttttcatccacaacttcaaccataaacttggatcattcgttcattgccaaaaagatccttttttatcgccacttttttatctggaaatgcttgctgaaatattttttttactgcttcaccttggcgaaatccgatttctaaaaaaatctttccatttgattttagtacgcttggtgcttcaactgctattttttcataaatagctaatccatcgttctcagcaaaaagggccattttaggttcgaatgaccggacactttcatccatcagttcccattcattccgactgatgtacggcggattagaaataatcacatcaaattgctgatccattactggtcctaatgtatctccatgataaaaactgattttcgttccttctttctgagcattttctttcgctacttctaatgcttcttctgaaagatccacagcagatacatgccaatttcttcttgctgctttcaaactaatagcaattgctccagtccctgtcccaatatctatcacttctaacggtacatcaggcgtctcgtctaaacaccattcgactaactcctctgtttctggtcgagggatcagtgttgcttcagttacctttaaccgatgatcataaaaatctgcatatcctagcaaatactgaggtggatgatctgcaagcagaagtcgcagatcggtttcgatcaaccgctgttcttcttctgaaatctcttcgttcatatgaaggagccaatcaagttttttccattgttttcgttccaaaaataaaaattggatactatatgcttctttcccatgatcctctaaaaaagaagaagcccgtgacaggacttctcgataggtcattttacccattttgcatagcttccagttttgatgtttgatcatacatgatcaatgcatcaacgatctcatctaatttccctgctaaaatctgatctaatttttggatagttaatccgatacgatgatcagtcacacgattttgcgggaaattatacgtccggatccgttctgaacgatccccagttccgactgctgattttcgattggcatcatactcgctttgtgcttcttgctggatcttatcgtacacacgagcacgcaagattttcattgctttttcacggttcttgatttgagaacgttcatcttgcatagcaacaacgatccctgttggtaagtgagtcaaacgtacagcagatgctgttttattgacgtgctgtccgccagcacctgaagcatgatagatatctgtacggatatctttgtcttcaatatcgatctctacttcttcagcttctggcatcacgacaactgttgcggtggaagtatggatacgcccttgcgattcagttgaaggaacacgctggacgcggtgcgcaccactttcatattttaatttcgaatatacgttgtctccggtgatcatcatgatcacttctttatatccaccgattccggtaacgttagcttccatcacttctgttttccagccttgtgcttcagcatacttttggtacatattgaaaagatcgccagcgaataatgctgcttcgtctccgcctgctgctccacggatttccatgatgatatttttatcgtcatttggatcttttggtaaaagcaagatcttgattttttcttctaagacttctttttctttttttaattcagataattcttcttttgctagttcagccatttcatcatccagtttttcaccaagcagttcttctgtatcggtgattccttgtactacttctttataacgacgataaacttcgactgtttcgcgcgtgtttgcttcttcttttgaaagctgcataaaacgctttgtatcagaaatcacttctgggtcacttaaaagttctccaagctcttcataacggtcttcaattgcttgtaattgatcgtacatgcttattctccttctgtaatcattgatgggtgaaagtaatgttttcgacaaacggggtaataagcttcatttccgccaatttgcacttgatcgccttcataaacagggtttccatcaatataatgtaaattcatgattgcttttttgtggcagaaccaacagattgttttcatttcttcgattttgtctgcataaagcaataaatattttgatccttcaaataactcgtttcgaaaatcatttttcaaaccaaatgccataaccggaatatccaattcgtccacaattctcgtaaaagcaatgacatgtttcttttttaagaattgcgcttcatcgatcagcacacaatagggtttgctttccattttctgaattacgtcaaatacgtctgtttcttcaaatatcggcatcgcattacgtttcagtccgattcggcttgaaacaacgcctaaaccatctcttgtatcaatacagcttgtcattaagacaactggcttattttgttcttcataattatgtgcgacttttaggatctcgatcgtcttgccgctattcattgcgccatacttaaaaaatagttgtgccatgctctttttcaccttccagtttgttcctatggtattatacttgattttcagcattttttacagtgagaattttcatcaagcacagattagtattaaatctattgctcacttttgttccaattttttgacaagaactaaacatgggttctgttcatcccataaatttggaaaaacttccaaccttgaaaatcctaatgattcgtagaaacaaatagtttgatcatatatagagtagtgcccctcgtctacagtcttcacttgcaaatatttgtaatgttttgctgcgtaaccttctgcttctttaaaaagttttgttcctaatccttggtgatgatagtctttttttattcccatacaatagatttcggcagtatcttcacttgtctgtgaaagagtgataaagcctaaatattcttcttttcttttttcacaccataaaggtagtttacttgattcctcgatatatttttccgttgattcaggaagcccaaaccactcaggcaagtctagtaatatttctcggacacactttcctttttcctctctatcttttacaaacgatatcggcatattctttctagattctccctttttgaattgagtatagcatgctttctttcttttcacgtgctataataagttaaaatttcaaagttttacgtaaggagctatttgatgacaaaaaatatttttgattccatcgctaaccattatgattcccctgaccgtcaagcattagccaagattattcgcgaagaactaactacttatctaccgcgcgacagccaccaaaaagtcctgctggattacggaggcggaactgggcttgttagtttaccgcttgcggaaagattcaaagaactgatcattgccgatgcttcggaaactatgctgaaaatggcagaagaaaagatccaagcagcagatctgaaaaatgtccgaacgatccacgctgatgcttctgtcgaatttcctgctgtccaagctaatctcatccttctatcacttgtacttttacacattcctgatacggagaatattcttacaaaactttatgaaattttagctcctggcggtcaattgatcatcgtagactttgacaagaatgaacaaattagtcatccgaaagtccataatggctttagccaagaagaattgaataatcgattggaaaaaacgggctttgtctctgctactagtcataccttccatcgtggggaaaagctatttatgaacaaaaacgcttcgcttttcttatccatcagccaaaaatcttaaaatgagattgcaaaaaaagtgagcaactccaagaaataagaaggaattttcggaaaaagaagctgtgacaaaaaacatgtcacagcttctttttattttttcatcacatgattttgatttctgaaagaggccaataacggaaaacaacttctccttggatcatatctttgtcgactaacccaaacattcggctgtcttttgaaatcaagcggttatcgcctagaacaagatactttcctttcggcacagtatattcaaagtcactcgtaaaggtggatgaactttctgcttgtgcttggaatcctgagctataagcatattctccttgtaacttatcttctgaaaattcttttttgaactcatccagataaggttcatcatactttttgccattaatggtcaactggtcattttccatcttgactgtatctccaggcataccgatgatccgtttaacaatcatccgttcttcatcccccggttcctttgtagtaataatatccattcgttcatagtttgagatcttagatgaaatcaatcgttgtccatcacttaatgtagggtccatcgaatgcccgtttacagtaactggtgtaaacacgtacactctagctaataaaatagccgctaatacaaggatcaaaatcccccaatttttcaaaaattctttcacagcttacctcctacttgtattttcctcgttatttattacgttttttcacaatacttcgttgtactttctttattctacaatgtttataaatgaaaggaaagaataagtgatgtgttcgtcttatctttctcgttatataaaaaaggaacgtgacaaaagacgtgtcacatcccccttattccgaataaacgtttttatcgcaaccactgatacacggcgtttcatcacattatgaatgtcttcttctttggctacgactataaaccactggttcttcctgcgactgtgccttttttgcaatcaatttcagacgataaggctcatgatagcgtaacccgtctttgacaaaatcaccgccgacgatgaacaatccgacaggttccaatgtgtcttctgttgagtcaagtcgaatggtccctactttttccatgtccgagtagcttcgtccaatatttagaacatactctttctctcctgttttcttgacatagtaataaggatacaatgtatttctatcgaccagaaatccatccatgcgaccgagttcatttgttttgatctcaccatttccaatcaaataccgcatattctcggctaatttcaattgataatcttcgtcataagaaaccatgacctcttgtgtattcactttatcaatcgaatttccattatctatcgattcttctgtctggatgttgaacgcttcatcaggtaaatacttcacaaaaagctgagtgacatcggctttcgtgtttttatctaaaaagtaataaaatacatttaaaacagtaaaataaacaagcactagaaatgcaagtccatataagaaaaattgaagatagttttggttttgccaaagtccataaacaattctcaataaataaagcgtgggaatcacacttaaaatcgtatatccacggttaagatatttaggactgatgtctaaatagccaaggaatttatgcaccccgttgataaggtctagtaaaaatgtcattgagaatcacctgcttgctggttatacgtttgggtatttcctgaatcttggttttgctgtgctgtacgtgctgcatcatcattttgcgtgttatcatctacagtcgtactgcttggtatcgtttcggagctagcacttgtatccggacttgtacttggattggttgaatccgatggagtgccatctggtaccgtattacttgtttcgcttgagctgtcagttgtatatgtctcatcatacgacgaactagttgttgtatcgtcccatgtacttgtcgtagtggtttcattcaaactttccgttgttgttggttcagatgtcgagactgaagtagttggtgttgtttcttctacagtactagaacttgaacttggtgcacggtagctggaactattcacaatacctgtagtagtcgcgacaatcgtcgagattgttaatacagcgattggcttcaaaataggtgctacttttcgcatcttatctcttccttcattgaaatttattcttgtttccttactttactacggacaaattatacagtctaccttatttctaccataaattctttatttttttcttacgtttttccgaaagatttctttaattttcctcaaaaactacggttgatgtttttaagtaagcttttgcttcccaattgatttctttcagatcgcatccttgctgcttggcagcgaacacgcaaccacaataacattggcgataaatatcatactctttgcacatttgcaaagagcgttcatagcctttgtttttcttgaaatcacttggcaagtattgtgtcccgtaaatcttttggatatccattccgatctgattgatcaaagctgcatttttctttggcgagatggtcagggcacttccaaagtaatcgtatcctagttcttgcgctttttgcgcaacaagatctaatcgcatattgaagcatgcactgcagcgagcaccaccttctttttcgttttcaagatggtttgttaaaaccattttggtgaattcatttggacggtattcatcaacgattagcgcaacatgatggtcagttttctcattaaattggtctacaaatcgtttttgttcatgtaatcttcgcaaatactcacttttaggatgaatattcgaatttgaaaaaaataacgtgatctctgcatattgagacatgaattccaatgtgtgcgtactgcaaggagcacagcatgtatgtattaatatcttaggctttacttcttctttctcccattgcatgatcatttttttcagaactgtatcataatttattttttgatttttcattttctctacgatttgttgagcattaatcaatttgttattcctcctccttcttttttctaggatttgccttattataagccatttctattttaatcgaaagctgtattgttatctgtttaataatttctttgagtattcctaattccccttgtatactggtagaaacgactattgtcaggaggatagtactgtgcatgttgatttattctttcgaaggctgcagcggcgaggacagaagtttgctgccaatcatttctcatcgatccaaatcatcgttttttattatatattgatgacggtcttatcactcgttctattttatatgccgatttttcgcgaaccagatagccatgtttcttttgtggacatgctgttcatggcaatcagtacagtgagtgtgactggactatcgacttttgatatcaattctgtgttcaatgataacggtattatactgctggaaatattatttcaagttggtggtttggggatcatgatgatttctactgcttttgtcattttttctaaacgacggatcacactgaaacagcgacagctgatcatgacggatatgaatcaaccgcgtttgtctggtatcgtccgactgattcggatcacttttgctattttaatctggtttcaattactttttgggacattcttttctatttatttttattacagaggctattttgatcgttggcatgatgccgttttttacggtttttatcaggcgatatcggctgtcacgaactctgggtttgacgtcactggggattccatcaagccctttgcacatgactattttttcttgatcctgatcatgtttttgatttttgtcggaggaattggttttcctgtattgatggagtgccgggaatggctattatacaaacgttccaatgcgaagcttccgtttcgtttttccttgtttaccaaattagctgtgttagcttttgttatcttgtttgtttcgggaactgtcttgatttatctattggaaaaggaccatttattccaagattccaatatgagtgtcaaatggatcaattcgatgttttattcgattacgactcgtaatgctggtctgcagattcacgatttgggtgattttcaaatcacgacactgatcattttttctttactgatgtttatcggatgcagtcctagttctgtaggcggcgggattcgaacaactactgtagcaatcatcggtttgtatctatattccttcctcaaaagtgaagataacatcaatatttttggacggagaatcgatcaagatgatgtgcgaaaatcagtcgttgtctttatgctttctcttggtatgtgtttcttttgtatcgtttttttatctgctacagaagaacaaacgctgatctcgatcatcattgaagtaacttctgcgtttggaacaactggtttatctttagggattaccggagacttgtctgttgtgggcaaaatcacgattgctgcactgatgtttattgggcggatcggaatgctatatacattgatgttattcgtaccaaaagaaacacgagatctaggctatgaatatccaagcgagaaaattattatcggttaaaatgggaatataggtaagagggaataataaaatcacagcagcttgaaacaatcattttgtttcaagctgcttttttgttaaatcatgcgattttgtccgatttcatgcactttcagccgtaaccttttcttaagaataagaaaagcaatttaacctttttttcaacatatggtatgattagttgaatttattcgtcagcaaatcgtttttggaggttacataatgggaatacgcagtcattttgcgattgcagttggaaaaacgtcgcaatgggcattaaaaactttttttaaaggcggatcaagtttaccaggtaaactagcgctgaaagtcgatccacatatactagatagtttggcaaaagactaccaagtcgtcgttgtcaccggaacaaacggtaaaacattgactaccgctttaacagtcaatattttgcgccagcaattcgatgaagttctaaccaaccctactggtgcgaatatggtacagggaattgtatcgactttcttgcaggcaaaaccaaaaaaaggacagaaaaagtttgctgtcctagaaatagatgaagcaagtttgagcaaagtcacagaatatatgaaaccagaactgttcttatttacaaatattttccgtgatcaaatggatcggtatggagaaatctatacgacctataaaatgattgtagacggtgccgcaaagtcaccaaatgcaacgattatcagtaacggtgattcaccaatcttcaattctatcgaaacagtcaatcctagaaaatattatggctttgaccatgaagaagatcgtgaacaaatggctcattacaatacagacggtgtcttatgtccaaattgtcatcacattttgcattataaaatgatcacttatgcaaacttagggaaatattactgtccaaattgtgacttcaaacgtcctgaattggattatcgattaactgatatggtacggatggacaatgtgtcagcagatttcgtgatcgatggtcatgaatacggaatcgaagttggcggtatgtataatgtctacaatgctttagcagctactgcagtggcagagtacttcaatgtcgatcctgataaaatcaaacaaggtttaggatatgacgagaaagtgttcggccgacaagaagtcatcaatatcaatgggaaaaaatgtacattagtacttgtcaaaaatcctgtaggtatcaatcaagtaatcgatatgattggtctagctccttatccattttctttagtggctttattaaatgccaattacgcagacggaatcgatgtcagctggatttgggatggtaattttgaaaactttgccgatatggatatcccagctgttatttctggaggagaccgtcatacagatatgactttacgtctaaaagttgccgggattccagaaaataaattgacagaaacaaaagaattaccagaagtaatcgaaaaaatcaaagaattgccaactgagcatgtctatattttagctacttacactgctgtattgcagcttcgtaaagaactagctgctcaaggatttatcaaaggaggaatgaaccgtggctaattatgaactcaatatcgcccacctttatggaaatttgatgaacacatatggtgataacggaaaccttttgatgttgaaatatatagcagaaaaaatgggggtttcttgccatacggagatcgttagtatacatgaaccttttgatgctgataaatatgacttggttttctttggcggtggtcaagactttgagcaattaatcatttcaaaagacatccagaaaaagaaagattctttgatcaactatatcgaaaatgatggcgtcatgttagccatttgtggtggctaccaattgctaggtcactactacatgggagctaatggagaaaagatccaaggaatcagtgcactggatcactacacgttaagtcaggaaaataaccggtttatcggtgatatcgttatccataacgaagaattcaatgaaacttattatggatttgaaaaccacaatggtcggactttcttaggtgaaggtgaacgacctttggggaaagtggtacaaggtcaaggaaataatggtgaagaccaatctgaaggtgtcatttaccgaaatgtcttcggttcttatttccatggacctatccttgcaagaaatgagaacctggcagctcgtttgatccgcctagctttagaacaacgttacggtaaagaattggatctgccctatcttgaaggacaaacagcctagttattcgaaaaaggggaatgtgacaaaaatttcgtcacattcccctttttcgtatcctattttaagcgacttgcttggcataacggttcacgttttgcttgatattcccgattgttttcggatcattgattcctgtgacttcttgaatcaattgttccaagttttcatggatcttcatttcatgcaattgacggctttgttcatcttcaggatcatagtaattaaaaataatccccattgttgccgtcaaatgtgggcaagtcaagttatgttcttgtagttctctcactggacgtgtaaatctttcttgataacctaacttacgtaatggtgtccgagcgacacgtgtgatcgcatcagagatatttttgttttggaagcgatgaatgattttttcaatatacgcatgatgctgctctgcatcaaacccccatttggcaatcagcaaacttcctgtttcctgcaaaactgattttaattgtgccacaactaacgcatcttgcattgcttcatcaatggtctggtaacctaacaaggcacctgtataagcgacagtcgcatgaccagtattgacactaaatagtttgcgttcgatatatggttctagatcatctacatataaaaccccttttaattggatttttttattttttctttggctatcgtcaatgacccattctttgaaaggttccacttggacgaataaaggatcttcatggtgttgtaatgggacgattcgatcgactgctgcatttggaaagccgatatatttgtcagtaaatgatgtttccggaagatatttatacacttctttttctagaaatgctgaaccgccaatcatattttcacaggcaatgatatctaaagatgttgtgcttccttccttttctctttcttggataccttttgcaatcaactcagcaataaaaggtaagatattcgggccaatggcggtagtaactaaatctgcttcagcgatttcttggattactttttctggatttgtttgattgttgattcctttgacattttttacagtgattttttcttttgattcatctgctaattcgatttcgtattcttttctttcatttaaagcatcaatgatcgtgtgattcacatctacgaaagtaatctcaaatccattagctgccaaaacctctccaataaatcctcgaccgatatttcctgcaccaaaatgtactgctctcatttttctctctccttaagcaattgctagattttccgttacttcttctttgctgagcgcgtctgctagctggacaacattgtccatatcactgcaataaagtgcgatttgctgtacaagttgcaaatgctcatctccgactcctgcaataccgaacaaaacagtcgcaatcttttcttcttcttcggtaccaaaatctacaccatctggtacttgaacgacacagatgccggattttttcacatatttttttgcttcatctgttccatgaggaatcgcgataaaattccccatataaacagataacattttgtctctatctaccatggcatcgatatattcctcatcaacgcaccctgcttctacaagcatctgaccgcaatagcggatcgcttcttctttggttttaaaagatcgattgagctcgatcatgtcgaatggcaaactttgcatgctgttttcctcccttaagctgtctgtttcaaatattgtgcaatcgattcgtatttttgcggattgaccatgctgttgactgataaatgaatggattgaggtgcagccatctgtactttttccgctaaactttctttggctacgatcagtgaatcaggttcatcttttaaatcttggatattgacttttcttaacgggatagttaaatggttcttgtctaatatatctttgagcacggtcatccccattgttgctgatccggaacgatcatcgtggacaagtagaatctctttgatttgtttgatgtttgctgaaagaaactcttctgctggctcattctcaatttcagaaactgatgttttctgcttgctgcttaattcttgaatgatttcatcatatcgaggtgaattcaaaaagttttctactgagacaaaacgcgcgctcggtgctttttgttttgctctttcttgtagttcgacctgagtaacgatcaatgtattcgagtcatctgtcagttggctgattgcttgattggtcaccgtttgaggcaagtctgcttcctgtactttttttctcaagatcgaagcgcccatcgcacttgatcccatccctgcatcacaagcaaaaatgattttttgtacgccagagaatgtagctccttgaggaataccttgggcacctttggaagcttgcttagctgcctttgtctcttgaacagatttttcgaagtcttcatttgtatctttcgcatccgctttcaaaattactgcagaaataccaaacgaaacagctgcggcaacaatcacgcccaaaataacaggaaggtaagaattgaacggtgtcatcgctagaatcgcaatgatcgaccctggagaagctggcgctcttagtccagcatccatcaattggaaaatgaaacttcctgacattcctccgcctataactgataagaataataacggtttcatcataacgtaaggaaaatagatttcatggatcccgcctaaaaagtgaatgatcatggctcctggtgctgaagattttgctgctcctttgccaaacaaagtaaaagcaagtaatacgccaagtcctggaccaggatttgcttcaagcaagaatagaatagattttccagcctctgctacttgttcagttcccaatggtgtcaaaatcccatgattgattgcattattcaaaaataagatttttgctggttcaataaaaatacttgtcaatggaatcaaatgggcagataaaatgatctctacaccttttgccattgcttgagtcaatgcatcgacaactggaccaatcgcagaaaaacctaataacgctaatccaaaaccgataagacctgctgaaaaattattgactagcatttcaaaaccggatttgatccgtttttggaatagctgatcaaatttcttgatggcatatccaccaagaggtcccatgatcatcgctcctagcatcattggaatatctgttccgacaatcacacccatcgttgcaattgccccaacaactgatccgcggtcaccagcaattacttttccgccagtataaccgatcaataaaggaatcagataagttagcattgggcttaccatggtagcgaaagcctcatttggtaaataaccatctgggataaatagagccgttaatacaccccaggcaatcagtgctccaatatttggcatgaccatgcttgataaagtactgcctaatttttgtaccctcgcttttagcgaaatgttgtttttgggaatcgtccgttccattttgtctctccctctctccttttgatactctaattgtatccgcttactaaaaagagaaatagtcgtactttggcacgaaactttgtgccaaaggtttgagtatgtcagcaaaataaaaagatttcggtatcagaaaacttcaattttaaataaaactgttattttaatttttttataatatgcaaacaataacttttgttagcatttcatttagatgtttttcattctattatgttattaaattttatattggaggcctatctatgacattactgatcaaaaacatgaacatgaaacgtggtaaaaaacatgtgattcgacaattgaatcttttagtagaatcaggagaagtagctgctttgattgccccgaacggatttggcaaaacaactttgctgaatggcattgcccaactgctgccaacaacttatgatcaattgtcccttcacaacatctctcctactgcttatacagattatcgccggtctttcttttttctagaatcaacgaatcagttatccgactatctatcggctgttgattatttgactttgatcaaatactattggcagagcaaagtagaatgccaaactgttttccaacgattgaagatgactgagtaccttactttgccgattggaaaaatgtctctaggaatgaaacaacatgtcttgcttgctgcttacttgatcagtgattcatctgtcatgttattcgatgaaccgttgaacggattagacccaggaagtattgatatcttgaatagcctcatcagacaatggcataaagaggggaagacgattcttctttcttcccacgctatcgcgaatatccaatcgatttgttctaaagcatgttttctaaaaaatggagaaatcgtcacagaatcctcaaatatggaagagattttagctatttatcgtaaattatatgaggtgtaactatgtctttacttacatttgaacgcaatctcttactaaaaaacaaagtaaactttttatttcctctattgttggtcgtgctctttgcattcccacttttttttgatcataaacttgcttatacagaattcgatgaactgaatcataactatgaagagatgcaacgtttgattgaaacgttgaaagaagatgagaatgagaaagaatttgtggaaagtttagagaaaagcaacaaactgatcgaagcaatcttacatgcaaaaaacacagggaatgtccagcaaatggtcgaagcaacttatcattatgaaaaagatatactggatcgactgatttctggtcaaagacaaggaattccaatcattgaacaacaaaaacgtgtcgagttgctccgttatatgaaagaacatcagatccaaagatattctatttttgacttgccagcgcatctccctttagcgaattactacgaaaatattttttcaggaatgatttctagttttttgattttatgtataaccgccttgtttctttcttccatcatctcttatgaaaaaagaaagcaggtaatctctctagtcaatctattaccggatagtatggtaaagaaacatagcatccgttttaccgtttattatggtgcagctatgctaagtctcgcgatgccatttttgatcgtctctatactagtaataatcaaaaatggtttgggagacttccgttatcctgtaggaacgatcattggtcaggagatacgaatccttccgatgtatgcgtatcttttccagagctttctgttcctgttgttgtgggtgctctttttaagtacaatcagttttcttctatctgctttatttgaacattctctagtcaatcttttaggtacacttctttgtcttttcttagcagagtatcgcttgttttcttcgattggatggatagaatcaatcagtcattacttgccaacttcttatgttgattttcaaaatgtgatcataggaggagatattttctcgccactagcttcagaacaggttactttcatgaatggtacttgacacttggtatatggagtatcgttttattattcataggtatgggcactatctatataaaaaagagctattaaaacacaaaaataataggggcggtgacaaaaaccttgtcaccgtcccctatttcaaataaacggttttctagaataaatagttttcaaaagcttgcatccgcagtaataagaacctcccaacaaaaatagctcctcttatttttatcttggttgaagttattacttaatgcaaggcagctttttttactgtgaacattggttatatatgtccatgttcaaaaatcatttggacttcttcaatggtttccgcatcactgagcgccattacttggtcgatgtctgaacagaaaaaggctaaatcttggagcaccgctaactgatgttctttttttaaagccactacaaataagagtgtcgcgatttttggttcctcttttgttccaaagtccacaccatcaggcacttggactaaatagattccttcttctactacttcttcatctttgtcagtcccatgtggcaaggctacgaaattcccgatatagacactcgctttttcttgtctttcgatcattgattggatatatgccggtttgattcccccttgttgggtcatccactggccgatctcggtcaacgcttctttccaattttgataggattgatcgagcaatattttttctgctggtagctggatcatcttttcaccttcatttctttatttcttcaatcaggattttcgctagcaactgataaacgatttctttatttcctgagcggaagatctcggtgttcaagtcattcatgatgattgctccactgatctttcctaaaagaatcccgtctttttcttggattggcgaaggcgccagcataactaacatacgggacaaatcgactggctgtctatccatcccttcaatggtcaacggatgtttcaaattgaaaatacaaaagatcggtttaaaaatcaatgagctggatgtatggaataaccccatatttgtatgaggaataccgataggtgcttgttcatatcgcttaagcagccggcgatgaaccacctcttcatccgttactagtccttcaggaaaataaggaaataagctgcgaatcgtttcggaaatcgtctcaggattatctagttcttgaataaagaaacgatcaagtaattgattgatttgatccatgaaatgcattgtttcctcataagtatcttctatcatccactcgttattgctgttatacgtaattttttgcctttttttcttctcaatatgcgaaaaagcttcttttagctgcttgacttcctcttccagcagtagcggggagactaaaatatatgttccattatatcctggtagaatagatgtagaaataacaacatcatattcttcttgtaaatcgattttttttaaatcagcaatccgatagaaatgaatttgttggatgaagggaaaataccttttcaatcgtagttccaacatgctagtagaagctaatccacttggcgaaaatcctgcaatactgatattgctttctttcggacttcgttccaatgaattcgcaaaatgaaggaccatataagcgatctcttcttcggataattttttttcttgaaaaatccgctctactgctttacggattgcattcgcaacttcctcgtattgaaccatgattttttctaaaatcggattggtcagtgtctcttcttgtaaaacggctcttgaaaacacaccagataaatgagtcaacagcattttgtacaaagtttcatcttcataaaaatggacattcgtctcttcacttacttcttgaatcagttgttttactaaataagcaagctgtgtatcgaacgtctcttcaaagaaattctgatcaaatgagttcgtgaagtcatttaataatcctgcaaaaaagacgatctcatttactggataaagttgttttgtctcagaagcgatccgtgaaaacaatcgtttagctgtctgtagtaattctttgtttgccagaccattatatgtctcatttgtcagtaaatgatttttcgtcacacgctccatcgtcaatgtcagcatcaaaaccaaatgttcaagctttctatcacttagattggtctttttttggatcaattcttccccgattactttgcgtgcaagagatagatgttgcggatcaacgaatcgaaaaaaataattcagtgatgcatcgaaagaaatactatgaaaaagttcatattcattgatttctaattctaatacattcgcggtcagaagccggcggtatttttccggtccttcgatctcgtatccctggttccgaatgatttccaaaggcaattggcgaatactttcttccaactgtttgatatctgcataaaaagtggtattactgatgcgatatgattccatgaaatgagcaagactcaacggatctgtcgtcagtaacaactcggctaaaatcgcgtgttgtcgtttagcagtggataagtcattacttttcccatctgtattttcttttaattgctctaatacttcttctgatgcctcaatgacaaatgagcctctagctgcttttttcaaagaagcatttaccgatttcaatgagacttcaagattatctaattcgcggtaaacagtccgtttactgaccttcaataaattcatcattttttggatagatacaggtgacgggctactgagaaattctgctaataattgtttttctctgggcgataaatacatcttatatttctcccttcacgagtttttcgtattcattcgtagctacccaatgttcaactagaactagccgagggatcttttcttctagctgttcagttacagctagttctctttgtgcgatataaatcgtttcttcttggattttgattttttctattgattcttttgagataacaaactgttttttcgctttttttgctaattgacttaaaaccgtcatgcccatagtttgtgagccgcgtctgttgtttttatacaaaaatacaatattagcaggcgacgttttttgttctgtgatatctgctatctctttttttcttcccgctttggaaaatggatcgcttcttttattcgtgacagcaagatatctgtttccaaaaagtgatccagtacatagatttgactttgaggtactttttctcttgcaagatccgctagttcatgttgcacgataaccagctgatttacttggttattcaattcatagatagagctgtatccgacagaaagatcgattttttctgctgctaatttctttttcagcagggcggctcccatagcacttgatcccatacctgagtcgcaagcaaaaatgacggaatgaatgatagatggttccaagatttctcccctttctttgaccgttttgttctctttttctttatttggtaatttcaatagtatcgctgcacaaatgaaggtcacaaatgtactgattgctatccctatacttaccccagctagttgtggataaggcgcattggcaaaaatcacgagtagtgacccaggcgatacaggtgcagctaatcccgtatctaaccattgaaatatcaacgtgccgcttgccccaccagccattacagctaaaaatagatacggtcgcagcaagacaaatggaaaatagatttcgtgaatcccgccaatcgcatggatcatcaatgctccactcgcatttactttttcctgtttttctgcaaaacaaaggatagaaagtaagatccctaaaccaggtccaggatttgcctccatcaaaaataaggaagagtacccgactgtttgtgagaattcgattcctaaaggtgtcaatacaccatgattgattgcattattgaaaaatagtacttttagaggttctaagatcagactgacaagtggtaacagattcattgtgactagccaagacacaacggaggcgagcaacaagtgaacactatttaaaactggttcaataaaaacgattccaattatacaaataacgctaccagtcagtcctactagtaggttgctgacaagcatttcatatccagccttgaatttcacatggaatctagaaacaaattgttcatatacgatgccggcaagcggcccgataatcatcgctcctacgatttgtggagcattggaacgagcgatcaaccctaaagaagcaattgcaccggcgactgcccctttttgtccccctaccgatttcccgcctgaataactgatcaagatgggtaaaagcagctggatcatccaatggcatacctcttctaatgtggtgtgcaaatcgccagacacaccttttgttgctaatgacaagattccccaagcgataaacagacttagatttggcatgatcatttcatttaagtgatgtccagcttttctcagttgtttcatagacacgcgactgctgttgtttgctttccatttgtattccatctttttcaccatacttctatttattgatggacggattttatgtagaaaaagcagcaaacgaaaaaccgtctgctgctttcagctatctgggaactatttgcctggttcagacgcaatgattgctagttcaccttggaccgcccactcagaaacgccatttggaataatacagcttgttcctttttctaatggatatgtttttccgtcaacgacaaggtctcctgctccttcgattaccgtcatcaatgtataaggggcttgttttttgaaagatgtgattcctttaatatcccactcatatacattgaaaaactcagtttctaaataagtgacgatcgatgaattcccttttctgacttctttgatttgtaattctggtgttttcgcagggacagttgttacatcgatcgattgttggatatgcagctctcttgtttgtccttgcgcatcttttctgtcgtagtcatacacgcggtaagtcgtgtcagaactttgctgtgtttctaaaatcatgattcctttaccaatagcatggatcgttccgcttggtacataaaagaaatcaccttttttaactggtactttcttcaaaaggtcatcccagcgcccatctttgatcatctcagctagttcttctcttgtcttcgcatgatgaccatagatgatttctgcaccaggttcagcatcgatgatataccagcattcagtttttcctaattcaccttcatgtttcatcccataggcatcatctggatgtacttgtacagatagatcatcttctgcgtctaagatcttgatcaataatggaaacactggttctgaaggatggccaaacaattccttgtgttctgaccatagttcatctaatcttttccctttgaattcgccattttctactacactgacaccatgaggatgcgcactgatcgcccaatcttctccgattttatcgttagggatatcaaaaccgaagactgaacgtaaacggcttcctccccaaattttttcttgaaaaactggttttaaaaacataggttcctgcataattcaaactcctctcatttttcatagctattatagcattatttcggtaataccgctttctctttcaaaaagttttcaacaatttcatctcgacatatgagatactccgcacgatgatcgacaggatgtacgcgatttgacaaaaatatcaacgcttcttgtgtttttatatcaatcaagaaaaacgtacctgtataaccagtatgaaaaagaatcgcatgaccgtcttctacatctttttttaaatcccaccctagagaacgatagccatttttttctggagtgtggtcttgtagcaaagaatcaatcgtttcttcttctaaaaaccgaccattacggatttttcccttgttcaaatacatttggacaaaagtaatgctgtcgttcaaatcgataaagagcccagcattgcctgcatgttcagctaaaactcttgctttcggatcatgagtttgtccacgcaaaacctcacccgaaggcagttgttctgtgggaacgatttttttggaaggaaaaggaagaaataagctgttcatcattcctaatggttccaatacttgttcttggaaaatctctactgcaggttcttggtaaatttcctctagcatcaacccaagaagaatcgttccggcatctgtgtactttacttcttttcctaattgctcaccaggttctagcttcatataagcggcaatcaattcttcctgagatagctcatctctgtttggtatccatgttttgatatcagaagtatgtgtcagtaaatgacgcaaagtgattgtctgattttcaaattcaggaagatatttatgaagcggttgatcgagttctatctttccatcttctaatagacgcaaaactaatgaagtggttgcaacgactttcgtcagtgaggctgcatcaaacaacagattttctgtcatcagctgcttttcaggaacgacttgggcaaagccggctgtaaatgtttctacttgattttcttttatgaaggcgactgctacacctggataaaatccttcttccatctttttcaaaataagctgtttcgtgtgtggatacatctttttctcctgcttttctatcagattcttacagtccaagcttaaagcttaatctatgaggaatcaaccttttttacacaaaaaaactgcgcgaaaaaccgcgcagtttcctccggtatactattttctctttctatctctagaataagcgatagtatgaccgttcataaaatgacgagacatgcgacaatcgttaagaaagaaaaagttaagcgtcgcatcgaatgtcagttttattcttttcttttggctcactgacgaaccaccattcgattcctatagcatcatagattgtgagtactgtgtgctttttgtctaagaagaaatcaactgatagttgctgcaagtgagcaatcagtccttccatgctttcagtatcgatcatgaatttcagaaaatcaagtccaatcacttcatctgtaggcaaatcaattgcgcctccgctagcttctgtcaaaccaacatggaaatctccttcattcaatacatggatgccctcttcttcattatgtaccttcaaaccaagtacatgattaagaaattggcgttcttttgttaagttagtaacatttaaatggattttttcaaaataagaacctgttgatagtttactgaatttttcttcagattttcttaataatgcttcttgatccattgtttccggaatttctctttggtcgttcttattctcttcatggtaaatttccaattcattctcttctgggtctacgagcaaaatccccatacgtccatgatcttctaaagcttctttgattggataattcattttacggatacgacaaaggatatctgccatttcttctgtgctagggataatcaatgaaaaacggttcagctttttgatctcccccatgtgatcattcgctctaggactttcttccagcagcaacatttcacttccagcttcttctgttcctaaaatggctaattcgttttcttctcttttcaaatcaaagccaacaacgttcttgtaaaaatcaatcattttatctcggtctttcacccgaatggctacactttttaaataggtggcagcccccaattgaaaatctttcatatttcttgctcccctctacgtcaagctttattttaacgatggattcttcttctttcaagcaataactttgattttgttaaaaaaaatgtgagaaaattcgcattttgcttgttttttgtaaattaatgagtaaaaactcttataaaaagaggttgtgaaaaagctgttctgcatcacaagtaataagaacagccaaacaaaaatagctcctcctatttttcgtttggttgggcttattaccgcagatgcaagcttttgaacaccgtttaaggaagaggttgtaaaatcagcggtttgacctgagtattagagaaacaaaacggaaaaatagctcctcatattttgccgttttttgagctaataccgagggacagctgattgaacaccgtttaaggaagaggttgtaaaatcagcggtttgacctgagtattagagaaacaaaacggaaaaataacttctaatattttgccgttttttgagctaataccgagggacagctgattgaacaccgtttattcggaaaaagggactgtgacacgacttttgtcacagcccctaaaaaaataataaatttgtactattctatgaagcttcttcttcagaaaactgactgttataaagatctgcatagaatccgtctttttccatcaatgtatcgtggtttcctgtttctacgatcgaaccatgattcatcacaataatgttgtctgcatcgcgtattgtagacaagcggtgagcaacaacgaaacttgtccggttttccaataggcggttcatcgctttttgaatcagtatttctgttcgtgtatctacactagatgttgcttcatcaaggatcaggacatccggatttgctaagaatgctcgcgcaattgtgattagctgacgctgcccttgcgaaatattgcttgcatcctcgtttaatacagtgttatatccttctggcaatttacgaacaaaatcgtctacgtgagcagctttagcagcctcaatgatttgttcgtctgttgcatcgtcgttcccatatttgatattgtcatagatacttcctgtaaacagccaagtatcttgcagtaccattgaaaactgtgcgcgcaattcatcacgtgaaagatcacgggtatctacaccctcgtaacgaatactacctccagaaacatcgtagaaccgttcaagaaggttgatcagtgtcgtcttccctgcaccagtcggacctacaatagcgaccatctcaccaggtttgacatccaagttaaaatcagtcattagcaagttatctggtgtgtagccgaattgaacattttcaaaacgaactttgtatggtgtatctttttcttctggaaggccagatttttcattggacatctcttcttcatccaacacttcaaatacccgttcggctgaagcaactgttgattggatagtgttcatcaaacttgcaagttgagtgattggttgagagaactgtgttgtatattgcaagaacgcttgaacatcccctaatgtcatgttcccatttgcaacttttaatccgcctagtacagcgacgaacacatagcctagatttttaacgaaattcatcaacggcatgatgattgccgaaataaattgagctttccaaccagcggcatacagattctgattttctttttcaaatacttcctggtctttttcagtatgattgaatgttttaacaatggtatgaccaccatatgtttcttctacttggttattcaataaacctaaacttttttgctgatctgcgaaaaacacttgtgatttcggcgctacgatcatcacgatgatcaagcttaaagggatcatcaataacgcgactaacgtcaattgccagctgattgaaagcatcatcacgatgaccccaatcaatgtgactgcactagttacaaattgagtcaaattttgctgcagcgtgcttgcgatgttatccatatcattgattgctcgagacatgatatccccatttgtatgtgtatcataataggaaatcggtacacgattcattttggcttccaaatcatgacgtaattcataaactgttcgttgggaaacacgtgtcataataaattgctgtaaaaagttgaatacagcagaaatcaaatacatcacgattactgtcgcaatgatctgcgcgattttatcaaagtctatcggaaattttgttacttgttggccttgttgcatctgttgagcgccagccattacacctttgaatatttctgtggttgctttccccaagacctttggtgtttggatttggaagatcacggctgctattgctagtacaaatacagcgatgatcgcaaccatacgtttagacatatagccaaacaatcggcgtaccgttccccagaaatttttaggcttttcaccttttacaccgagatttctgccaggtccaccatgtcctggaccgcctgctggtccatgagagggacgtgtgtttgttttactcatgctaagtcctcctctcttagttgtgaatgaacgatttcttgataagtttcgtttgttgctaatagttcttcatgtgttcctttgccaaccagttttccttcatctagcacaaggatcatatctgcatccattactgtacttactcgttgagcaactaaaacggtgatactttctttcatattcgttttcaatgcttggcgaagattggcatccgttttgaaatccaacgctgagaaggaatcatcaaacacatagatatctgctgttttgactaatgcccgtgcaattgccagacgctgtctttgtccaccagagaagtttcctcctccttgttccacatggctatctaagccatcttccatctctgaaacaaaatctttagcttgtgcgatttctaatgctttccaaatcatttcatctgttgcatccggcttaccatactgcatattgtctcggatcgttccagagaacagaactgctttttgaggaacaaagcccattaattctcgcaaattatattgagtcatgtcactaatgtccgttccatttatttggatcgaaccagattcgatgtcatataatcgagggatcaaattgactaaggtcgttttacctgaaccagtcccccctatgattgcgacgatctcgcccgacttggcttggaaatcaatatcttccaatgcaagtttttctgctccatgatatcgataattgacatgattgaaggccaatgttgcgttttttccagcaaaagaaactgttttaggattttcagggtcatggataccgattttttcatccaacacttcattaatacgatcagctgaagcttgtgcacgaggcaccatgataaaaatagcggaaagcatcataaagctgatcaagatctgcatcgcataagtcataaatgcaatcagattaccgacttccaaagtcatatctgctatgtagtgtccaccaaaccaagtgattgctacgtttgtaccgctcatgatcaatgtcatcatcggcatcatcaatgcgacgatcgtattaactttgattgccgtatttgtataatctttattcgctaaatcaaaacgattttcttcaaagcgtgtcttatcgaatgctcgaatcactctgacccctgtcaatccttctcgaaataccaggtttaaacggtcagttttcttttgcatacttttgaataatggaacagcaaagtacatgattccgccgatcaaaataatcattactgggatgacaactaagaagatttttgtcaactgatgatctttttgataagcaagtatgctcgcgccaatcaacgtgattggtgcattgatcatcatacgtaaaaacatttgtgtaaccatttggatttgagtcacatcattggtcgttcttgtgatcaaagaggccgttccatatttatcaaacgcatcttttgtcagactctctgattttttatagacatccgtacgcaattgcttacccagtttctgtgattcacgagtagcaaaaaatgtatttgcgatagcagctaagatactgatcaaagaaaagccgatcatcacaaaacctgtatgccaaatataatcgacatctccttgcgctacccctttatcaataatattggaggtaagtgtcggcaaatataaatctgccagtacttggatcaccatgaaaactgcagctgcaattgctgaagtcaaggagatccgttttacgatttttagcatctagttcccttctttctatttatatactccgtttttcagccaagaaagtttcaaattgaattcactgattgcttgctctactgagtaatcttcagatgttgaaaataagcgatacgaatgcgcaattgttgtaaatacagtattcatcactaattggatcagtaattccaattcatgatcattttttactttcagcttcgtccgatcaatcaattcaagcaactcttttgcatcttgtttgtgttctttatgtggatcgtgaggcgttttttggcgactcgtatgaggagcgacttttcttgaggcacggtaatccatgttcataaacaaattacgataaaaagaagcattctcgccttccaaaatctcataaatcattttagaaaaataggattcgaatcctttgaatagatcaccatcggattctttcattagttgtaacatatctttagagctgtcacgtctcattgtctcaaagtaataaaaataaagatcctctttatcttcaaaatactgatagaaactgcctctagggatatccgctaatttgacgatattagcaatcgaggcttctttcaaaggtactctagaaaactcgattctcgcagcctcgattagtcttttttgtttttctttaggcaaatggaaaaatgtctgtgtcggcatatggatcctcctttctttcaagatgacacattgtcatatgacgctatgtcattataacacctcctacctgttttgcaagacatttgcatagtttttttcattattatccgatacattaaaaaagtgataagaggaatccttccatttgaattaatgagagttgcccattaaaatagccacatactaaacaaaggatgagataaatggcccaatcaattagtgtccaagacttcaataaattgccgctcgatgctgacagcatcgttttagatacaagaaataccttagattacacaaaaaaccacttaagccactcgctttctatccccgctgctatcttgccaagacaattaaaaaatctagatccaaaaaaactttattatattctaagctacacaggcagacgatcagaagcattagccgatcaacttactgctagcggatttcgtgctgtttatatcattggcgggatggaagctcttcagtcaagcgttgcttgaacattgcttgctagattcaaaagaggctgtgacaaaaatcgtgtcacaacctcttttatatcctgtctttttttagttatttattcttcaaccttatcaatatgacttgatagccttttctttttcgagtaaactgattttgttagtcatagttataacaatcatagcaataaaaggagaaggtaagcatatggcatctgttttagtagtcaaaggtcatcccctaactgcagaagaatcgcgcacagttaaggcattgacgtcttttttaacaagttataaagaaaatcatccagatgatgaagtgactgttttggaactttatcgcgatgatattccggaaatcgatgaagaattattatcaggttgggaagcattacgtgctggtgcagaattcacttccttatcagaaagtcaacaacaaaaaattgctcgtttcaatgaattgactgatcagttccttgctgctgataaaatcgttatcgcaaacgccttatggaatctaaatatcccaacaaaattaaaagcttggttcgataccgtcaatgtagctggaaaaacgttccgctatacagaaaacgggccagaaggattagtgacaggtaaaaaagcactgcacatccaatctaatggcggtgtatacaacggacaagactttgcctctcaatatgtaaaaggtattttaaactttgtaggcatcgatcaagtagatcagctattcatcgaaggaatcgattatgaccctgaccgtgcagatgagttgatgcaaaatgcattagataaagctgctgctttaggtaaatcattttaaaaattgagataaatgcatacaaaagagacagaggaaaaaatcttcaaagcagcatttgtgccttggatattttcccatctgtctctttttgttattctttctgctttttcaacggattttcttcataaagagaagagattgttgtgtaccattcaaaaacatgagtaatcactactttagctgctgcataaacaggaatccccaagatcacaccgatgattccgaacaatttcccagaagtcagcagaactaataaaatcgttactggatggattgctaactgattccctagtactaatggagagatcaagcgtccttctattgtctgctctactgcaaaaacgatcagtactttgatgatcatgaatggacctgctacaatggctaaaaagatagccggaatcatcgctaaaaatgatcctaagtaagggatcaggttcaaaaaacccgcaataatccccaacgtgacagcatactctaaaccaatgaccgcaaaaccgatcataaacatgattgccacagcaaaagccacagttagttgtcctcttatataagaagaaacttgactattcatttcactcagcacattcaacgtcggtttttgcatgcgtgtcggtaaaaatttgacaaaataaggtgctaattgtttaccgtctttcaatagataaaataagataaacggcatcgtcagcagagccactaaaatagtcgctaccgcgccgacaaaacttccaagactctgaactgtactcttagatatatcttggatcatatcgcctgccgaattcatgaacttatcacctgctgtttccaactgttcgcgaaattggttgaacagcgggtcccgcaaaatctcggttaatttattatcaatcgtatctacatattgagggaagttactgatgaagctcactgtttgttcctgaatcttagggatgatcactacgctcccccatgcgattagtgcaacaaccaaaacaaacagcccaatgatactgtaaagccttggtacttttcgcttttcaaagtaatcaactaccggattcatcaagtaatacaagattcctgctaaaatgataggcagacctacgattgctaaaaattgccagattggtgcaaacaaatatgaaacttttgtaaataaaaagacgatcagcaatattaacaatacaacaagtaaggctgtgactacttgattatttaaaaaccagcgccaaaaccacgacaccggtctgttcttcttattttttccttccataattcctcctgttagttataaaaaatttggcttcccaaaccaatagcaggcagtctatgcggatgaagatagattccatttgcaatttgtccttcttctggacaagcatcaaaaatcaatgatacgtgagctactgtctctaaattcccattggccatcggaccgacataatcgatcgtatatacctgatcatcaaaagcaattgttccgcctgctttcaaagaaaaaggttcgtcttttgatacttcttgaatcaccgaatattttcgtaaggcagctgttgctgttttatcgaacaaaatcagcatgggttcttccttgtttattgcttctgtcccaatttctgtaatctttgcctgaatcattgcactctctcctttaattgctttcaaaaacagtataacacattctcattctttagccgtgtggaataattatgtgatagaataaaaacgaaaactatttcattacaattaggaggaatcagctcatatgatcgaaaagataattttaggaacctatacgcgtcgcgaaagtaaaggaatctatacgatcgaccttgatacagaaaaagaagaattagccaacctttcattagctgttgaagaaaatagccctacctatgtagcaaaaagtaaagctggcaatctttacacagttactagtgtggatggattaggtggtgccggtgcgtacgataaggattttcattttttgaatgcggtaacagagtctggcgctcctttgtgttatgtagcggttgatgaagcacgtcaattactatacggggcgaactatcataaaggtgaagtaaatgtctaccatatattaggagatggcgaactgaaagcagcagattcaatattccatcaagaagcgacaggtcctcataaaaaccaagatcatgcgcatgtccactatacggatctgactcctgaccaacgattagtcgtatgtgatcttggtacagatcgtgtgtatacttatgatgtgtccgaaaacggcaaattgaatcttgtaactaccttcactgcagagccaggaacaggccctcgccatcttgtctttcatccaaatggacaattcgcttatttatttggtgaattagacagcacagtccgcgtgctttcttataataaagaaacaggtgcttttgaagaattacagaaaatatcgaccttgccagaagaattcgacggtgaaaatggaggggcagctatccgcatttcaaatgatggcaagttcctttatgcttctaaccgaggacataactcgattgctgtattcgcagtttttgaagatggttcccacattcaaaacaagcaaatcatctcaacagaaggggattttccccgcgatttcgcactagatccaagcaataattttgtcgtgtgtgccaatcagaataccgataatctgacattatatcgccgtcatcctgaaacaggattactggaattactgaaaaaagatgtctatgcaccagaatgtgtctgtgtttattttgatcgttagtaagaaaaggagaatgaaatgaatcagcaagacgtattagacagactacgggaagaactaaatattcctttctttgatgggaaaatcgaagataaagagtatagcgaagaggaatatcagaaactcaaagccgatttacagaactactttgaacaatatgtacagaatgtagaaaactaatcagctttccatactatctgaaaagaacatcaggacaagacttttccgtctatcctgatgttcttttctacaaataaaaaaccgccgagatggttagactcgacagaaaaggagtatttactcgattttgagtaagtacaaggttgttgttggttataggtatgtcattatcataaaggattttgatcactctatcataaaggtaatattacatttatattagataactctagtttttattgttatcaaagatttcttttattttttcaacaacaaattagtcattttttggatggcagctgtcaattggtctgtcgcttggtcttgttttgcttcagatgtattgaatagatcttcatctacccctgattcaagatcgatactttggatcatttcttcacagcctgctacatatgaaagataagctttttcaaaatttttatgaatgcccattgcttttgctggtggacgcaaagtactgactttcttaagcattgcccgatatttttttgttccttcttcaaataacaggatgatctcttcaagagtcgatttgtccagttcacttgtttttccttcatcaattgcgtttctgatcacttcatatttcggatgcattccttctccgattgcttctgtttccttgacgatttgatcgatggactgcacataatagccaatattcggtaacatgttcgttttcctactttctccattgttgttattatttattctacttgtttttatcctcaaatgacaagtacttgaaaaaatttaatggtttctatacagctcgccattcttattcgtgctcaaagaaaccatctgctaaactatattgtttccctgcgacaatgtcatattggatcaattgatattcgtcgtaaatctcttgttgcgagcgattgaattgcgcttctttataccactgtccgttttgatagtacagttctcgttcaaacgccggaagttcctgttctaatgataaaagcagctgataaaagccatttgttgtctgattcgtctgttccattagattcgctgcaaaataaaacggactggtgattgcatcgtgagtcgtttgcttttctaattctcctttactgtcgaacataagaaattgtgtttcatgcaatgtttgtttgtcattttttgcttggatcgtatctgaatagatccctggaagatgatccccccaaaaaacaactaaagtccttctagaaagattcttcaattcttccgtgaactgcttcagtgccgtgctgctataggaaatatcttgcagataattctctaagtcaagtgtcccacttccatctgaagtttttgcaggatagtctagattatcatactttccatcgtagggcatatgtgtctgcatcgtgactaaatgaatgaactgaggtgttttttcttccttgagaagtgtcattacttctttgtaagctgactcatcagaaatatatggattattctctatcgtatccgtataggtcatcgtacgctcgctgatgaactggtcaaatcctaatgtctgataaacatcctctcttttatacatcgaagtattgtatggatggatcgctgtcgtctggtatgattgtgcgtttaacgctgaaacgatagaaggaagctgatccatttttggtacaagcatcgtgtaaggggtggtgagttgcgcattaaataacgccatagaaaaaccagtcaatgcttcaaattcgatatttgctgttccaccgccatagttttgagaaagcatattgccactatatgtttgatcagctacttcataataatctgccaatggctcaccagatacttctacgccgtttaatcgactaggatctgagaaactttcactcatcacgaacacgatgttcggcgactcttcctctacagttttatttttttcatcggctagcttctggtatttttcagtgatttctttgatcttttctttcgaatatccttcaggttcatccattggttctaccttcagattgtacaaaaacccaccgataaaaccagtgttatagtagttcattttctggctgtaaggtatccatagtgccgttttattatatgcttttcgcaacaaattatcgggattgttgaaattactgatataccctagcagtccaattgccacaagcagtgtcgttaatcggatcaattggaatcgccttccttttttcaggcttcgaaacatgtaccagcaaaacaatcctagcacggttcctgcggcagctaagatcactgtaaacagcatagtgccggttatatctttcagcaatccgatttcagtgatcatcttcaaatcgtctggataaatcggttcttgccgataactcattttcatataatttgcaaaacctaatacaccgatggctacgacatacgtaagggaacctaaagggacagatcctgctagtgcaatcagaaaaataagaatgatcagcaagacgagacaggctaagaagaatttttccgtatgccaagaaaaagcaaatttcaacgcaaggtctacggatagatcattttgacaccactgcaaaaataaattactaaaaacaacaagaaaaaagatactgatgattgctgctgttccttttaaaatctttttctgtttggtcgaaagtctgcttatatatcttttcaaatgcttgctccttcatttctatcaataaaagaatgttgcttctcttattttagttgtacaaaattcgaaagtaaagaacggaaagaagaattaatgaaatccaaatattctctttctttatggcctttctggtttctttaataagcggacctttcgtactccagaaattttttctagctgttgtttcacttgattgagctgttcaaaatcagtactgtctatgtcaatcaatatgtagacatgctcattcttatggttacgcgatatatctgcgatcgctagctcgttctcatttagcagagaaaatatctctgctaatatattggttttcttttgataaaatatagtgaatcgaaacggcgcttggaaaaacattcgtgcggatggataattgaccgcttctctaaccgtaccgaacaaaagataatcttttaaggcttcaactgccaaacgtccgctgtctgccaaagcttcctgagtcgatccccctagatgaggcaacataagtatacggtcattttctaagaactcttcttctggaaaatcagtcacgtatttagccagatgttgtttttccaatgcttgcataacagcatatttatcaacaatttcacttcttcctacattgataagtacagcatcttttttcattttttctatattcgcctgatcgatcaatccttttgtatcttctgtcaacggcagcatgactacgatgtaatccgaggtagaaagaactgtttctaaatctgcttgccgaacataatccaactgggcatcgcggatagaataacccaagacatccatccctaagctatagcaacttagcgctacttttgtgcctatcgctccaagaccaagaagaccgatggctttgccttgcaattctcgtcccacataagcacttcttttgttttctgcctgttctaaaatattaggacctgttagtgtttgtaccatacgacttgcttcgattatcggacgggaagataagagcaaacagcacaaaacaagctcttttactgcattagcatttacacctggtgtattcatgacgatcgtcccgttttcagaagctttttcaacgttgatcgtgttcaccccaacaccagctcttgaaattgctagcaaatctggtgtaagccattcatctttcactttcgtactacgaataactattccttcggctggcaaatcatctattattttgaaatattccccttgtaacttttctatctcttgttctggaatagcatcaatcaaatgaacgtgatacataaaaccccctccttactaacaagtatctcgaaatttctgcaattagacaactgtttaccatttgacttcctagaagcaaaaagagcagttagagcagagtaggcttagtgataaaaataaggctatgacaagttactgccataagccttattttcgagagcaaaatattgagggtgagatatcttgataaatggtgttccgttagctgacattgataataagactaaatttcaaaaaagttgaaaagcaaatttcgtcaatctcttcttatttcttaaaactaagcggctttttcacaacctctttttatctaataaccactgtttccaactcaactaattttgcccacgtttcaatttgatctgttgttagatttagcgagacaacggtatgatgaccgccacctgcctgaatccatgaatggacaccttcatggaaattcggtttagttttccataacacacgtgcaacaggtaaattaggtgcttcagtcgttggttcaaaggcatctacttcattgatcagcagtttataatgcgtaccgaaatctgccatcgatacgactaccccttctcctgctttcccatcaaatacaagacgcgccggatcttctctatctcccattgataaaggagaaacaacgattcttggtttcgtcgcagcaagcgtcggatctacttccatcatatgggattccaagattgcttcttggccactagctagctcgtaagtataatcttccatgaatcctgtatctttccctcgagccatgattttcagcaaccgatcaatcgctgcagttttccagtcgccttccccggcaaaaccgtatccttctgccatcaaacgttgtacagctagtccaggtagttgtttcattccatacaggtcttcaaaattagtcgtaaaagcgttatagcctccttcttctaagaaacggcgaataccgatttcctgctgagcttgtacttttacatgttcctcccatgtcttttcttcataatcaccatagtcgaaggtatacaattccttgtactcttcaaataattgatcgacttcttcgtctgatacgcgatcgattacttgtacaagatctccgataccaaaataatcaacagtccaaccaaattgaatctgtgcttccactttgtctccttctgtgacacccacgtttctcatgttgtcaccaaaacgagccacttttattccaaaactttcattataggctactgcaacatccatccaatcagcaatctctttttggatctcaggtcgtttccagtagccaacgacgattttattttgtttatttaatcgagcattgatgaacccatattcgcggtcgccatgagcagattgatttaaattcatgaaatccatatcgattgttttccaaggaatgctttcgttatattgcgtagctaaatgaagcaatggtttttgtagaagctttgtcccgcggatccacatttttgctggtgagaaagtatgcatccaagtgatcacacctgctacttcttctcgataattgacctctttcatgatttttgtgatcgtatcagcagtaactgctaattcttgaaggcggattggataaggcaattggccattttcattcagttcatcgaccatttcttgtgcatgtttctttacttctcgcagtgcttcttccccatataaatgctgtgatcctacaacaaaccaaaattctttttctccaatattcaacataattagccactccttttatttgttttgtccgtaatacgcattttttccgtgttttcgtaaataatgtttatctaaaatccgttgaggcagctcttctgaaaatgaattgagctgtctggtaaataaattcatcttgcatacttcatctagtacgactgcgttcattaccgcactttgcgcatctttcccccaagtaaatggaccgtgtccgtgtaaaagtacccctggaattgctaagggatcaattttgcgttctttgaatgtttctatgataacttttcctgtttcatattcgtacccgctgtcgatttcctgttgtgtcaaaaatcgagcacaaggtaccgatccataaaaagtatctgcatgcgtcgtccccatcgcaggaacatccaatcctgcttgtgcccagatcgtcgcccatgtcgagtgagtatggacgattcctccgagttgaggaaatgaacgatataaaacagcatgagtaggcgtatccgaagagggattgagtttaccttcaatgatatgattgtccaagtccacaacgaccatgtcgtctgctgtcatctcttcataactgactccgctaggtttgataacgaaatatcgtgtttcaggatcaaaagcgctcacatttccccatgtatatttgacgagtccatgtttaggcaagtcaagatttgcttgatacacttcttctttcagttgttccagcattttctatcactcctttttcttgcaattgatgaatcgctgttttttcaatgtcgatcccctcacggtaacgtctcataaatatctgatagcctgctatttcttctgctgaaggtgtgatggtgattccttggtcttgtccaaacacgtcttctgccaagaagttttctaaagacttcccatgtcgatccatcatataggctgctaataacgcgattccccacgctccaccttctccggctgtgtccatcactgtaactggtgcctccatagcagatgctagaatccgctgtccaacttctggtgttttaaaaatccccccatgccccactaaacgatcaatttggacattctcagatttcaatatatccattccgattctcattgcaccaaaagcactggctaaatggatccgcatgaaattcgctaaatcaaaacggctacctggtgtacgtacaaataatggccttccttcatttactcctgtaatgttttctccagaaaaataaccataagaaagtaatcccccgcaatccgtatcgccttctagcgctttgttgaataataccgtgaataatttatctctgcttatctccatacccaaagaattggtaaattcttcaaaaatactgacccaagcattgatatccgaagagcagttattcgtatgaaccatgcctactagttctcctgaaggtgtagtgaccatgtcgatttccggatggacattttctagttctttttctaatacgatcatagcgaaggcggaagtaccagccgaaatgttccctgtccgtttggctacactgttcgtagcgaccataccggttcctgcatccccttctggcggacaaaccgggattcctggtctcaaatttcccgtagggtcgatcagataagcccctgattcgcttaacttgccagcttcttctcctgctactagaactttaggcaaaatgtgatccaagtcaatcgctacgtgcgctttttcgactaactgaccaaaaatatttttcatttcttgatggtaggttttcgttgaaggatcgataggaaacatgcctgatgcatctcctacgcctagtactttctcaccagtaagctgccaatggacatagcctgcaagcgttgtcaaaaaattaatttctttcacatgttcttctttattcaaaatagattgatacaaatgagcgatactccatctctgcggaatattgtattgaaatttttccgttaatattcgttctgcttcttcagtgattgtatttcgccaagtacgaaatggtactagtaactgttccttgctatcaaatgctagataaccgtgcatcattgcactgaacccaatcgacccgattgtcgtaagattctcgccatagatttcgaatacttctgctgccatttttcggtaactgacgcgcagtcctttccaaatatcttctaatgaataggtccagataccattttctagtttgttttcccactcataactaccagcggcaataggagtaaaagatgaatcaatcaatacagctttgatcctagttgatccaaactcaatccctaaagatgtacgaccatctatgacatctaacatactttgcgcatttacttccttcataatgatttaactccctccttctcgtcaaacctgatcaaaccgtctttttagtagcgcttacaatgattattgtatacttttgtacgtacatgtcaagcggttatttacaagaatacaataaaaaacacttgttttgtacgtacataagttataaaatgaaattgcttacaaaatctgatcaaccgccttctcgaaattctagaaggagagaatacttatgaaaaaagaaaaaaaagtttcctcatcgtttatttatttttttggcgcatttggcggcattctatttggatatgatattggtgttatgaccggcgccttaccttttttacagcatgattggggtttggcaggtaaagcttctttgataggatggatcacgtcttcggtcatgttaggtgcgatccttggcggctctttatctggtcttctttctgataagcttggacgacgaaaaatgattcttctttctgcacttatttttatggctggttctgtcctttctgcatctgcccctcacaatggttcttattttctgattgcagcaaggattcttctaggtttagctgttggcgctgcatctgccctagttcctgcttatatgtctgaaatggctcctgctagactaaggggaagattgtcagggatcaatcaagtgatgattgcttctggcatgctcctttcctatgttgcagattatttgctaaaagggttgtctgaaacgatggcttggcgcgtgatgttagggctcgctgctgtccccgcgctgattttatttttcggtgttttagctctaccagagtcaccgcgttttcttatgcaatctggccgcttggaagaggcaaaaagagtattgaactatattcggacaccaaaagaagctgaacaggaattcgaacaaatccagctgaatgtcaaacaagaaaagacaaccggaacttcttggcatactttgtttttagaaaaatatcgttccttagtcattgccggtattggtgtagcagtattccagcaatttcaaggagctaatgctattttttactatattccgctaatcgtagaaaaagcgactgggcacgcggcgagcgatgcattgatgtggccgatcatccaaggaatcattttagttgctggttctttgctctttttggttattgcagacaagttcaatcggcgaactttattgaaaataggcggtagcgtgatgggactttctttcatcctaccagctgttttaggaactgtactggatgctcatacaaattcgttgttgattctcttgtttttatgtatttatgtcgcattttattcttgcacatgggctccactgacatgggtaatcgtaggcgaaatattcccactagctgtccgcgggcgagcatctggcctagcctcttcttttaattggattggttctttcctagttggcttgctttttcctgtgatgactgcttctatgtctcaagaaatcgttttcggcatttttgggatcatctgctttttaggggttttatttattcaagagatcgtaccagaaactcgtgggaaatctttagaggaaatcgaacaaagtgcatctaaaaaaacttatcctaaacgtatttctatccatcattcttaaagaggttgtgacagaagtggtcagcttcaagaaataagaaggaaccgcttagtttcgagtcacaaggaacaatttcaaaaaacagcttctcatgtttgatgaatattgtgacttgtgaccagttggtaggagaacaccgtttagtggagaggtggtgaaagaaacgttcagccttgagcgatgacaaaagctctcacaaacattgcgacgagtaaccgtaggagcaataagaggcggtaaaaacccgtctcttatttttcgttttctttcactgtttcccgttcaactagtacaggttcataaagaatattcggctgtgcctgtcctttttcaatcgttgtgacgatccaccgtgcggcatcttgtcccaacttttcttttggatgtgtcaatgttgtcaattttttatttcctaaatggcttaaagaagaatcgtctgttcctacgatggatagatcatctggaatttgatagccattttctgtcagcttatctagcaataaactagctatttggtcgttatagcaaatgatgccatctaaagcttgttcttctttcaaccgttgtactgttttttcagcgattgtttctcgtgtttccgtggtgaaagtaatgatatcttccatcaaaaaacgcacattatactgttcacacgcgctgataaaacctttcatcctgtattttccttgaagatcgtcgatttttgtgatgaacaacagacgctgatgtcctttttttatcaaatattctgctgccataaaaccgactttcacatcatctaaacaaatataagaggcatttaactcttcataagcagcattgatcatcaccatcggaatgccttgttctctcaaagcaacataaagtgctaagtttgggttatactgattacttttcgtaggctcaacgatcaaaccatctaccccataagcaatcattttcttcaaacactctttttccaattcgtgatcgttattcgtactggctaaaagcaatgaatacccagactctcgtaattcattttcgattcctcggataatcgacggaaaaatataatcagagagatatgtggtgatgacaccgatcgtttttgttctgttcaatggtgttttttctatcttatagctgtcatctacatatgtgcccgaccctttttctttacgcagatagccctcatttaccaacacagcgattgcttgccgaatcgtatgtctgctgacgtcatatatttcttgcagcttgaattctgagggaatggttgtatttacttcgtattcctcacgaaggatcttttgttttatctcttctgcaatgtcttgatattttgccatttgccttgcccctttttatttgtacgtacatatatcataacgagtctgcaaggtttattcaagcaaaaatcaaggtttcttgtgctcataaggcatacggaacaggttcaccaaattctggaaatccttgctcattccacgtaaagcattgcgcgttcgcgtgccgattgggattgtctaacggatcccctttttggttcttctctggtcgagcatgatagatcaaaatatcaaagcacccatcttctgaaaccgtaaacgagttgtgaccaggaccaaattgcttatttttttcagaagaaacgaatactggctccgataatttatgccatgattcttttaataaaagattcttgtgctcatcagcccacagcaggcccatggcatagttttcatctgttgcactaccagaatacgtaatgaatattttcccattgcgagtaaggactgctggaccttcatttactgaaaaaccccgtttttcccattcatactcaggtatagaaaggaggatctgcttcccctttaacgtccaaggattatccatttcggatagataaagattagaattcccagtaatttcaagatcttgttgggcccacacataatatagctttccttgggaagagaaagttgttccgtctaaactgaaagtttcccttttcgtttttatttgtcccttttctatccaatctgtattcattggatctatatgctgattttcaagtacgaacatgcggtgatgatgagattcatcacgtatagttttatgattgcttgcagcaaagtaaatataccattttccattgatataatggacttcaggtgcccagatcaattcactcatcggtccttcttcatgagcctgccatacaatcaggctttcagcatgttctaattcattcagtgactttgcccttcttaattcaatcacttggtagcctggaaccgatcctgtaaaataataataaccatctgtatgtttatatacccaaggatctgcccgttgccgaacgataggattattataaagtgtcttcatcataacaaatttcctcacattttctttattctaattacattccaagagtatttttctatccctacatttaattcgtcatgtttttctattgaaaaatagtttatttcaggttttattttttctggttcttcacgtgtatttttgtccaacagatcgctactggttaatgtgtagtgctctccttgatctagcaaattgaaatcatgttcaatcgttatcttttgttgttcatttgtgcgattgatcaagaaaatagtcagctgattgccgttatctacgatcacactgtccacataaggaacattttttatcttttcacaatcataaacagggcaaatgatttgttgttccaatacttgacctttagcatatttcgataagtgttgcatcacataataagttggattcctccatgcttgtcctttagcatctgtcagtattaaaggtattgtgtttactaacaatgattgacaactaatctttacgcgatctgcgtgtcgtaaaatagccagccctaatgaaccaaataataatgtatcttccatagtaaagtaacaccaatcgatgggactaccgacttcaaaatccctatgtcttttttccggttgggcatgtacattccattcatcaaacgctagatacattgttttctcacttctcaaatatccttttacataatcacaagtagcaacgatttcttcaatttgacgatcgaatcgataagcttttgcaaggtatgtcgctgtatcatcacgctcatttttaggaggtttagtcaagtcttcttcatcatacttatcaatatagttatgcaaagctaaataatctacattctcataagcttcttctaatgcgatacgatcccattcagggtacgatggtaaacgtggcgtagagcttccaactaagattgtttcaattgaatcatccactaacttcatgacttttgaggcttcatttgctaacctaccatattcataagcactcttagcccccacttgccatggcccgtctagctcattccctaaacaccataatttaacgccaaaaggctttttttgcccattttttattcttaaatcactccagaaggttcattttggaaaattacaatattctactaaattttttgcttcatcaattccttttgttcctaaattcaccgtgaatatcggtttcgcttgtacatgactgatccatttaaaaaattcgtggagtccaaaagaatttggttctatacctcgccatgctaaatcaattttttttggtcgttgttctttcctacctacagtatccacccaatcataaccagatgtaaagtttcctccaggatagcgaatgacacctaattctaattcctttacataagagaggacatcttgtctaaacccgtcaccatcagctgtttcatggcccggttcataaatccctgtatagacgacacttcccatatgctcaacaaatgagccaaacagccgagaactgatctctcctaccgtaaaatcctctctgatttttactttcacttcttcgtccaacagctttccctacctttcatttcctatagtcaagataatagatacaagtttccatacgccaccagcaaagataaaaataaaaggagggaaaagaaatatgagcagtacaaatcctaataacaatacgcaacaaagaatatttctcaaaaaatcaaaaaatactttccatgcactttgttcaaaaatttgtaaaaatgtgatatctttgttttcagaaatcacatatatccaggataaaagaaacatggaataaataagtgaaactacatatccactaattgaaagtacgattgtctgttcttctaataattgattaacaagaaaataaataatgatcgttaacagactaaggaacaagttcttaccaaaatgttgctttattccttgaaagaaaaaataaatgatatttcctgatccctcacctttccattgcgccattacataaaaaacagcacatgtagcaggcacgatagtaataacaggcaaacacacgattacccagagaatacctaataagatgtaatcagaaaccacaatcaactgtccataaaatttagtctcaactattttcatcttcctcactctttcattccagacatagctgttccttgaacaaaatatttctgtgcaaaaatataaaccactagtaatggcagcattgaaataaccgttccagccattacaggtccataaaaagaaatgttctgccccgtaaataaagctaaccctgctggtaaagttctcatttttgaactacttgtcaatatcaatggataaagcaagtcattccaactattcatcagcgtgaaaatccctaatgataaaagagtaggtttgctcaatggcaacatgattttcaaaaaaatattaaactcacttaatccatcaatgcgtgctgcctcttccaaagaatctggtaaagtaataaaaaaggaacgcatcatgaagataccaaatgcagttgtcatacgaggaatgatcaaacctgcataagtatcaagcatgccaagcaaattgacttcaataaatagaggaatcatgaagacttggaatgggatcatcattgtcagcaaaacgaaatagaacaaaactgattttcctttgaaacgcatacgagcaaatgcataccccgcaagagaatcaaagaatacagaagtgatcactgtccctccagcaaaaatcactgtatttttgatgtaatctaataaagggatcgttgtccaaaccttaatatagttatctagggtatagctatctgcaaatattctaggcggaaatgagataatgtctttttcgtgtttaaaagaagaaataatcagccacaaaaaaggaaacgcaataaccaacaatataactagcatactaatcgttcgaatgatttttttaccactaactgcttttcgactattcacagtaactgtaatcgagctttctggtgccatacaggtttccctcctatttcatttgtttttctttccgtgacatgtacacattagtggagatagctatagttgcaacaatgataaacaaaaccgaagacagtgctgatgcatagcccaattcataaggtgctgtaaatcctcgactgtaaatatattgaacagctgtttctgtcttaaattgtgggccaccagcggttgcaacatatacttggtcaaacacttgcatcgaaccaatcagattcgttaaaatacaaaaacctaaggagggaacgatctgaggtagcgtaatgttaaaaaactgctgtcgatttgttgcaccatccatttgagcagattcatacaaagagggagagattccctgaatagcagtcaagagaatcgtcatagtaacaccaaaattcttccaaacagtcatgatggctaccgtcggcatagcaagggttggatcgcgaaaaaattgagggatcggcaagccgacttgtgaaaacaagtaaggaatcgcccctacattcggatcaagcaacatagaaaaaataatcgcaattgacgtcaatgaacaaataactggaatgtaaaatgtcgaacgacaaaaacgattgaatctggtatttttagataatgctactgctgctaataaaccaacgataatttgtgttggcgtttcgagtacggtgaaatataaagaatgaatcaacgaattaactgctcgttcatcactaaatatacgtgtgaaattttcaaaacttacaaaatttcttgatgtaaagaaaatattcaaatctgtaaaactaatagcaaatgttcctaaaagcggtatgacagtaaataataataaaactaaaaaagatggagttaaaaacaaatacgcagcacgatcaggacgattccaatatttggtgaatccgttcatatagtccacctcatctttcattttgataaaatatacaatcttggtttaaacgaatctgaataagatatccgaacaatcgctgtgatttttgcaataacacctatctgcaaatactaggtcgatcattcagatatctgtatcttgccaacagtctatcctgtataaagttctgtactatttttgcagtaattgattgatggcatcatctgcatcgttcatgagtgtctcaggatcttctcctgctaataatttttcaatcagtggattgatgatatcgttattgatcgcagagatttgggtaaaacctggtaaatatggctctgcatagtccatttgtttcgataattcagatacaataggatcattttttacttcttcatcttttgctactgaatccaagtaggcaggaaaaccattttcgatactccattttttaccaatttcagttgtattccaatatttcaaaaactcatagacagcttcttttttattattatctgtacttgccggaatggcatatcctacgccatctaaaatagctgtttttttgtctgaatcactcccttgtggtaaggtagtcacattataatcaatctcgtttgctttcaatccgttatttaaccatggcccattgatttcaatggctagttgaccagcattcattaaattgtccatttcggcgccagaaatcgattctggaccagtcttgtctacatggatcattttttggatcgcttttaacgttttaaggttctcaggagacgcaaattcagacttagtataatcatcgttcactaatttaccgccatttgctaacatccagttatataacggtgcagttccatccttattgaagacaaaacctgatacatttttactactatcagttaattttggtgccatttctgtcaattcttcccaagtagtaggtggttgttcagtatctaatccagcttgtttaaacaaatcattattccaatacatatacattccttgtacctgcatggggacaaaatactgtttaccttctacttcacctaattcaatagccgtttctttaaaatcagatttatctactccatcatattcccagaaatcgtctaatggttgtaccgctccgttttctacatactgtgcaaaatctggataatttaatgcaataaagtcaggtgcttttttagaagaaatcgctgtaggaagtttttcattcaaattggcccaagtcatgatatccatttcaattttgatgtttttatcatttgttttattaaattcattaacgatttcttgcaatatttcaccatcagatgcagtaaacccattccaaaaagtcaaagtcacttctttatcagaatcagattctgctgaacttccgccaccgcaagctcctaaaatacctgttgcagctaccaacaaagagccaattaaccattttttacctttcattttttgttcctccttcatctgataaacgacatctgaccacattccaagatagcggtttcaataaacaattgattttcccatcttcagcttttacatttgttgaatgacttggttttacttgttcacttttaggaagattagttgcttttgtatcaaatccactcatttcagaaaaatcaatcactccctctactgataattcagacaagtgaacagttagattcatttcttcttctccacggttaactgcaaatatgacaagttctttgtcatttattacggctatactttctaaatacggcacttcttcaaaatcttccgtcgcatagtttgctgaacgaatttgtgggcttaacacctctccttgtccatacacagcagcttgcataaatggataatagatcgtctgtctccaagcttctccgtttgtttctgtcctgattggtgcaataacgtttaccaattgagcaagacaagcaatctttactctatctgcatgtttcaataaagtgattaatagacagcctaatagtaatgcatcttcaaaattatagttatcttctagtaaaggaggagcaatctgccaaggcgctgcttgctcatcttgttccgctgaatgataccaaatattccattcatcaaaggacaggttgatctgcttcttactatgtttcttcgccttgactgtatcgcacatcgctgtcacttcagaaatgaaccgatccatgtctaaggaacgtgcaagataatgagaaagatcatttttttggttgccataatattgatgaagagacaaataatctatttgatcgtacgcttgatcaagaactgttatctcccaatcaccaaatgtaggcatttgccgattcgaacttccgcataaaaccacctcaattgaatcatctacgagtttcatcgccttagccgtttcctctgctaaccgtccatattcttccgctgttttatgtccaatctgccaaggaccgtccatttcattccctaaacaccatgtcttaattccaaaagggctctcttgaccattcgaacgccttaaatcactccaataagttcctttaggaaaattacaatattcgactaaattacgagctgcatctactccacgagtacccagattgacagccatattgatttcggcccccacatgctgacaccagttataaaattcatgaatcccaacttcattcgtttcaattgtccgccaagctaaatccaaccttctaggtctatttgctatgggcccaatactgtcttcccaacgaaatcctgacacaaaatttccaccaggatatctaatcatgggaatgttcaattcttttaccaagtgaatgacgtcttggcgaaatccacttttattagctgatggatgatctggctgataaatcccttcatatactgctcgtcccatatgttcaataaatgaactgtacaaccgcggatcaactttgcctacacgcttgacactactaatcaacattgtggcttccataactgacctcctttaatttatacatgaataatacacctttttgaaagcgttgtaaataatataaatgttaaacttaattattttttatcgattttaattaaccaaaatattaataatgattaaaacaaataatttaatataacttttattaacaaatatgttaatatataagaaaaaccttttaagaggtgatatatatgcaactacaaataaacgaagaatccttaccagtatatgaagcattagctagtaaaacaaggatcaggatcatccagctactttccaaaaagaagatgaatgtcaaagatttggcaaaagaacttggggtaagcagtgctatcacaacgatgcacgtgaaaaagctagaggaagcaaacatcatcaaaacagaaaaagtaggacaacaaaaaatttcgagccttcgtgtcgataaaatcgatatcagttttccagaaaaaatattcaatgcttttgatacgaaagaaacattgatacctattggtcactatacaaattatgcaattgaaccaacatgcggtttagctacgatccatgattttatcgggaaagtggatgaaccacgctattttatggatcctcgaaggatggatgcccgcattctctggtttaccagcggatttgtcgagtatcaggcacctaattttttaaatacagaggatacattggagatgttggaagtttctgtggaaatttcttctgaatttcctttttcaaatgacaattggccttcagatatcactttcagcctaaatggtgtggagctaggaacatggacgagccctggagattttgctgatatccgcggtaaatatacgcctgattggtatccagataatcttaatcaatacggcttgctgaagacgatccgaattaccaaacacttgacgaatatgaatggagaacccttgtcaaacatcacgatcaacgacatccctaaagagcaagacacttggcatttgcgaatcgaagtgaaagacgatgccaaacatgcggggggctgtactttatttggtaaaggattcggtaattacgatcaggatatcaaattaaaagtttactacagctgatatttttcttttctattttataaaacaaaaacagccaatccctatcaagggacggctgtttttgctttattgttatttccagaaatcatccaaaacggaaattggcaaatgtcgtttatgttgtgtcttgttccaccatgcttcgattttttcttgtgcttgagcgggaacttcttttccttctagataatcatcaatttcattatatgtgacacctagtgcgacttcatctgcaatcattggtttcccatcttcaagatctgcagtcggaatttttgtgtataatttttccggtgcattcaatgcttgaagcaattgtttcccttgtcgtttgtccaaacggaataatggcaaaatgtcggctccaccatcaccaaatttcgtgaagaatccagtaatgttttctgcagcatgatctgtccctaatacggctcctgctctttctccagctacggcatattgcgtaatcatacgttgacgtgctttgatatttcctttgttaaaatcgctgatttccacacctgcttcgcttaatacttgtacttgtgcatcaacagctggtttgatatttactcgcagactaacatcgggctggataaagtcaagagcagcttttgcatcttcttcatctgcttgttcaccataaggaagacgaacagcgataaattgatagttttcatcttttgtttcttcacgcatttcttccatcgttagttgcgccaaacggcctgctaaagtagaatcttggccgccgctgatacctagtacaaaagttttaagaaacggatattttttcaaatatgctttcataaagtcaatacttttacgtatttcttcttttggatcaattgttggtttgacacctaattcattgataatttctgtctgcaggctcatttattctcctcctatgcttctgtatgaagttctgctacgctttttttcattcgttccatgatagccattttatggttccagcattcagtagacagatcgactgggtatttttgcggattcaagtctcgtttatactcttcccatagtgaatctagattttcttttgtatattctttgatttcgtttagtgcaggtaattcgtaaactctttttccttcgataaagatatcttgtaaaactgggcgagctgtaaagtctcgaacagttttattgataaacgtatgcactggatggaacatgaagatagcttcttcttctcgagggtcttcatcccataatgtcacgtagtctccttcagatttcccatcaaaatttcgagtgatgcgccacacttgttttttccctggagtagttactttttctgcattgcttgataacttgatcgtatccatcatgtttccttcatcatcttcgatcgatactagcttgaatactgcaccaagggctggctgatcataggctgtgatcaattttgtcccaacaccccatacatcaattttagctttttgcatctttaaattcaaaatcgttgcttcatccaagtcattcgaagcatagatttttgcttccgtaaatccggctgcatctaattgttccctaacacgcttagatatataggccatatctccactgtcgatgcgtacgccttggaagttgattttgtcacctaattctttcgccacgcgaatcgcacttggcacacctgatttcaacgtatcataagtgtcgactaagaacacgcagtctttatgggttttagcgtaggccataaatgcttcataatcatttccataagattggactaacgaatgagcatgggtcccgctagctggtatcccaaatatcttcccagcacgtacattgcttgttgcatctgctccgccgatatatgccgctctagttccccagactgctgcatccagttcttgtgcccgtctagttccaaattccaatagtggatcttctccgatgacagatttgatacgagctgcttttgtcgcgatcaacgtttggaaattgaccatattcaacagtgctgtttctactaattggcagtgcgctaaaggcccttccacttggatcaatggttcatttgcaaaaactagttctccttcacgagcagaacgaactgttgctttaaattcaaaattttgtaaatactccaaaaaaccttcaggatagacttctaatccacgcaagtaagcaatatcggaatcattgaacgtcagattctctaaataattgactaaccgttccaatcctgcaaaaaccgcgtatccgtggttaaaaggcatttctcgaaagtaacattcaaaaacagcatgtaaatcagctcgacctaattcccagtatgtctgcatcatattgatttgatatagatccgtatgcagcgtcaaactgtcgtctgggtaagtattattcatcttgtattactcctcttggcaagttttcatttcctacccattataacaaaaaaaattaataggaaaagaaatcttccattttttctgaaaaagcacatgttttacggatatttcttgctaaaaatgaactccatctgctaaaactatcctttcttattggtatttaacctaaacgagaaagaatacttattttattcaatgtatccgagacacgaagaaattagcgttttctatttttcttacttgataaaataagtagcttttcctactacaatcgtagccgttaagataccgatgattgaacgaatataaccaaatgtctctacaacataatcaatggcaaaagtttttgaagcaaataatacatctttccttttttgcttcttatccccaaagaaacggatataacttattatgtattgaatttttttggaaaggcgaattatggcaagatataccttgcgttgaaaaaactcgcggaaaaaatatcacacgtttttttaaaaaaacaaaagtaagaaagcagctgtcaatagaatggaaacaaaaatggcgagacatcaatcagtctcgccttgttttttattgtatacgttagatatggagcaggttaccataaagatgattattagtcgttattaaatagaaatcttcgtatttttttgttctatcactacaatatctttatttggacgtttgaattgtattccggcacgttctagctcctgtttcactcctacatggactttgacatcttctcgtgtcatttttaaaacgtgatgaatcgcatagtcgatttcttgccttgtgatttttttcttcgtattgatcatcacgacttgctttttatcatatgtgtctaccaatagcagttgtgttcgatctaacgaaaataatttgtaataattaatagccgtattcccaaaaaagaattccactactttaggataaaatgtcttaatatttaaattactattcacaggtgtttcgattagcttcatctcattcctcttttctatatagtcgatttagatccaacctaagttatgttaccatctttcctagcattaaggaatcggttacaattgaacccttaaagacaaaaggatttaccttttatcacttaatagtataacataatttcatgagaaaaaaatacaattttttcttgaccttctcgttacgtaaaggattatgcttacatttgtcaggaggaaaaataatggagtacacaataaagaaaatgtcagagatatcaggagtcagtccgagaaccttgcgcttttatgatgagattggactgctaaaaccagctaggatcaattcttcaggttatcggatttatggcaaaaaagaagtcgatcgtctgcaacacatcttattttatcgaacaatggcattcaagttggatgatatccaagaggtcttagacaatccatcttttgaccaccagaaagctttaatcaagcatcagcaaatgttgctggaaaaacgggcacaaatcgataccctcttgacaactgtccaacagacacttgatatgtacgaaggaggaagaaaaatgagtgacaaagaaaaatttgaagggtttaaacaacaaaagttgaaagaaaatgaagaatcctatggacaagagattcgacaaaaatacggaaaaaaaaaggttacagcatccaatgaaaaatggatgaatatggataaagaaacgtatgaagaaatgcaaactgttgaaaagcagatgttatttgatctcactctttacttaaaagaaccagaagatgaaagcttagcagaccgtatcttccaagctcataagaagtggttatcttacagctggcctgaatatcagccaaaagcgcataaaggactaggaatgatgtacgaagccgatgaacggttcactgcatattatgacgagcgaagtggtcatggtgcagcaaaagctttaaatgaaattatccaaaaaaaggcgtaatcttttacatgatccaacaaaaaagtacacgtaaaatgacctaataacaaaacagcagacacccaagttagatttttatgctaacttttggtgtctgctccattctttcacaagttttttcatcctactttaaatatattcatcgttgaataaacgtataaggtattttcactttatcctttttttctgtaagaaacaattgaaatgccatttctccgcaagcttccagatggtggtcgatggttgggaaaccaagaagctcgctgatcagcaaattatcgcgtccaatcaccactggtgtcttatcttgcagatagctttgcaagatgcctgctgcaaccatatccgaatttgtaaagacaccatcaactccaagctctttaaaaaagaagcctgcttgttttcctttctctgcatctatacaatcccaaaaaacaagtgattcatcaaaagatggaaaaagttgatgacatagctgcaaagtgatttttgagttataacttagcctgccacttcgccccaacgtgatgcccaattgctttataccttgctgcttcaaataagtaaggccttctgtaattgattgttctcgatcaataaagacacaacttgcctgttttcccttgatttcttcacaaaaaactagaggtccatatttttgatatgccaataaatcatctagtgtattggcacgagacgtaatgatcaatccatcgaaagctttagctgcaaattcttcaagataccttcgctctttttctttctgatagcccgtcggtaaaagtgtcactttgtaatcataatcaaacgctgcttcaatgatcccactgatcaactgatcaaaatacggatgattggtataaggcagaatcactccaatgcttttcgtttttccataacttaactgtctggcatttgcattagggatataatcgacttctttcatgaccgcaagtatttctttccttttttcctcatctacatatggatgtccattgattacacgtgaaatagtagaaactgaataacctgtgagctttgcgatatctcgaatgtttgccactgctgcttcgccacctatacaaaaagattttcttgtaaatagtctaccacagctggaccgcattcaaaaaactgatacatttttccttcatgcgaaaaactgatccgctgcccgccccaatatatatcttttgtcaaagtttcgatttcattcattggtatttcttttactatattcctattcaacccttgaaaactgtacaacgttaatacggatcccttgaactcgacaaacgcataaaaataattgttcgttgtgccatctgttatctctacataagtattcattgcaagccctccttttgatactttgagtatagtgtatgaaacgcgtctcatagcaaggagtttgttttgccaaagaaaagttttattcctctttcattattaccaaagtctcttattttaaattgaatacattataatgatactgtaaatatatctttattattagtgaagtcaaatataaaaactagtacgaaattaatttgtaaattatttaagcttgataaaataagcaatatcgatgatgtaaagtccaagatattaacaagaaaagtaagcgaaccagtaaagctaacggcacaagataaaaaaaatggaattgttctttatggtgatgatgcaaagtataactataattgggatacctcctcagaagctgaggtattaagtattcctactaccgatacttcaggggaaaaagtcacctttaaaataaattttataacggcaatttctaagttggagtatgggaagcaaaaaaagagagataacaatgatcaatatctacctaaaaaataacgaattaatgatgcatatgttaaagttgtttttttgaattaaacaactcaatttattcagttatatgttcatcgcagcaagtgaacattaatcgagttataaaattaataggagctaaaaatataaataaagttcgatcagaatttatttttccagaagatttttttaactggtttttttatcaattcagtgaatgcaagcgactcttaggtgagaattattacttaaaaggaatcggcggatttatggggaatgtggctgatgaacaaaatattataaaaggaatatctgaacaaacatcagagcttacagtaactaaagcatttataagtaatggtgaaagtttgaaaaatgtaactgcgcgaattagaaaagaaaatgaagtagacattgtttttggaattgaccatgaatgtaattcagtgatatatgtaacacaatcagcaaatttaattctttttgagaatggttgcaaggacgattttatggtggtctatttgtacgatatactaattccaaaacttcgttccttatatatgtcttctgaaagtatttttgtgagtgaacaaaagggatctttctcgaaaaaaataggtattgaagtaattgaatcgattatgtgtcataatcatattacgctagaagaattagaaattttgatagggcaaaaaaataataacacgaaaatacaagtttcttagaaatcattttttattgagatatctagataaatgatttattcttcaatcaaccaactcgccaagctgaggtaatgttttgaggtaatgataacatacaactttttataccctagtaaaactctataaacaaagacttattaatttcgcatgaaatacattcctgtaaaatgcaataaaatagagttttgtttaaccaggtcttaagaaagcccgtaaagcttcacagttctcaaaacgttaattgcgattatcgttcgagttcacgagttacgagaaccgtactgggcgaagcaatgctgagcgcagttaccttaatcctaacttttctggcactttccacaatttggaaagtgccttttttgtgtttttagctatgttaataggtaggattcttggtctataatatcattcgatctataaacaaacgggaaaaagataaagtatcatcaaacaatattatttatccgcttctgaggttgtgacagaagtggtcagcttcaagaaataagaaggaatttacaaaaattgcttctcatgtttgataaatattgtgacttgtgaccgaggagttggcaggagaacaccgtttattcggaagaagggattgtgaaaagtcttttgtcataacctcttatttggtagctaattgtaaatcccaaacggcatgtattatttttcataagtccgtttttaaggattaatgttttcttttgctttttatatggtctggcttcagcgagaagttccaacgcatatacaaggacgtctgatgtcaacgataacaacgattaccatggtggccagtccacttggattagcactgtttggtgcgctctttgattggaagacaacgcaaccacgtctgcgagacagtctaatttttctgggagggagtcttgctatagttatccttataaccggtctggtaaaattactcaagcttgatctgaaagaagcaaaaattttcagtgaagaggaatacagagaaacgactttggtcgaaaagaaagaatcaggaaactgatacaagcgtataacaaactgcctgataataggaaagacacgtattgtccgattgttttttttgacattcaattggaaaatttacactttctttatacatttctggctgctttctttatacccgtcaactatacttcacttatcaataagaaagaaggataagtatggattttggaaatgaaacggtcttgaaagcaactggtataaccaaaaaatacggtgctgccaaagcattagataaagtatcaatcgaaatcaaacgtggaatgatctatggattgattggggaaaatggagcgggtaagtctacctttatgagaactattatgggtttgatctcgattgatgaaggttcgatcgaattatttggaacgacggatttgcaggcagcaagacgacgtatgggtcaatcgattgaaacccctgctctttatccagaattaactgcaagagataacctacgtatccaagcagcgaacggcggtgtgtcggatagagaaatcgaagacctgctgaaaatgatgcgattggaaaatacagggaaaaagaaagcaaagaatttctctttaggtatgcgccagcgtttagctattgcaaatgcactgatcacgaatccagaatttttgattttggatgaaccgacgaatgggatggatccagcagggatggcagaaatgcgagaaatcatccaacgtttggtaaaagaacggggcatcaccgtcttgctttctagccacttgctagatgaattgtcacagatcgccactcactatggtattttgcatgaaggacacttgatcaaagaattatcgaaagaagaattggcacaagaatctcgtcaatttataaaaattgacacttcggcgacggaacaagcagtaacggttctcgactctcttggttatagggattattttgtccaatctagccgtgttatccagctttttgaaggaattgaccaagtagcagccatcaatcaagcattggtagaggcaaaagttcctgtggatggtatccacctagttgggcaaaaactggaagattatttcttacaattaactggaggcaatccacatgtttaatctattaactgctgaaaaaataaaagtatggaagagccgtaaaatgtgggtctcactaggactgatggtcgtacttccgcttttttattcttggaacgaatggtatatgcatacaaaatacggcaatgaattaaaccaagcaacggatacagtcatcaacggtgcaacagggattttaatggtggaaaaaatggctgcatggattcttctggctttcgcagcatttgcgtgcttttatattggggaagaatttcaaaacggtacgattcgcaatacgttatctttaggacggaatcgaatgacttattatgtgtcgaaacttctcgttacgcttttgatcacaacacttggcgtggttttgattacggggctagccatgattgcttacacacttgctttcggatttggtgaagttgagggaatcaaaaactatggaaattatgttctaaaagtatttcctgtattgcttctgctgacattagggacattatctgttccagtggctttgacattcatcactagaagtaccagtgtcagtttgcttctttcttttctttatatcatgggaacggccttcattcccggtgttttcgcaaaaatcaaaggcttggaatttctaacggagtggtttacggaaacgtggctcatgtatacggactttgcgcaacaagcaacttattcgcaagcaccgaaaatgattctggtcagtctagtaacaatcgtggtatcatcagctctaggaatgtttattttccaaaaatctgacattaagtaggtggtcctgctggaaactattttgattatcgaagacgatgaagctgttcattctttactggaggaggttcttgaacagagatacaaacttcttgatgcttattcaggtacggaaggaaaattattgttaagcacatatcctgtcgatttgatccttctagatctcatgcttccagggctttcaggtgaagcattgttagcagaaatccgacagacatcgaatgttccgatcatcgttctttcagcaaaaagcgatcaaagagataaagtttccttgttggcagcaggagcggatgactatgtgacgaaaccatttgatatcgaagaacttttgttacgaatcggcatccaacttcgtcatcagacttctgtccaagtaaaagatctgtcgcaacgcatctattacaaggaaatcttactggacaaagagtcgagggatgtaaatgtgaatggtgtggctgtccatttgacaggaagagaattcgatctgctgaagctttttttagaacatccgaaaaaagtattttcgcgagcaaatctttatgaaacagtttggcaagaaccatattttgatagtgagaaaacagtgaatatgcatatttccaatcttcgagggaaactagcaaaggcacatgctgtgtatattcatacggtgtggggagtggggtttagatttgattaagtggctgttgcttctcgttgttatctttatgggaagttttattttcttcctgcaaagggaaatcaagagattaactaagaaaatcgccactctttctgaacgacaagaatatggtggtcgtctttcagtcgaatttcgagaaaagaatctaatggacctagtagatgcactgaatacatgggtggatgaaaatgaacaaaaaggacaagcatttcaagaaatggaagaaaacatcagactatcgatcgtcggcctttctcatgatctcagaactcctttgactgctattaacggttatgtacaattactggaacaggtagaggatacggagaaacgggagaagtatttaacgatcatcaaacaatctgttgcaagattactcagtatgacggatcagttttatgatcttgctcgaatagagacgaagcaaaaagaaatggatctccatacgctttctttttctaaagaggtggaagaagtatttttctctttttatgaacaattttctgagaaaaatatcgaggtagcgttcgctgaacactcgataaatacaactgtattagcagatccgctcatgttgctgcgagtgctgcaaaatatcatacagaatttattgcgttatgcagatggacaagcaaaggtgacattttcaaaagaggattcattcattcgattaacagtggccaatcctatcaaaccaggagcgcaaacctctgttgaaaaagtcttccagcgtttttataccgaaaataccagccgcacaaatacggaatctagcggaatcgggctttacctgtcaaaaaaattggtggaaggaatgggaggagagatgaccgctagattagacgggggcatcttctccatctccgtcaagttgcggagggtttaattggctctaatttacctgaagtgaatgacaaaaaattgtatctcgttttaaagacatcttcttttttggaaggtgtttttattttggtgtgattgatacgaattaggtaacgaagacagttatttttgtacccccttttcaaatagcgcaacagtgctatactaaaactaacaaatcaaggaacggagagggatatgggccaaagagaatttatcgttttaattattattgaagttgttattttattagttgttttagacattttttcacgtttgaaagtaaaggaaacagttcgtagtaattggggaaaaattccttatcaaccgagatttgataaagaagaaagtttgaaggatgcgtggctcacggagaaaaaattccgttcatgggatagtgaaatcgacgatcttacttggtatgacttggatatgttcgaagtatttgaagggatcaacagtacctattctagtgtaggttcagaagcgttgtatcagcgtttacgtagctttgattttggagaagattatcagttagaaaaactaattgctttttatcaggaaaatcctcaactgagagaaagaatccaatatcaattcgctcgtttaggaaaaaaagatcataattttgcaaaacaatatctagcggatggaaaaagtaaaaagattggacgcgtaggtttatttatttttcttggcttgcttccgctggtgggtgtaggtttgcttcttttagggcaagtactaggaatctatctagcaatcggtggcttagtattcaatacggtctattatctagtgaagaaacaaacactagaaacagagctgaatagcatgagttatttggtttcaacgatttcagccgccaatcagttagcaaaaatgacgacaccacttcaaaaagagctgaaacagcaaactaaaccattaagagacatccctaaattaggtttttcatttcgaatgaagagcgggagtgaagcagaattgatttttgaatatgtcaacatcatgttcatgctgccatttatctcctatcatttcgttctcactaaattagaaaagcattcaactgaagccatcaagctgtgggaattgctgggagaattggaagttgcagcagccgttttgaattatcgcacctatatgccgatcacttgccgaccagagtttactgagggcggtgtgacagcgaaagatatctatcatccattgttaaaagaagcggtagttaatccagtcaactggcagaagaatacattagtcacgggttccaatgcatcaggaaaatctacgtatgtcaaaagtatagccatcagctgtattctagcacagacgatccaaacagcgattgcagaacagtttaccctgcaacctggacatgtgttgacttccatggcaatcgaagatgatttatttgaaggcgacagttattttgtttcagaaatcaaatcgatcaaacgtttgctggaccaagtggcttccaaagaacgctgctactgcttcgtagatgagattttaaaaggaacaaatacgatcgaacggattgcttcttccgcttcagtcgttcggtggcttgcggagtatccatctttagcatttgtcgccacacatgatatcgaattgacagagattttaaagaattattgtgagaatgtccactttgaagaacaagtaacagaaggaaaaggaatcagttttgatttcaaattaaaagaaggaccttcaaggacccgaaatgcgattgccttgctgaaagttttgaattatcctaaatccatagttgaacaggcccaaaaagaaagtttgttgttcgatgaacagcgtcagtggtatccgtttgattaactttatcaaacgaagcatgatgcgtgggtccaaaaagacgattatcaaaagaagtacattgatgccaaaaaagtggcagaattcaatgggaacgagtctgctgtccagatgatcttggaagatttagcaaaagacgatacaaaataaaccacgctgtcttccttctagcagcttttatcgaaaaaacttagcatcagcgacgagacgcacgttccatggcaaagttctccgtaaaacaaacagcgaaaacagaaattgaaaataactatttccattttatttatttcggttaaaataaaagaaaaaagctttcgataaaaggacggaggaaagcttaacatgaataaaaaagacaagaacctcagttataaggatcttctatatgtcatcgtagtagttgctgtcggtacttttatgattttaaaagttccagagttgtttagatagttattctatcgaagatgatcatgaactagaaaacacatctcctctttgttagcaggtgtgtttttgtgtggaagccaagttgttttttcatctgctgtattccatgatacaattaagaatcatgtctataaggagataggaaataaatggcaaatgcgcttgaaataaataatttgaaaaagatctatggaagtggggtcgaagcattgcggggaatcgatctttcggtgaaagaaggagatttctatgcgctattagggccaaatggagctgggaagtctacaacgatcgggattattacttctttagtcaataaaacatctggaaaagtgaatgtcttcggttatgatctggacaaggatctagttcgagcaaagcaacagattggattggttccacaagagttcaattttaacccttttgaaacggtccagcaaatcgtcgtgaatcaagcaggctactacggtgtctctcgcaaagaagcgatgaaacgcagcgaaaaatatttgaagcagtccaatctttgggaaaagagaaatgtccgtgcacgtatgctttccgggggaatgaagcgaagactgatgattgctagggcattgatgcatgaaccacgtttgctgatcttggatgaaccaacagcaggagttgacatcgagttgagacgcgagatgtgggagtttctacgagaattgaacgaaaatggtacaacgatcattttgacgacgcattatctagaagaagctgaaatgctttgtcgcaacatcggaatcatccaatcgggtgaactgatcgagaatacaagtatgaaagagcttctgtcaaaactgcaatttgaaacatttatctttgatttagcgccatatgataccaaacctgtgattgaaggatatgcttgtacatttgaagatgagcagacaatcgctgtcgaagttgaacgaaatcaaggggtgaacggaatcttcgatcagcttacaagacaaggaatcaaagttctttctatgaggaataagtcgaatcgtttagaagaactgttcttgaaaatcacagaagaaaataatcatacggaggagaaaaatgtttaatctttattttactgcattaaaaagtttagctatcaaggaaacgaaccgctatttgcgtatatgggtccaaacactggttccgccagtgatcacgacatccttgtattttgttattttcggaaaaatgatcggtgggcggatcggtgacatgggtggtttttcatatatggaattcatcgttcctggtttgattatgatgtctgctatcactagttcgtatgccaatgtttcttcgtccttcttctctcaaaaatttcagaaaaatatcgaagaaatcttggtagcacctgttcctacgcatgggattatttggggctttgtgattggtggtgtgggtcgcagtattctcgtcggctctctcgtaacgatcatttccttgttctttgtaccacttcatgtgtattcatggttcatggtcatcattacattattgatgacggcaatcttgttttcattagcaggactgctcaacgggatttttgctcagtcttatgatgatgtatcgatcgtgcctacatttgtcttgcagccgttaacttatctaggtggcgttttctatgccatctctatgttaccgcccttttggcaagctgtttcaaaagtcaatccgatcgtttatatgatctccggtttccgttacggattccttggaacgatcgatgtgccagtagcaacatcgatgatcgtacttgtgttattcatcgttgttttgtacgccgttacttggtatttgatcaataaaggaagaggattgagaagttagaaaagaggttgtgaaatcagcgttttgacctgagtattagagaaacaaacggaaaaatagttcctcatattttgttgttttttgagcgaataccgagggtcagctgattgaacaccgtttagtggagaggttgtgaaaaagctgttctgcatcaagtaataagaacagccaaacaaaaatagcttctcatgtttgatgaatattttgacttgtgaccgaggagttggcaggagaacaccatttattccgaaaaagggactgtgaagatttttgtcacagtcctcttttagttcaatcagaaacatcttttaagctgttcactttgcttctttttttgtttcctagtataatgacaatgtttttgagaaagattgcgacttcactgcttgatagaatggagagtaacaaataaatgactactaatttttggaaagagctgccaaagcctttttttgttttagcaccaatggaagatgtaacagatgttgtatttcgccatgtcgtaaagcatgcagcagcaccggatgtcttctttactgagtttacaaactcagacagtttctgtcatccagatggaaaagacagtgtacgaggaagattaacatttacagaagatgaacagccgatggttgcccatatttggggagacaagccagaattttttagagaaatgagcattgctatggcagaaatgggcttccaaggaatcgatatcaacatgggctgcccagtccctaatgtagcagaacgtggaaaaggcagtggcttgatccttcgtccagaagtagcggcacaattgattgaagcagctaaagctggcggtttgcctgtcagcgtcaagacgcgtatcggctatacggaaatgtctgagatggaagaatggatcagtcacctacttcatcaagatatagccaatctttctgtccatttgcgtacgcgtaaagagatgagtaaagtagatgcacattgggaagtcattcctaaaatcattgctttacgtgaccaaatcgctccacaaacactaatcacgatcaatggagatatccccgatcgccagacaggagaagaattggccgagaaatatggcgttgatggcatcatgattggccgagggattttcaagaatccttatgcatttgaaaaagatccgagggaacatacagaaaaagaactgatcggattacttcgtctgcaactagatctgcaagatcattattcagaaatcatcccgcgttccatcacaggactacatcgtttctttaaaatctatatcaaaggatttccaggagcaaatgacttgcgagttcagttgatgaatacgaaatctactgatgaagtacgagagatcttagagacctttgaaaaagaacatccaacgcttttcagtgaacaatgatttcttgcttgaacaccgtgaattagaggtcgtgaaaaagctgtcctgcatcaagtaataagaacagccaaacaaaaataactcctaatgtttttgaattggttggacttattaccgcagatgcaagcttttgaacaccgtttaaggaagaggttgtgaaatcagcgttttgacttgagtattagagaaacaaacgggaaaatagctcttcatattttgtcgttttttgagctaataccgagggtcagttgattgaacaccgtttatatcagaggttgtgagcctgccattcagctctgagtcacaaggagcaattccaaaaaatagctcctcatattttatgaatattgtaacttgtgaccgaggagttggtaggagaacaccgtttataagaggttgtgacaaaagtcttgtcgcaacctcttttttaaccaaaaaagtgcaaatagtttactttaagtaagagaataattatgatgaataaaaaaggtggaacaaatagcatactatatatattgaaatgaaaactgtatggatgctccaacttgatgaagctaaggaggaattcgtatgtcagaaaaggaattaatgaaggtagtcggtttttatgaagggttgccgatcgatgatccaaaaagctttattgatgaaaaagaacagatacctgtacccagttcacgggatcttctggtaaaagtcaacgcagtatctgttaatcctgtcgatacgaaacttcgccaagataacgggataagaaatgctttacgtatcttaggttttgatggagtcgggaaagttgttgctgtaggtgacgaagtgcaaaaattttctgtcggcgatcgcgttttttacgcaggtacaacaacaagagcaggaagcaatcaagaataccaactagttgacgaacgtattgtcgctcttgcaccaaaaaatctttcagatgaagaagctgcagccttgccgttgacctcattgaccgcttatgaattgttatttgtaaaatttggtctaactccagaagaaaatgccaatcgcgggaaaaaaatcttagtgatcaacggagccgggggcgtcggttcgattttgaatcaactagcgcattgggctggcctagaagtctacgcgactgcaagtccgaagaattttgaatggctgaaaaaaacaggtgtagactatccaatcgattatcatcacgacttaagtaaaagttttcgtgaattaggaatcgatcaagtagagtatgtcgctgtattattcgatattacccgctactttgatcaaatcaagcaccttgtccgaccatttggacatgtgggaacgatcgcagggatcaaagagccgttagatataggtgtttggaaaaaccaatctatcagcttcgactgggagtatatgttcgctaaaacagactataactatgaaatcgaaacgcaaggagaagctttagcgcacattgctgctttagcaaacgaagggattatccgcagtacattgagcaaggtctattcagatgggatcaatgcaaagaatttgaaacaagcaaccaaagacgtagaaacaggacatatgttaggaaaagtcgttgttagtggtccgttcaacggataagcaggaatacgccgattttcttcttacttataaataaaaaacaagagcgcaggacagtaatttgccataagctcttgtttttttatttataataagcgaatcaatgaaagggaaagaattcctgccaagacgatcaccaataagctttttgaaagaatagcagctaaaagtgtaggaactgaagccaaagcattttcgagattgatctgcggcagatgtccgatgttttgggtaaatagactgctgaaccataaagcagacataatgacgattgggacaaaacttaaatactcaagcaacggttgcggtaaatcgaattttttcagtaagacaaacggtaggaccctagaaagccaagtcgctagagtacaacctaaaatagtcagcaatgtaaactcaaaagaaggcatgtttgatccacacccccaatccgcatccgatcagtgtcacaactacgatcactaagttgcttgggataaaaatcagtccgacatataccagaatcaaagtgagaccaatcaggatcaactgtaatcgtttagaggtgtttctatcagaaatgacttgaagataaagtaaaccgataaacatagcgacgatggcgaaatccaaaccaaactttttcggatcagtaataaaattacctaaaagtgcgccaacaagagaagaacccacccacgtcaaataagaaatccaattagctgtattcatccaacgaaagtttaacttttgtccagtatagttcaatttattcattcccagtgcgaaactttcatctgtcagcaatgtgccaatcagcagattttgaagcagccgatttttcttgaaataaggggcgatcgtcatactcatcaaaatcattcgggaattgactagaaaggtcgagaaaacgatggaaagcaatgggctgtgactagcaagcatgctgactgtgataaattgggcagaaccagcatagaccagcagggacatcaacgtgacgactagtggatgaaatccggcagcttttccaacgataccaaatgcaagtccaataccgatataaccgaaaacggtaggtaacgtgtctttgatcgcagtttttatatctaacttttcatccaataacaaaactcctttagcacgacataaattttcataattgtcgtcaaacttgtgaatattctaaatttttaatgaagacttgtcaacttcaattttaaacaaataaaaaagactggacgtagtttaaaaaaatcttctcaagttagatttccagacctaacttctgaggatcactacatttgtcacagtctcttatactgacaagtataaatgaagtatgaagaaaaagtatttgttattggtatttctcattattcttgttttctaatgtgttcacttcaagtggaattttagaatattattcaactaacaagtctacatcgtatctaaatccatttgtatcacttaattgcttgtaaaattcgccactttttttaattgttcttttttgagtagtaaggtcgagtgaaaccagcccatatcggtttttataggcgttgatccatgaccagcaatcaataaatgtccaaagatgataccccttaatgttacatccttcatttattgccttccataagtaagcaagatgatctttgatatactcaatccgataatcatcaattatttgccctgtatcatccatgaaacgttcttcatccgcaacgcccattccgttctcggagataaatgcttcgatgtttccataatggttcttgatatccatgcacaaatcataaattcctttttcgtaaatttcccatccccggtattcgttcattcgtcgtccaggcatgatatgtggttcgaaaaaccactctgataaaaatggactagatgtatccaccatagaagaacgagatttgacgcgacgtggctcgtaatagtttagtccaagaatttgagcggtattttcgtagatacatacaagatcttctttcgtataatcttcaggaagctgattatattcttgtaataacaggataagctttttagaaaaattccctttaaccataggatctaaaaagctccgcgtataaaataaatcagcgatttctgctgctttcacatcagcaggattttgactacgaggaaaagtaggactcaaatttagaataacgcctattttactaggaagagctagttctttaaatacttgtattgcttttgcgtgtgcaagtatagtgaagaatgctgcttgcgctccgcgtttaaagtcaatgaggtttggataatgaaaatcttcaagataagtacctaaaataggcccaagtggttcattgaaggtaaaccaatgacaaactaagtcaccaaattctttaaaacaagtttcagcgtaatgaacataagcatcaactacttcacgtgattcccatccacctttatcttgaagagtagcaggcatgtcaaaatgatataagttggcaaatactttgattccgttattattcatttcggaaaataattttcgatagaaagaaatggctttgggatttacttttccggtaccgccatttggaaacattcgtgcccaagaaatagaaacgcgaaaggagttatgcccagtttttttcattagttctatatcttctttatattgatggatgtgatcggttgtaatagaggaatcgattcgttgataaaaccggtaaggttgttctttaaaccagcgatcccagatagtctctgcttttcctgtttccccttttccttctgcttgctcagctgaccaagcggaaccccaccaaaaatcatctggaaaagttagctttttcatagttgtcataatttttttacctcctgttttcacttaatgataacaccgcttacaacttaaagtaaatagttttgtttaaatatatatatcttttttgttgtgtgtataattttgatgtggattttatcggtttatttatgttaaagtatagatgaagatatgtttttgattggagggtcaccattgaaaaaaattgcgaagtatatggaaatttacttagatataaagaaaaaaattgtaaatggagagtataaaattggtgagaaacttcctacaggagatgaattggcagttatttatcatacaagcaagttaacagtaaagaaaggcgtagacttacttgtttccgaaggagttttgcgaagtagaagtgggtatgggactgaagtcgtcagaacaccaattgataactcacgagttcttggtccaaacgaaggtttgtttagcgtggttggtgaagaacacgtagattcagaaatccatactttctcaattgaacttccatcgaaaaaagtagctgataaattaagtatcagtgtaaaagactatgtatataatattgtacgaagccgttttattgattgtcaaccatactcgattgagcaaacattcatgccattagcagtcataccaggcttggaaccaaaacatttaaagaaatctgtatatgcttatatcacaaatgaactgggtctggaaataaagacttcgcacatacgtatcaaaggagatactgcgaatgaatttgacgcaaaaatattaaaaatagatccaggtgaatttatgattgagatagacaaagttgttgctctatcgtctggtaaacctttcgagtattcggtatcgagacatttatatcaagactttgtttttgaagctgtttttgttgaaaaataagctcgggaaaattatttttttcagagcttatttttttatactaaaaaagatatatatatttaattaaaagtatttacttttgttgataagtgatgtattatttgggcggaaaaagtaatcgattacaataagcataaaggagaaaaaatatgggcaaaagtagcaggaaggacattgtatttgaaaaattcggtatagttgcgactaagttggggaatcagatccatttaagaactttgcgagatgcgtttgctacatttatgccatttatgatgttagcaggatttgtgacacttattaattcagtgatcttagaaccaacaggattcatgggtgaaattgtcgatactagtacattgaccacgttacaacaaattggtacttcaattgccaatggtacattaagcataactacattattagttgtagcagcagtatcttatcatatgtgtgcaagcagaaattatacaaatcatattgcagcggtattagttgctatttcgacatttgttgtattaacacctatgcagatgatgtttactcctgaaaatgcggataaagctgttgaagtgacgggtgtgatacctatatcctatacaggagcttcaggaatgtttgtaggtatatttgttggattagcggctacagaattatttattaaactttctaataataagaaactacagattcagctatccggaaatattcctcccgctgttttaaagtcttttaatgtattaatcccaatcattattacgattacctcgtttgctttattgtcatttataatcattcaattgtttaatatggatataaataagctaattaccacgatagttacagagccattaagtaaaattacaactggtttaccaggatttttgttaattacatctattgctaatctattttttggatttggtatccatcaagcagtaatatcaggttcattgttagatccgtttttgattcagaatatgcaagaaaatatggcagcttatgcaaacaaagagcaaattccacatattatcaatatggcctttaaagatacctttgcggtaatgggtggatcgggaaatacgattgctttattgattgcaatatttatcttcagtcgtagaaaagattataaggactttgctaaattatcggtaactcccgctatattcaatataagtgaacctattatttttggattgcctattgtatttaatatcagtctgattattccctttgtgcttgcaccgattttttctttgacagtagcatattttgcaactgctgtgggattaattaatcatgtagtagtgcaaattccttggactacgccaccagttatatcgggatttttagcaacagccggagactggcgagcagctgttttacaaatattaattatagccgcaagtgtgtttatatatttaccgtttttacgaattgacgaacacgtgacaactaaattaagtgaaaatgaaacataatttactatgagataacaaaaattaacacaagaagtcgttggaatataaatagccagtaatttcaataaggatcatattttttgataagtacgaacatgtagaaaaacaaacattttttggtacggataatcattatttttcacaagacaaacctatctgcgtatatacgtctatttagtatatgcaaagataggtttttggtggtgaaaaataaagactgttaatattattaatcgttattttaatatttatctttaaagattagagtggttcgacacacctgaaagttgttgtcagttttttatccagtatacagatgcagtggaacctctcttacaaaatgtagaaaagtatcgtaaaatatatcaacaataccggaaaatctatccagcaacgaaggaaatttatcatgacttataaaacaaaatgcgtacctaatagtcaaatgactaatattgggtacgcgttaagtcttctttacttcatcctttgcatgattcgtgtttttaaagcagggtctgctgtatttcttgtggatttaggatggttgttatcgtttacttgctatttttcattgaaatcgtctttctttaccgtttctttagttttttatctatttttttcttttggttagaaaattctttttcccgaaagtcttctttcaggatttttatggagtagcgttttgaataagaggcgtcagtatgatcgacttggcagacgaaccaagagaacatttgccttttttctgcatgaggtgcttctgctaataattctttccataaataataacagtcctctatcagaagaagggttcgttcatcctcaggctcccaatagaatgtttcgagagtagcaatcacttcattgatcaattcgaatgcgggaagataggcattttgctgaataagcgactcaactgcttcttggatgaactttcgcatctccatgatgaacttcgctgttttcttgtttttgtttttcttgataatatgatcgtatttatggatgatagttgttaatttatctgaataatttattgcatgaaatggcatcttaactttgaagcgttcgataaagtgcggatgttctataagaatctctgttaaaagctcccgtacaagagaggaactagcggaggaaacaagggacgagagttcggaaagtgagtagttggatttttttattggacgttcttcgtaagcgaataagacagcagccatgtgtttgcatttttttccttctatggcatatagacaatcacaagtcatgttggtcttttcatcccaagtgatcactaccttataatcttccgtgccagaaactgttgcggacaagtacttgcttgtatagttcaaatgacggacaaaaccgtgcagatgatagctgtaaccgcgttccaaaacgttttcaggaaaatactcaagccaattattcatctagttctcctttcatgaaacacttatttatatttagtataaagaaacgtttaagaaaaaagtagctgattttacatatttgataatcacttttgctcgaattgtcaaaaattcattctccttttcttttcttagagaatgtgagaaaaagtaaaagaatagcgtgttttaaagatggaactttttttgttttttatttatctgacaaaaatgaagtgattttgttagaaataaataattgttccaattgataaaagaggtatgatgtatcgcaaagaaaaatccaagcagcgttctgatcagcagtttgaacaacaatttgctttgtacagtaggtagtaagcggattaactaagggaataaaagatatttttaccgctttgtttacttagaatgtgtcttccccaaaatttatttttctaaaggtaaaacatagataggcagataataccaattatccgttacgaaacgctgcttgagaattttctttagatccatacaacattttctacatctgactaaattggttcctgattcatcaagtaattgactttctttgataatatgataaaaaggcaagcaaggaggaagataaatatgcttaaagatctgaaccaattgatcgattacatcgaagaacatttgacagaaggactttcctataaaataatagccgaaaatacaggaatctctgaatatcaattaaaacgcatctttacgtttattgcagggatgtcgctaatggactatatcaaaaaccgtagattggctttggctaatcgcgatctcctagatggatcaagagtgacagaaacggcgtttagatatggatatgaaacagtcgaaggtttttcaagagcttttcgtgattggtcaggatatctgccttcagaaatcagcagatacggcatacaaaaatcttttccacgcttgacattttttattgatgtcagaggaggaaaatcgatggaatttcgtatcgaaaagaaagaacagttttatgtggcaggtgtggcgaaaaaagttcctgtcaaatttgaaggagtcaatcaagaaatacaaaagttagcgcagacgatcacggagactcaaagggaagagatgcataagttaggagatttatatccaaatcaagtaatcaacgtttcttatggatttgatggagaccgcttggaagaaaagggcagtttgatgcacatgattggctttgctacgacaaaagaaaatccgtacgctgatttagaaatgcttgttatagaagaacacacttgggccatttttcctaataaagggccatttccccaaactttacaagatacttgggggaaaatctatgcagaatggcttccttcttcagattatgagttagtcgaagctcccgagatctcttttacaaaatggggagaggatttcagtaatgtttacagtgagatttggattgcagtgaaagcaaaaaaatagttaaaaaataaaaatatccctagaaaaaagagcgtaatcgtgtcatttccctttaattttatgtaagatgaacttaatataatagaaagggtgggagaaatggcaaagtataggatcgaagaaaaaccagattttacggtgacgggtattggtgtggaattgaagagtagcaatacggattttgtcggtttggctgcagagaaacaagcatttgagcaaaaagttatcggtaatggaacaatagatgcattgaaacaagctgctgaaaatcattatttctttacagtcaacgaaccctataacgggaaaatgatgtactatgtcggtgttcaaacgagtcaggatgttccaaacactacgcgaatcatcccattcccaaaaggaacgtatcttgttgtaagcgctttagcagaatcgcctgaagaattaagaaatgatttgacgaatacggcctttgggcatgttttaagagaagtagaagattacgcctatgttgtgggtccaaatgctgtagtcgaaatgggagttaccaacgggaaatatatgggagaaatctggataccggtagtcaataaaccatgataatatagaggtcgtgaaagtagcgctttgacctgagtattagagaggaaaaaggggaaatagctttccatattttgcatttttcagaactaatgccgagggtcagctacttgaacaccgtttatcaagacgtcatgacttcagcgctttgacctgagcattagagaggaaaaaggggcatgacaaggcttttgtcccccggagaataaaagaatttatgtagacgattccgatcagaaaaatgcaggcacagtagagagaattataaaaatctctctactatgcctgtgttttctggtcttttttctttttccaaaacggctattttatgtatcagactatcaagtgtgatcttagccatttcttcttctgcctttttctgcagccgagcgtagctttcttctaaagcttcttggatattcgcaccaacgacgcaattgggatttgtttttggatcgacttggataagctgtgtattaccttcgatgctgcgatagacatctagtaaagaaatctgatctggacttttggcaagggaaggctgcggttttccggtttttgtaaagatcaaaccggattttttgagctgactcatgattttacgtacatttgctgcatttgtttcgatactactggcaatcatctcactagaaagtgatcgggtatcttgaaacatttcaatataggcaagtacatggattgcatcactaaattgcagagaatacttcatcagttgtcatcctttcattttttttgcttgacttatcttaccacactctttatgataaaggtgtaatttataaatgtacagctgtaaatcttaacaaataaaaagaatagggagtggcaaatatgcattatttagtaacaggagcaactggaggttttggtggttatgcgctggaattcttaaaaaagatggttccacaaaatgaaatctatgtactagtacgtagtgaagaaaaaggagaagcgctaaaagaagctggatttaatatacgtattggtgattatgatgatttagactcaatgaaagaagcgttgaaaggaatagatcgattgctttttgtctctggcgttccaggaaatcgtcaagccgaacatgagaatgtagtgaaggcagcacaagcagctggggtatcttatatcgcttatacaagttttgcagatgccgatcactcgatcagtgtattagcgccagatcaccaattcactgaaaaaatgattaaggattcaggtatttcccatacatttttacggaataattggtatgtagagaatgaattacctatcattgggcaggctttaaaaactggtcaattcgtttatgctgcaggaaatggaaaaacaggttgggcattgaaacgtgaatatgcagaagctgcagcaaaagtactagtagaaagtgactctccagaaatcttagaattatccggcaatctaactgactatgaagaattagccaaggcattagagcgtgcgacaggtaaagagttagaaattattgaagcaagtgatgcagcgtttgtcgaaaatctaaaagaagccggattccctcaagaagcagctgacatgtttttagcgatccaacatgatattaaaaaggatcagttagctatttcctctgatgatttagaaaaagttttgggaaaaccattaacttctcttgaagcagcattaaaagaaatattggatcaggaataatgtataaagaggttgtgaaaaagccgattagttttgagtatgaagaaaaattttgtgaaaaagctgttctgcatcaagtaataagaagagtcaaataaaaaatagctcttcatatgttacgtttggctggacttattaccgcggagttggcaggagaacgccgtttttattcggaaaaaggagctgagacaagatttttgtctcagctcctttttgtttatcgataaaaaagtctggggaagacgatggctcaggctttgttggaaacagagccgattttatcatttgcttttacatcacgtgcgggttcgatttctaagctttggactttgtcgccatttgtgaatacaacgaccatatccgtgtttttgcctgcagattgaatagcggcaagatcaactaaagcaatcaattgacctcttgcgactttttgaccttcttctacatataaagtgaatggttcgccttttaagtcaacagtgttgatgcccatatgaagcaagacttcgataccagcatctgtttggattccgacagcatgtttcgttgggaaaatgtttgtgatcgtaccagcgattggagagaagatttctccattttctggtaatacagcatagccgtcacccatcattttttccgcgaatacatcatctgaaacttcagtgattggaatcagtttcccatttgcgatagcgtaaatatcttgttcgatcgtttcaccggcaaatgtttctgttttaaccacggtgtttgtttgtgcaggtcgtgctgcagcaccaccacgtagttttgccatctcatctgcaacgaattgtacttctgtacctacgatgacttgcgcattttttccgtcgatgatcttcataccaggtacgccagtggctttgattttattttgatcgatcaggcctgtatctttgacttgcaaacgaaggcgtgtagtacagttatcgatcgaagttacattgtcggctccgcctaatgcagcgtagattttgcttgcttgtgccgcatatttattgtctgaattagtcgttgcagtatcgtcatctgaaagatctgcttcctcgcggccaggagtcatcagatggaattttttgatagcaaagttaaagccaaagtagtaaatcactgctgttactaatccttggacgatcaacatcaatggctgattcgcaatcggatttttcaaagataggaagtaatcgacaaatccggcactaaaggcaaatcctgctgtccaatggaagaatgcactcactgctaaagaaatcccagtgaaaattgcatgcaagacatataatggccaagcaacgaacataaatgagaattcaagtggttctgttacaccagtaaagaatgaagcaaaagctgctgctaacatcaaggaagctgtttttgctttgttttctggacgtgcatttctgtaaatagcatatgctcctgctggaagcccgaacatcatgattgggaaaaatccagcttgatacattcctgttacgccttttgttccttcagaagccaaaaatttaccaatatcattgattcctgctacgtcaaaccagaacacggagttcattgcttgatgcaatcctgtagggatcagtaaacggttgaagaagccataaagacctgcaccaccccagcctaaactcaaaatgaatttagcaaaagaaactaaagcagagtaaaccggaggccatacgagcagtagcactgcactgatcagcaacatgacaaaggcagccaagattggcactagacgcttgccgctaaagaaagataaagccatcggtaattttgcttcgtggaaacgattataaagagctgccgcaatcaatccggcaataataccaataaatacgttactgatctgagcaaaagatggatcaactgattctggtttgatattcaataaagtagctactgaatcagtttttaaaacatttactggaacttcaaatgcgaccaaacctgccaaggcagcagcacctgatttgtccactgacatccctagtgctaacccaacggcaaacagcaaaggtaattgacctaaaactgcgttaccgccagcttgtaaaaaatgagcgacaatgtcgttactataagatgcccaccagtttccgatccctactagtaaagcagcagcaggtaagaccgcaactggaagttgaagggaacgtcccattcgttgtagatatgctttcaatttttttcctcctcatgattgttaacatttgtttgtacgattgcgcttcttaaacgctcgatatggatggccaagtaacccagttcttctttcgtgatcgcgagctggtattctttggtcagcaacacacggatttttttagaaatcttatagctttctgggtattttcgtttgaccatttctacgatttccgtgtctaaaacagcatattgttgcgcatgggttcgttgtagaagcagtcgtaaatgattcaccagtcttgaataattcagtgaaaatggttctgaatggatatctgtttccaattctgattccactaaatggatgatgtcagatacaatcgtcacttcacggatactgcgatggttattgttccgaccgcttcgtccgctgtgaatatggattgcgatatatcctgcttcgtcataagtatatggaatcccaagctcttttgtcagatactctactgcccattgagcaatactgaattcatcactgtaaagcacttcgatttctcttaaaagtttgttgcggatgacgataccgttattaatgttctccgcagaaaaagcaatgtggtcggtcaaagcgatcaatacatgttcattcaacttttccatcaaaacagtttccgcatgatcaatgatcgtttctgctgcaaataaaaagcgttcatcaatctgattaagtaaattttgcaacttgatttgaccttctggttccatgacaaatatccgttcgacatcacgatcaaaaatcaaatcatttctttttctgtcaaatccaatcccttttccaatagctactttttcctgtccaccgtcatctaccaatactgcattttgattaaagatctttttgattttcatgcgcgcaccctttttgaagatttggttttcacgtttgctagaccagttgattgcggccaaacaaaaatagacacgaaaaacctcctagggaaaccatgttcctcagagatttttcatgcctagtatgatctagtcacatgaaacgaattattgttaacgtaatcaattttatatagacagttatgttttgtcaattctttttttataattatagtaatttactggaattatcagaaataaaaggaagaaataaattaagaaacttatgttatttaatcgttggatcttttgcttatcttattcgttgttaaaaagctgaaagcgaaggaaaaaaactctacttaactgtatttctccgttaggacatctaaaaatttacgagcagcaggagaaagaggctggtcttttttccaaatgagattcagtgaagcttgtaatggcggatcgagtgggatgaatattttttccgtcccataagtattgatgatcccatctagagctaatgcaccaaaagtcccgttatcgaccatcaaagaagcattgtacaataagttatatgttccgacgatcgataactgatctatgctgaaacctagccattcagctagttgactgtccactgacgtttgccgggaaatgatcaaaggaacagttttcagttcctgcggatggatgacggtttgctttgctaaaggatgatttcgatgtatcaaaagtccccaacgatcttgggctggcagtcgaaatgactggtatttttgtttgtttgtcggttcgattacgagtccaaaatcaagtaatccgctatccagtttgtctatgatatcatctgcattcccgctatataaatgaaactggatatcaggatgcgccttgatcaacgaatgaaggctatcagaaatgaaagagattgctttagtttcgcctccgccaatgtagatttctccagagatgattgcgtcatttgttaaattgttcgccgttttttctaccaacgacaagatttcttttccttttgaataaagatatcgaccagaatccgtcaactgtatctctcgggagcctcgagtgaaaagtgtcacaccaagttcttcttctaaatctttcagttgttttgagagagtaggttgcgtgatatgcagagattttgctgctcggctgatatttttttctctagctactgctaaaaaatacgtcagtatacgaatatccattttttccctcctgtttttaaaaaagcataccactaagtatagttaaaaggaatagttaagtatgttttataagtattagacatcataagccgtccgttataaagtaaggataaaaggagggagcaaaatgacaagcctcatcgaaaaacaaatcgtcaataaagagattcgagtaacggatccgctctttgaagtgatccatcagatccaagctgaaaacgaagagcctttagcagcgctgaatactgggtaccatgaaccagcagatatccgcaaacggctagaaaatatcattagtgacaaagtagatgatacggtgactgttctgctgcctttttatacagatttcggcaaacatattagtatagggaaaaatgtctttatcaatcgtcaagcgatgttcgttgacttaggtggcatctgtttagaagattcagtattgattggtcctcgtgtcaacctcatcacggtgaaccatctaaccgatccaaaagaacgaagaggcttgtcagtaaagccaatccacatcaagaaaaatgcttggatcggagcaggagcaactattctgccaggcgtaacgattggcgagaatgccattgttgcagcgaatgcaactgttacgaaagatgtcccagacaataccatcgttgcaggaatccctgccaaaatcgtcaaacctgtcgaacggattatttgaacagtaagatgaaataagagatagtgagtataagcaagagatttttcaaaacaggaggagaatagaatgaatgatttatcagaaaaagtgattgtcatcatgggcgcttcaagcggaatcggtgaagcaacaacgaagctattagcagaaaaaggggctaaactagttatagctgcacgccgagaagatcgcctaaaaacaataaaagaatctttaccagaagctgagctatatattcaaacagcagatgtaagagattttgcacaagtccaagcagttatcgatttagcgatggaaaagttcggtcgaatcgatgtattgtacaataatgcaggaatcatgccaaccgctccattagttgaaggtcaccgtgatgaatggcaaaatatgcttgatatcaacatcatgggtgtgttaaatggaatttccgccgtacttccaatcatggaaaaacaaaaatctgggcatatcatttcaactgattctgtggcgggacatgttgtttatcctgattctgccgtttattgcggaacaaaatttgctgtccgtgcgatcatggaaggattacgtcaagaacagcgacaaaataacatcaaatctacgatcatctctccaggagctgttcaaactgaattgtatcaaaccatcagcgacaaaaaggctgctcttgaacttcatgaagcgcaaaaagaatggggattgacctccgaagatatagcatctgctgtagcatttgcgatagaaacgccagaccggatgtctgtcagcaacatgattatccgtccgacgacacaggaagtataatccataacggataatatccagagagaattacttgttaaatagttattcaaacgaccatcaatttaaggcgtgaatggagaagaatattcttcatttacgtctttttatgcagaaaaagcaaatttattaaaaagaaacaaacgttatttaaatatggacattgacttgcttttacttttttagttacactgttatttaggaaaagtttcataattcaaaggagaaaaaagatgaaagcaaagaatttattatttagcgttattcttttaggaaatctagcagttgccaacacaacagtgctagctgaagaatcgacagaaactgtcgcaactcagacatcgagttcttcagaaacaggaattgaaaacgatacagaaagtactttgcagtcagctactgtctcagaaaatacaatttcaaccgaagaaccaacaactgaaacaacagaacaaacacaaaccgaagacagtacatcagcagaagctcagaacaatccagagaatgcagaagaaatcacgaaccaattgacagatgggcaaacattgacacatacccatcaagcaaatttgtctgaattcgaaaactatactggctatgctttttatgctcgctcatctgctaattctcaacaagcgttcattgatagtattgcctcaactgcacaaagtttggcaagtgccaatgacttatatgcatcagtcatgattgctcaagccatcgttgaaagtggctgggggaacagtactttggcttctgcccctaattacaatctatttgggattaaaggaagctataatggccaatctgttacgatgcctacttcggaatatgtgaatgggcaatggattacggtgaatgccgcttttagaaaatatccttcgtacaaagaatcattgcaagataacgtaacggtattgaagacgacttcttttcagccaggcgtttactactattccggtgcatggaaaagcaatacgaactcttacaaagatgctacggcttggctaacaggtcgttatgccactgcgcctaattatggttctacattgaacaatgtaatcgaaacctataatctgacacagtatgatacagcaccaacttcaacttctccgatgtatcgtctgtataaccgtcatacaggagaacatttatatacattgaatgccggagaaaaaaattatctgccaactgtaggctgggaatatgaagggattgcttggcaagcaccaaacagcggacaacctgtctaccgtttatacaatccttacagtggagaccatcattacacaatggcacaatctgagatcaactctttaacaaaaatcggttggcgttatgaaggtctaagtttttattctggtggttccaagccaatttatcgactatttaatccaaatgaaaaaactggtacccatcactataccttgagtgctaaggaaagagattggctaacaccgatgggctggagatatgaaggaataggattttatggttattaaaaagaggttgtgacagaagtggtcagcttcaagaaataagaaggaatttacgaaattgcttttcaaatttttgtgaaatcagcgtcctgacctgagtattagagaaacaaacgaaaaaatagttcttcatattttgccgttttttgagctaataccgagggacagctgattgaacaccgtgtatcagaggttgtgaaaaagctgccctgcatcaagtagtaagaacagccaaacaaaaacagattttcatgttttttgtttggttgaacttattaccgcagatgcaagtttttgaacaccgtttactcaaaaaaggttgtgacaacatcttgtcataacttttttattaccgtttaagcatactgatccaatttctaatattcgacgggattcttgcaaaaggcgatttcggaaatttttggcggtgtaaaattttctactgcagaagagctatcttctatagtttgataagaatcaataatcttggttttagcgttgtgctttctttatcattttttccgttcattctacaaaaaatttcttttctctatacttttctattgagagcgtttttttattacacagctgattctttgacttttttctttttttattctattattgacaagtcaatcgttgacgagtcaattattagagaggaggaaattatgtctttagaagagattagtcaccttttatatcaaatcaaattagccgatcaaaaaatcgtccagatctttgaagaaaatatcggtataagtcttactagatacgagatcatgatgagactgaaagaagaaaatccattgctacaaagcagtttgcaagaaaagttgcagattgatcaaggagcagttactcgtcatctgaaggtattggaagcaaatggctatgtttcgcgtcagagaaatcctcagaacaaccgggaagtgtatgtagcgctaacagaaaaagcccagaagaaaatcgagcattgtgaaatggaccataaagatacaggttccgtgctatccccggctttcagcgatgtagaaatgaaacaatttctaacacttttagataaattgaatacccaactttgcaatataacaacagaaacgaaagaggttaataataatggaacaaaaaaatgatttttcaacaattatgactggtagaagatccgttcgcgtatatgatgaaacatacaaaatcccacacgaagaaatgctggaaatgatcaaagaagcgacgactgcaccttcttctgtcaatatgcaaccatggcgctttgtggtcgctgaaagcgaggaagcaaaagaaatcttgcgtcctttgatccgtttcaatacgagacaaaatgatacttcttctgcaatggtcatgatttttggcgatatgcaatgttacgaatatggcgaagaaatctataaccaagcttacgaatcagggaagatgccaaaagaagtcagagatcaacaattagctgcgatcattccttattacaagagtttttcaagagaagaaatgaacgatgtagtcaaagtcgattctagcttagcggctatgcaattcatgttagttgcgcgtgatcatggctatgaaacaaatccaattggtggattcgaagcagatcagttggcagaggcatttggtttggataaagaccgttatgttccagttattattttatcaataggaaaagcggtagaagaaggttacgagtctgttcgtttagcaccagaaaagatcactacgttcgaataaaaggttttcagttactattcagtagctattgctttttttgaatcgtgtgtggtaacctaataaaaaaggaggtcggaaaaatgactgcatcgatgaaattacgtttcgaacttttgaataacaactaaataaattcaaaagacatgtataaacaacaatttcatggatggagtatgtccattttttcgaacgacagtagaataggtgaaagctatgacagatttggtgatttagtcatagttatttcgttcagagtaggaaaagatgtgatgcagtttttttgcaaacagatttttctgctcttttttagtatcgataattgttgttttacatgaaataggagtgtaaaacatatggaaaatttagcagtaaatataacaaatctacaagtcagctttggcaaccagctagaactatctattgattctcttcgtgtctatcagcaagatcgtatagggatcataggagaaaatggtgtcggtaaatcgactttgctcaaactaatagccggtgaactttttcccgatcatgggaaaatccaaacagagatcaccttcaactacctgcctcaattaacctatctcgctgaagcaaaggacctaaatttggaattagccagtcatttccagttaagactggaagaaacttcagagcggaaatggagcggaggggaagaacgaaagatcgaattgatacgtcttctttcttcttatgaacaagggatgcttctagacgagccaacaacccatctagatagaaaaagtattgatcgactgattgaagagcttcgttattattatggtacgctggtttttgttagtcatgatcgctattttctagatgagctggcaacgaaaatctgggaagtaaaagacggagaaatccgagagttttcggggaattatagtgcctatctcactcaaaaggaattggagaaaaagactcagctacgagaagcagagtcgatcatgaaagagaaaaaacgattggaaaaatcgatccaagaaaagaaaaaacaagcggaaaagttggaaaaagtgtccagtaaaaagaaaaagcaacaaatcagaccggatcggttgtcttcctctaaacaaaaagacagtgtacaaaaagccatccaaaagaatgcgaaaacattagagagaagactccaaaaaataggagaaacaaccaagccgcagcagatgaaacaaatccgttttccagtaccaaaatctcttgaactccacagccgctatcccatcatgggacaaaatgtccaactggaaagaagtgggagaacattactggtaaatggtgattttcagttttctttaggtaaaaaaatcgcgattgtcggtgaaaatggttcaggtaagacaaccttattagaacatatccgcaaacaaggagaaggaatccttctctctccgaaagtaagctttcaagtatatcagcaaaagggttatcaaatgacatctgaagaatccatcattcgttttgtcatgagacaaacagagttttcagaatcgcttgtccgtagtttgctgaatcacttagggtttgctcaggaaactttgacgaaaccgttatgtacattaagtgggggagaagcgacccgtctgacgattgctttgctttttactaagccaagtaatgtgttgctgttagatgaaccgactaattttattgatatggcaacgatcgaagctttagagaagctgatacaaatatatccgggaacgattttgtttacttctcatgattcttactttgtcgagcgtacggctgatgaagtttatgaaataaaagggcagaaaataaaaaaagtacttacgagaaatttttaaatgtgctacgatgattttcgtgacaaatttaaaggagtggtacagattgcctacaaataaaaaagaaggaataatttttacaacaatgatgtgttttttgatggtcttggggatgagcgcgtataatttatggctgcatcaagatcttcatttatcaagtttgttgattggtctagtgcctggattcgtggtggctttcattttggatgtcttcatcatcggtgtgctggcgaaaaaaattgcctttaaactaccagtaaatccagaaagcaaggtccaaatgatcttaactatttcatgcttgatggttttaggaatggtgacatgtatgtctttattcggtgtgatcatggaacaaggaatacctgatcaattattctctgcttatatgaatgcttggaaaatgaatgtgattgccgctttaccgttgcagttgatcatcgttgtcccgctttcaagaagtgtgctaaaagcaattcaaagtaatgaatgatggaacactgttatttgaaaaaaggccttggcatgctttttgtcatagtctcttgaatgcagttctagaaaaatagtgatccgaacgataggttttggcctgtcgttcggatcgctttttcttttccaactgtattgctcttttattgaagataatttgctcttcaatagatatttctagaaaggttctgtttatcccttactcaaaaaactgctgcatttgttctcttacttgctgacaccattggagttcctgctgacaaagcatgattcggcgctggattacaacgtaacgtccaaattcttgtttcttgtctagcgagaggtcattcaattttttttgatttttttgcatgattttgttcagctgttgttctctagtgaatagcagtccagtagctgttgttttatcgagcgtcgaaaaagcatagatttttgctagaaattcatctttttgcgtaggagcgggagtttcctctttgatccattcctctacaagaacacgtccttcatcagtcaagtggtagatctttttttgagagtgctcgtctttgtccaaaacggtcacataaccctgctggtctaacttggcaagcgttgtatagatctgactgtgatgggcttcccaaaaaattgtgatcagctgcttcaattcatacccagaacgtggtttggataaaagcacgcataataatatataggctaaagtattcataaaaatcctacctctcgtcttattttctttattatatcacagtaaagtttccatgttttacatgtgcatattgacatgtaaaataaatcatgtatgatgctaatagagagaaagggatggaaatattggagaatcaaatagatatacaagaacaaacaaatgaagaaacaaaggggaaaagttcagcgctagttgtagcagctacctgtatgatcgcttttatgggagtgggtctagtagacccaatcttaaaaacgattgctgcacagttaaacgctacgccagctgaaacgaccctgttatttactagttatatgttagtcactggtgtggtgatgctatttacaggtttcttatctagtcggatcggtttgaaaaaaacattgatgacaggattgtttatcatcgttgtattcgctggtcttggcggattatctgggaatatcggaatgctgattgggttacgtgccggctggggtgtcgggaatgctttatttgtctctactgctttagcaacgatcgtcagtattttagttggtaacacagaaaaagcaatcatgatgtatgaagcagcacttggctgcggaatggctgttggccctctagtcggtggggtcttgggcagtggttcatggcgttatccattttttggggtagcatttttgatgttttgcggttttatagccctagcggtacttttacctgaaactgagaaaccaaagagaaaagtaggcctttgggaaggtgtcaaagcgttaagcaatcataaacttcgttcagttggactaatcgcattgttatataatttcggattctttactttacttgcgtatgcgccatttttattgattggttatactgaattagaagttggttttgtattttttggctggggtgtgcttctggctattgcttcgattttcgttgcaccggctcttgagcggaagtttacgacttatcggacaattttagcagcatttgtcttattcattatttgtttgctgttattaggggctggaacttctatgccagtccttgtaccgatcagcattgtgttagcaggatttttccaaggaattatcaatacactgttgacgacgattgctatggaaataccaggtctgcaacgaaatgttgcttcttccagctatagttttgtccgctttttcggtggagctttagcaccatttattgcaggtgtgattggtgaacatattggtgaaagctatgcgttttattttgcaggtgccattgttcttatcagtgtatgttgtatcatttatcaccgtaattattttgctacaaatgaagaagaataagaaatcagaggttgtgaaaaagctgtcctgcatcaagtcataagaacagccaaacaaaaatagcttctcatatttttcgtttggttgggcttattaccgcagatgcaagcttttgaacaccgtttatcaggaggttgtgaaaaagtcgcttagtttcgagtattaagaaaaattttgtgaaagtggctttccacatttttgcataaatttggcttaataccgagaaactggcttttgaacaccgtttaccaagaggttgtgagactgtcgtttaactctgaatcacaaggaacaatttcaaaaaacagtttctcatgtttgttgaatattgtgacttatgattgaggagttggcagaagaacaccatttattcggaaaaaggggatgtgacacgatttttgtcacattccctttttttctcaaaataatgaaactggaaaattttcagtaggtaagctaaaattcatttaagaaaaagaatggggggataatagatgctggaagaatattttcaggaagtcgggttgacactcgttgaattacccattgaattttcagatgatcggttgatttatcgtggctatatcaaagaattgccaataattaatgcggaaggtgaaactagaaaagcgatgcagcaaaaaatagctggtatgtatcaggtgtatcgggaacagctactggctgaatcagcggaagaagaaaaagaaaaaacgatgaacttgtccatggatgagctgcttcgttattatgatggcgaaacatttgacggattttcgcttcttaacgaagaggaaacagatttaccaggcagctggtaggcgaacaccgtttatatgggaagaggctgggacagaagcgtttaactccaagaaataagaagaaattcacgaaaattgcttttcaaatttttgtgaatttcagcttatttccgaaggagttgcttctgctcccgccgtttatacatgtttagagcgtgggacaaaagtttttctttacttttgtcccacgctctaaaaagtccggcagttttttgccgatcttcaaggcactctacttatcgtacggatattttttagcggaaagtccgattcaagtggtttttattcagctgatatttataagataagtgaaaaatcccagcaatcagtagcgtaatcgtataagcgattgaatgatcgaaaaaagaatagtaattgattgtcgctaataagcataatgcaaccatgtaactaatgtgcaagcgtgtaaccagcccttttggcccgattttgtcaaaatactgcgaccatttttcccgttgactccctatgcttcgttttttgaattgaaagaaaagggataaaataccgactcccagaaaagcagcgatattcagagaaataaggtaaataaaaaaaatcattaaaatttcaaacatattgacacctttctagttggatagaacctttacagaaaaaaggcaaaaggcgggaataatgtttcacacgaaacattattcgcggatttgtccatcgccataaatgatatattttgtggaagttaattcatttaaccccattggaccacgggcatgcaatttttgagtagagataccgatctctgcaccaaaaccaaataccgatccgtctgtaaaacgagtggaggcattgacatagacagccgccgcgtccacttcatttaagaaacgttgactagccgcataactatctgtcacgatcgtttctgaatgtttagtattatgccgattgatatgtgcaattgcttcatccaaagaatcgaccactttgacagcaaggatataatctagatattcagtatcccaatctatgtcttctgctaaagcagccgtctctagatattctaacgcacgagcatccgcacgtaaagagaccccgtgttctaccagttctttttcaatagctggcaagaaaaaaggtgcgatctcagaatggatcagcaatgtttctgccgcgttacagacagatggacgggaagcttttgcattgacgatgatgttcactgccatagccaactgtgcttctttatcgatatatacgtgattatttcctgtacctgtttcaatgataggtaccgttgcctgttctttgactcgttggattaattttgctccgcctcgaggaatcagcacatctaagtattctgtcaatcgcatcaactgtcctgcagtttcatgagaagtatcatcgacaaactggatggcataaggagattcgccagcactgaccagtacttgctgcaataattggactaataattgattcgagaagaatgcttctttgccaccgcgaaggataacggcattccctgatttgaatgctagactagctgcatctgtcgtgacatttggacgagattcgtaaatgatgccgatcacgcctagtggcacgcgctttttgccgattctcaatccgtcggtgttcgtccacatctcatctacttttccaataggatcgtctaacgaagcaattttttcgatctctgtagccatggcattgattcgctcaggtgtcagctgcaagcggtcttgcatcgtttcactgatattgttttcgactgctttttctaagtctttatgatttgcttcaatgatcgcttgttgattctttttgatggtttgtgccatttgaacaagtagctcatttttgcggtttgtaggcataagtgctagttgttgcgcgctatcttttgcctgttgtcctaattgcatcaagtcagtcatttcaagtcctccttaaataaagtacctacttcttttcctgcaagaatatcaaaaataattgccggattttttccatttgctaaaatcattgcgctgtttgcttcaaatatcctagaagcggcttttaatttactctgcataccgcctgttccaaatgtgctaccagcaccacctgcttgtgccagaatcttttcatcgattttatcgatatagcgatacatctgagcctcgggatttgtagtcggattatccgaataaaacccgtcgatatcagaaaggacgatcaaaaggtctgccgcgacaagttttgccatgatggctgacagctgatcattatcgccaaattttgtcagatgatctaattcatccactgctacagtatcgttttcgttcacgatagggatcgtgtccataatcaaaagctgttccaatgtattcctcacatttttacgactttcaggataatctaccacgtctcttgtcacgaggatctgtgccgtctgttgattatatacactgaatctttgattatagatattcatcagttcggcttgaccaacagccgccgcagcttgctgttcaggaatcaaagtcggacgttctgacaaatgtaatttatgcataccaacgcctacagctcctgatgagactaagatcacttcctttccccgatttctaagatcagaaaggacaaaagctaactgatcgattgccgcaagattgatatttccattgggataaatcaatgtacttgttcctactttgacaataattcgttttgcatttttaatttctttacgcatgtgacacctcaatcaaatatccactcattaatttcgttctattctacttgttttgacgagtaaagtcatgtaaaaaatagtttttttgtacaacttgcagttgttcggtaaaagaacgcgttgttaatggtttactttaagatagcagaatttcttgaagaatttgtaaagaaagtcttttacagcctcggatatgttagaataggagtagtttatttagggaggaaaaccggtgagaaaaagaggatttgaagttatttctaaatataaagagcaaaatatcaatctaccgcagcgcgctacacatcatgctgctggctatgattttgaagcagcagaagaggtcgtgattccaagtatctggaaagcaggctggaaaaaggggttggaaacagtcgcagatggattgaaaaaagatgtatcagaaaatgaaaaacaattgaaaccaaccctcgtgcctactggaatcaaagcttacatgggagaagatgaatttttgcagcttgctaaccgttcaagcaatccgttgaagcggtttttagtgttgacaaacggagtaggtgtgattgacagcgattattacaataatgaggcaaatgaaggccatatcatgttccaattcaccaactttggtttcaaggatgtagtgatcaaaaaaggtgagcgtatcggtcaaggaatcttcttgccatttttaaaagcagatcaagatcaaacgactgctcaacgtcaaggcggatttggttcttccagtaaataaaacgataaagaaatttaagcttgatttaatgtctcatgattaggataaaaggaggcggtacaatggcaaaaaaatcaaaagtacaatttgtttgccaaaattgcgggtatgtgtcgcctaagttcttgggacgctgcccaaattgcggaaaatggaatacgatggtcgaagaaatcgaacaagatacaacggaccgcagaactcggacaagtttgacaggagaaaaagcaaaaccaacaaaaatcgcagacgtcgtccctaaaaaagaacctcggatcaaaacaaaattagaagaactgaaccgtgtgttaggcggaggtgtggtaccgggatccatggtcttgatcggtggcgatccaggtatcgggaaatccactttgctgttacaagtttctcagcaattagcagccataggcggaaaagtcttatatgtatccggcgaagaaagcgcagagcagataaaattacgcgcggaacgcctcggaagtatcaacacagaattttatctatacgctgaaacagatatgaacgaaatcagtcgtgccatcgaacatatctcccctgattatgttatcattgattccatccaaacgatgacgcagccagacatcacaagtgtggcaggaagtgtcagccaagtaagagaaaccactgcagaactactcaaaatcgctaaaacaaatgggatagccatttttatcgtcggtcatgttaccaaagaaggctcgatcgccggcccaagaatgttagaacatatggtggatacggtgttatattttgaaggtgaacaacatcatagttttcggattttgcgagcagtaaaaaaccgatttggctcaacgaatgagattgggatttttgaaatgcatgagcatggattggaagaagtcgctaatccttcacagattttcttagaagaacgcctagacggtgcaactggctctgctatcgttgtggcaatggaagggacacgtccaattttggtagagatccaagcattagtcacacctactatgttcggaaatgccaaacgaacaacaacaggtcttgatttcaatcgggtatctctgatcatggcagtgctggaaaaaagagctgggttgcttcttcagaatcaagatgcttacttaaaagctgcaggtggggtaaaattaaatgaaccagcgattgatttagctatcgctgtcagtattgcttcaagctataaagaaaaaggaacacagccaacggaatgtttcatcggtgaaattggactgactggagaaatcagacgtgtcagtcatattgaacaacgagtcaaagaagtccaaaaactcggcttcacaaaagtatacctacctaaaaacaacttaggtaactgggaagcgccaaaaggaatcgagatagttggagtagcaactttggctgaaacgttgaagcgtgtgttccgctaactaataaatgattgtcgaaacggaggaaaaacgatgcaaaaacgtgtcattactttgctgatgatcattgtcggcgcaagcttgggtatttcatttttaccctcagcttggcaggcaatcggtcaacagtcaaatgggtggctgaataatacatttaccaacagcttgttaggcgcacttattttctttttattatctttgctgttggccaaacatatctcagctattatcaaacaagtagaacaaaaactaagtgaggtcagcttgacttatcttctcttcggtgcgatcggtgcgatcatcggattgactttaggtgttgtgatctcgacccctctttacaatatggaaattccattcgtcaatagtgtattgccgattttactgatgatcatcttaggttatctgggattgagaatgggaacaacacgaatcgaagaatggaagaaagtttttggttcacgaagcaaaaaaatcgagcaagaaacagctagtcaagttgagagtcaactgctagaacgaaaatcaggagaaaatttccataaatataaaatcttggatacaagcgtgatcattgacggtcggatttatgatattacaaagactggtttcttagaaggaaccttgatgatccctaattttgttctttacgaactacaatacatcgcggactcaggggatagtttgaaacgtgtgcgtggtcgtcgcggattagatatcctaaatgccttgcaaaaagaagagggtatatctgtcgaaatgtacgatggagactttgaagatatcagtgaagtagacagcaaattgatcaaattggctaagcttttagatggtgtcattgtaaccaatgactataacttgaataaagtctctgaattccaaaatgtacctgttcttaatatcaatgcgttggcaaatgccgtaaaaccagtcgtcatccctggtgaaacgatgaatgttctagtagtaaaagccgggacagaacgccaacaaggagtagcctaccttgatgacggcacgatggttgtcgtagaagatggacagcattacatgaatgaacgtatcgaagtcgttgtaacaagtgcccttcaaacagctgctggacgcatgatctttgctaaacctgcacatgcaggacgaggaatcgacaataaaaaagagacagagaaaaagactaaacaatcaaaataaaaaagaaattcagccaactggtaaggaaattcaaccagttggctttactatttaccttagaaaaggtaaaatttgtgctgagtggctttaaataaatgatatttgagaagccgtaactgacggaatttttgctgttagtcaaagtctagtttgaaagaagaggaagaaaatgacgaaagtacgcgtacgctatgcaccaagtccaactgggcacctgcatattggaaatgcaagaactgcattattcaattatttgtttgcccgccacaatgatggagactttattattcgtattgaggatactgaccaaaaacgtaatatcgaagatggcgaaaaaagccagttggaaaaccttgcttggttgggaatggattgggatgaatctcctgaaaatcctggagaatacggcccttaccgtcaatctgaacgtaaagaaatctatcaaccgctgattgatcagctgcttgctagcaatcgagcatacaaatgctattgcacagaagaagaattagaagcagaacgggaagcacaacgcgcaagaggagaaatgcctcattacgcaggaacatgtgcgaacttgacacctgaagaacaagcagaaaaagaagcacaaggtctagaatctgttgtacgtttccgtgtgcctcgcaatacagaatacgcatttacagatatggtgaaaggcgctatttcgttcgaatccgataatatcggtggtgactttgtcatccaaaaacgcgatggtatgccaacttataattttgctgttgcggtcgatgatcatttgatgaaaatcactcacgttttacgtggagatgaccatattgccaatacaccaaaacaactgatgatctatgaagcatttggctggacaccaccaaccttcggacatatgacattgatcatcaacagtgaaacaggtaaaaaactaagcaaacgtgacgaatcaatcttgcaatttatcgaacaatatcgcgaattaggctatctaccagatgcaatgttcaactttattgcattattgggctggtcacctgtgggcgaagacgaaatcttcgaacaccaagaattgatcaaaatgttcgatccaaaacgcctaagtaaatcacctgcagctttcgatgcgaaaaaactgcaatgggtaaacaaccattacatcaaagcaatggatctagatgcatttactgacatgtgtctgccttatctaatcgctgatggacgtgtagcagaaaacccagatgaaaagacaatcgaatgggtgaagaagatcgttagcctgtatcaacctcaaatgagctatgctgcagaaatcgttgatctgtctacgctatttttcaatgaacatcctgtattgaatgaagcagcaaaagaagtacttgctggtgaaacagttcctactgttctccacgcattcaaagcacagctagaacaaatggaagtagtagatgctccaactgtcaaagctgccatcaaagctgttcaaaaagaaactggcgtaaaaggaaaaaatcttttcatgccaatccgtgtagctgtatcaggacaaatgcatggaccagaattgcctgaaacgatcgaattgcttggtcgtgaaaaatcattagcacatttaaatcaagtactgaactaaacacgatgaacagaaaaaagtaagcagctgatcattacaagagagataccgggtggtgcaaggtatcaatgaatggttgccgaaatgcctctgggagtggtcttggcgaaaacacagaaaacaggaaaaactgttttataggaaacgaagtagccaagaacgtataacaggcgttagctgtcagagataatcgttgattatgaagaaaagtggaaccacgcggaaagcgtcttttgataaggaaacttatttaaaaggcgcttcttttctttataagaagctgttttcctacataaaatacttacgaaaggagtggaaagtcatgagttggtttgcccgagcgattgatgcagcaaagagaaacgatccggctgcacgttcgacagcggagatcgttttgacctatcctggttttcatgccttgttttggcatcgtttctctcattttttatatcagcatcgcctctttttattggcgaagatcaatgctcaattttggcgtttcctgacaggtgttgaaatccatccaggagcaacgattggcactggcgtgttcatcgaccatggaatgggaatcgtcattggcgaaactgcagaaatcgaggatgatgtgattttgttccatggcgtaacattaggcggtacgggaaaagaaacgggtaaaagacacccaacggtcaaacaaggagccatgctctctgcgaatgcgcagatattaggaccggtaacgatcggaaaaaacgcaaaaatcggcgcaggtgccgttgtgttgaaagatgttccagacgacgctacagcggtaggagtaccagcaaaagtcgttcgaatcaaaggagaaaaagtgaggagatcagaatgataaaaatctacaatacattgaccagaaaaaaagaagaattcatccctatacaaaagggacatgtcggtatgtatgtctgcggaccgactgtgtataattatatccatatcggaaatgctcgtagcaccattgctttcgatacgattcgacgctattttgaatatcgaggctataaagtcgatttcgtatcgaatttcacggatgtagacgataaaatcatccgtacagcaaacgaattaggtattacagcaccagaagtcgctgatcgtttcatccgagcatttgaagaagatacgaaagcgttgaatgtcgagcctgctacactggatccaagagtcatggatcatatgccagatattttagcatttattcaagtgttggttgaaaaaggctatgcttatgaatcttcaggtgatgtgtattaccgtacccgtaaatttgaaaattatgggaaattaagtgaccaatccatcgatgaactggaagtcggagcaagtcagcgtacaggggaagaacagcagcaaaaagaagacccattagattttgctttatggaaacaagcaaaacctggcgagatttcttgggattcaccatggggcaaaggacgtcccggttggcatattgaatgttccgttatggcaacaaaacatttaggagaaaccatcgatatccatggtggaggtcaagatttggaatttcctcatcacgaaaatgaaatcgcacaaagtgaagcgaaaacagggaaaaaattcgctaattactggatgcacaatggctatgtaacgattggcgaagacgatgaaaaaatgagtaaatctctagggaatttcatcactgtacatgaaatgatcaaaaacgttgatccacaagtcttgcgtttcttcatggcgaccacacaataccgtcgtccgatccgctacagtgaaacgacgatgaaagaagcagccaccaatttacaacgactgaagaatacgtttgacaatttgaaattccgccaagaaactgcctcagagaatttggcagatgatgcggataaaatcgctttgttagaaaatttagaacagcgattcatcgaagaaatggacgatgattttaatgcagcaaatgggatcacagtggtctatgagcttgctaagtggctgaacacttatctagaccagccgaaagtttctgccgctgtcttggcacaaggagaagctttattctcgcaatggctttcgatcttcggtattttatttacagcagaagagttattagatgaagagattgaacaattgatcgaagaacgaaatcaagcaagaagcaatcgtgattttgcccgaagcgacgaaattcgtgatttgttgaaagaaaaagggatcttattagaagatacaccccaaggaacccgatggagaagagaagcatgagagattacacacaattgaacggtttagccttggcttatgttggagatgcgatttacgaaatctatgttcgtgaccacctgattgatcaaggagaaacaaaacccaataagctgcatcgtgcggcaacgaattatgtttctgcgaatgcacaagcctttttgattcagcaaatgctggaagaacatcttttgacagaagaagaagaactttattatcgcagaggaagaaatgctaaaagccatacgagcgcaaaaaatgctgatgttacgacgtatcgggtcgcaacagggttcgaagcgctcatgggctatctgcatttgacaaaacaaaccgagcggatggaagaattgatccgctggtgtattcagaaagttggtgaaaaaaatgggtaaagaaagaacaaacaaacatcaatcgaaacgtggatttgaagacaaaaaacaaaatagatatccaaataaaaagcaaactggacgaaatcagtcagtttctgatcaaaatgaagaagcattagaagataatttcgtctttggacaccatgccgcagtagaagcgctacaacaagggcgagggaataaactctttcttcaagaagattcacgaggagaaaaagtagaagaactgaaagaaatcgcacgtgaacaagctgtgccagtcaaatgggttcctaaacaaaaattagaaactttgagcgatcacggcgtgcatcaaggagtcgttcttgcgattacaccttatgaatatttatcccttgaccaactgattgaacgaacaaaagagaaaaaagaagaccccttctttttgattttggatagcatcgaagatccacacaattttgggtcgattttacggacagcagacgcaagtggcgtcgatggtgtgatcataccaaaacaccgagcagttggaatcacacctatcgtaacaaagacttccactggggcagtcgaacatgtccctgttgcacgcgtgacgaatttggtacaagctgtgcaacagctcaaagaaacaggattttgggtatttggcacagatatgaccggcacaaacttccaaaaatggaatgccaaaggatcaattgctttagtcattggtaatgaaggcaaaggaatgagtccaggattgaaaaaagaaatggatgaattgctgacgatcccgatgaccgggcacgtccagagcttaaatgccagtgttgctgctggtttgcttatgtatcaggctttttcccaacgtcagggggagtagaccatgaaaaaacagctgttgattgtagacggctacaacatgattggttcgtggccggaacttgtccagcttaaaaagcaggacaaaatggcggatgcaagagaagctcttttacatcgtttatcaaattatgcgaaatatgaaggactggaagtcatcgttgtcttcgatgcccaactagttccgggcatccaacaaaattataagaaataccagttggatgttgtttttacgaaagaagacgaaacggctgacagttatatcgagagaatcgctggtcagctgaatgaccgtttgacacaagtgacagtagcgacaagcgatttagcagaacagtggatgatcttttcccaaggagcattacgaacttctgcttatgaattatataagacgataaaaaaaacggaaaaaacaatagcccaagaaaataaagatatgcattttattgatttccgacgtaattctccatggaatgaagagcagttaaaaaaattgtcccaaaaattggacgatttaatgagaaaaaataaataacatatcgttctaatcagttcgatgaatcattgatgataagattcctccataaacgaatttatggaggaattattttatgtctgaggagttattgcgcgctgcacgtaatggtgacgaagaagcatttgctgccctgtatcaaaaatattttccacttttactacgtttgaaaaacacctattatttaagaaattatgtttctgaggattgggaacaagaagcaaggatcgctttatatcaggcattgagaacttacgaaaaaagcaaaggtgttagctttggaagttattataaaagcattataagcaatcaaatctattctctattgaggaagcagaacgcgctgaagcgtcgtgatcaaaaagatgaagtctcaatcgaccaaaaaatagagacagaaggaccagactttttagcagagatcacattgcaagaacctttagcgattcagcatcttttattaaaagaagcaatcgaaaattgcgaaatccagttttcaaaaatagaagctaaaatttttcattattatatgcaaggcgttgattttgtagacatggctgaatgtttagcaatggatcacaagcaagtaatgagcgcttacgggagagtaaaactcaaaataaaaaaacacttgaaattttataatgaggaataatttagaaaaatcttaatgagcttcttatttatttttattgcatttcttttttttttatggtaaacttgaaaattttaaaaatatgtggtatagttgatagtagaggtgaactgtatgccaacaactttagcttcaatcaagaaagatttagaaggtcgtatcggcagcccaatcatgttggttgctcagacaggaagaaagcgtcaaacagaacgccgcggcgttttaacagaaacctatccttcagtattcgttgttgatttggatcctgaagaaaattcttttgaacgagtatcttacagctattcagatgtacttactcggacagttgagatcgaatttttaactgaagcagtttaaaaagcaaacgagcctgagattcgtaaggttcgtttgcttttttgtgtgcgaatcggtatgctaagaataaaaaagcagggggcgtttgcttagtggaatatcaggtaaagaaatttgaagaattgtcaacagcagagttttacgcgatcgtcaaagaacgaatcgcagtttttgttgtggaacaacagtgtccttatcaagaagttgatgacattgatggacaagcttggcatacgttttttcaagatactgatgggaaggtccttgcctacacgcgagtatatgaagaagcggagagtatccattttggacgtgtccttgttcatcaggacaaccgtaaagatggtttaggaagaaagattgttcaagaaacgattaacatgatccagaaaaattttccagaaaaaccaatcgtgatcggcgcacaagaatacctacaagctttttatgagtcgtttggattcaaggcaatctcagatgtgtatttggaagatgatattccacatatcgacatgaaaaaggaacaagtagcaagttaagaatctaaaaaaagaaagccgacactgaaaatcggctttctttttttttagattctttattatttagaagtatcggaaagatttgtttgctctactggatgtgtattgtcttctgccacttgtttggcaagaagatcgcgtatgtcactaagataatcttctgcagtaggagtttcttccacttccacttgctcttctttggagcgtaaattcttcgcacggtttgccgctttgacaactaagaataagacaaaaccagtgatcagaaatgtaatgatagcactaataacgttaccaaacgcaaatgtgacgccttttgtcggcgaccagtcaagaattgaaagtgctccttctaaatcagaagtacctgtgatcattgcgacaaaccaacctattagtggtgtgatcaagccttgcaccacttggtttacgatgcttgtaaacgcactaccaataacaacgccgacagcaagatccaagacatctccacgcatgatgaactctttgaattctttgatcatgaatgaccctcccttcttttatttgtctttagtatatcgaaaaataaaaaataaaaaaacaatatacgcttttagccgtctgtttcttttgataaaaaacatctatgctatactataaagtgtaacatcatttagaaaaaacggcgaattgcctgaacttataaatttcaagcagaggaataagtaaaaaaggcaggttgacccattaaaagagtaagcgggcaatcatctgtgaaaaggagcatataaatatggtgtatcaattggcagaaggcgtgaatcttcatgtcttaccaacaaaacaatacaaaacgatccggatttttatccgttttactgcgcgtctgcaacaagaagtcatcacgaaacgttcacttctcagcagcatgttggaaacaaatagtttgaattatccggatcagacaaagttaagtgcgcaacttgcagagctttatggcgcaagctttggattatcagttagaaaaaaaggaaatttacattggctaaacgcagggatcagttttgtgaatggtgaatatgtcaatgatccaaaccttttttctcaagcggtagattttttaaaagaggttttattttatccaaatattaaaaatcatcagtttgatcagttgacgtttgacttggaaaagaacaatctgcgtctatatttggaaagtttgaaggaagataaacaaacttttgcttcctatgccttgcaagaactttattttgaaaacagcccggaacaaaagatcccagggttgggcgtagtcgaagatctggacaagatcactgctagttcgctagcgtcctactatcaagaaatgatggcaaatgatcaaatcgacatttttgttgtcggcgatgttgatccggacaaagcagctgaagcagttgggcaattaccatttgagtcgcgggaaacagtttatccagatctgttttatacccagcctcaagtgaatatcgtgaaggaacgacaagtacgtgagccaatcgttcaagcaaagctgaacctagcttatcagacaaatgtatattacgatgaaccagaacgttttgcgctaatggtctttaacggtttatttggcggttttcctcactctaaacttttcatgaatgtcagagagaaagaaagtctagcttattatgcctctagtagcgtggatacgttccgaggattcatgagtgtccaaaccggtatcgatgaaaagaaccgaaatcaagtacttcatctgattcacgagcaattagaaagtttgcgaaatggtgaaataacagagttggaactgtctcagacaaaagcaatgctgagaaaccaatatctgctttctctagactctccgcaagcggcaatcgaagcttcttttttggacagctggctgccggaaacaaaattatctgatgaagaatggttgaaacgtatggagagcgtaacgatcaaagagatacaacaagtagctgagcaaatcgaattgcaggcaatcttctttttagcaggaggaaatgcaaatgaataaaacagaatatgagcaaatcaatgaaacactttatcatgaagtactgccaaacggtttgaccgtgtatttgttgcctaaaaatgactatcacaagacatatggtttgttcagtacgaattatggttcgatcgataacgaatttattccctatggtgaaaaagaaaaggtgaaagttccagatggaattgcccattttttagaacataagttgtttgaaaaagaagatggtgatgtctttcaattatttgggaaacaaggagcttccgccaatgctttcacaagttttacgaaaaccagctatctgttttctacgacggatcaggtagaaaagaatctgacgactctgatcgattttgtacaagcaccttacttcacagaagaaactgtaaacaaggaaaaaggaatcatcggtcaggaaatccaaatgtatgaagacgaccctaactggcggatgttttttggcatactaaataacttgtatcctacacacccattgcatatcgatattgcgggcacggttgaaagtatcgacaaaatcacagctcaagacttgtatacgtgctatcggacgttttatcagccaagcaatatggttttatttgtagttggtaagatggagcctgagaaattgatgaaacttattcgggaaaaccaagaagcaaaaaatttccctccaaagcaagaaattgtacgttatttccctgaaaacacaaaagaaatcatcaaacaaagtgcattggaagcagccattacacgagataaatttgtacttggtattaaaggattagacacattgccgcaagaaggaacagaactgttacgctataaaacagcaatcaatctgttgttccaaatgattttaggcaatacttctcgaaactatctagcgatgtacaatcaaggaattatcgatgacagctttggttttgaattcagcttggatcgtgaatttcactttgcggacttcagcggagatacggacgaaccagagaaagcagcagaaaaagtcaaagaaatcattcttggattcgctgatgatccggaagtgtcagaaacaaatctcgatttgctgaagaagaaaatgcttggacaatatttccaatcattaaattcgatcgaatatattgccaatcaatttacgcaaagtttatttggcgatcgaactttatttgatcttcctgaaatcatcgattcgatccaaatgaaagacgtactggcagctggggaagcatttataagtgaagaggccttcagcgagttttacatgagaccaaaataaaccagtattttatgaggaaaagtcttaaatttcgttttagacttgtagtaggaacctcctccaaaatcagcttttatggtattcttagttgtgttggaaaaattagtgagaaaataaaacaaatcatgctctcttttaatcaacttatattaaaataaaatcaaacgaagtaatcaaagaggttgtgacagaagtggtcagcttcaagaaaagaaggaatttacgaaaattgcttctcaaatttttgtgatatttcggcttattgccgaagaagctacttctggaacaccgtgtaccaagaggttgtgaaaaagctgccctgcatcaagtaataagaacagccaagtaaaaacagattctgatgtttttaacttggttggacttattaccgcagatgcaagcttttgaacaccgtttaaggaagaggttgtgaaatcagcgttttgacctgagtattagagaaacatacggaaaaatatctccttatattttgtcggtttttgagctaataccgaggaacagctgattgaataccgtttaagaaagaggtcgtgagcctgccgtttaactccgagtcacaaggaacaagttcaaaaaacagcttcttatatttattggatattgtgacttgtgaccgaggagttggcaggagaacaatgtttattcggaaaaaaggagctgtgacatgacttttgtcacagcacccaaacataacgtctttcgttgcaacagcagatgcttcggagaatcaaacagactggagaagatgaacgagtggcttttgaaaccatcggagaaaaattacggcaagcacgcctgaataaaaaaatatctttagatgaattacagcagattacaaaaattcaaaaacgttatttggaagcaatcgacaatgatgattttgaccaattgcctggtaaattttacgtgcgggcatttattcggcaatacgctgaagctgtaggagaagatggagaccatttagtcgatgtttttgatgggaaaagcaaattgacaggatcggtccctgaacgtccgcagcctgaaacagtaagtacttctagaaaagcaatgcatcaggaagaatcgcatccaagtcgcttttggacaagtcttcctgtcattttattaggattggttgctttggcgattgtcgttgtcgtgggctatatgacttggcaagatcgtcaagctgatccaataatcggagacacagcttcttcacttaaagtagaaggatcagtcgaggagtcctcttcctcagagcaaagcacgcagaccaaagagtcttctacagtagaatcaacaacaaaatcaagtgaagaaaagaaaatggcaatagctacaggagaagattctggcagtgccatcgcagtaaatatcacagacgctaccaagcctgtaacccttgaatttactgctgtcaatcgtgtatggttaggtgtgctagtagacaatgcctatgtttatcaagggacactggcagcaaatgaaacacagagtaccgtgttaccggaaacagcaacaaatgcgaccatcacgattggtgcagcaagcaatgcaacgatcaaagcgaatggagaatccgtaccagttaatccaggggaaaacaatcagagtccaaaaaatgtgaaccttactcttcaatacgcagagtgatcgtataaattagtttacgcatctgtttacttgcaggtataaaaaagaaggatcgtgacaaatctgtgtcgcgatccttcttcgttaattcaaaaagatcaattttaataaaaatactcccttgaataaattcatttggaaaagtaaataatatcggtggaaacttcgctgatagtcacgtagaatagggaagaaaggagtcgatagtgtgaatttaccaaataaattaactgtacttagaatttgtatgatcccgattttcattttgtttgtaggtttacctttagattggggacaacttaacgtaggagacaccacactggctgtcacacagctagtaggtgcagttatttttgctttagctagtatcacagactggttagatggaaaaattgcccgtgcgcgaggccttgtcactaattttggcaagtttgcggacccgttggcagataaaatgctagttatgactgcttttatcatgttggttgaccaaggaaaggcccctggttgggtagtagcgatcattgtctgtcgtgaattagccgtcacaggcttgcgtttactacttgtcgaacatggagaagtcatggctgcagcttggccgggaaaagtcaagacggctacacaaatggttgctattatcttgctgtttatcaataatatcccattcagcctgatcggtattccagtagatcaaatcatgctttatgcttgtctgatctttactatctattcaggtgtggattacttcatcaaaaacagcggtgtgttcaaaggatcaatgtaagtatcgtttagtggagaggttgtgagcctgccgtctaactctgagtcacaagggataatttcaaaaaacagcttttcatgttttatgtatattgtgacttatgaccgaggttttggcaggagaacactgtttatttggaacaaggagctgtgacaagatttttgtcacagctccttgccctctttttaaataaaaaaatataaaaatacagcgtatactatataagggagcgggaagtaatgaaagcagaaataatagctgtcggaacagaacttttactaggacaagtcgtgaatacgaatgccactttcttgtcagaacagctagctgatctaggtatcgaagtttattatcaaacagttgtaggagataatcagcagcgtttagaagagttgattgctctagctgaaacaagaagtgaactcatactcttatgtggcggattaggaccgacagaagatgacctgacaaaagaagcaactgcgactcacctcggtaagtctctcatacaaaatacggaaggatacaaaaaattattggcatattttgaaacaacccatcgaaaaatgaccaaaaacaatctgcaacagtcccagattatcgaaggcggggttcctctaccaaatcgtacagggcttgctttagggactttttatcaaacagatacacatgcgtatatccttcttcccggtccgcctaatgagttaaaaccaatgtttgtggaacaagtacgtcctttactagaggaacgttttccttctgaagaaaaactaatttctaaagttttgcgcttttatgggattggtgaatcgcgactggtcactgagctaaaagatctgattgatacacagatcaatccaacgatcgcaccatatgccaaaccaaatgaagtgacattacgactgacagtgaaaacaaatgatgttcaggcagggaatcaagctcttttagcattagaagaaaaaatccaagaacgagtaggggaatatttttatggatacggcgatgataattcgctagcaaaagtcgtagtggaactactgaaagaaaacaagcagactgtaacagcagcggaaagtttgacagccggcgccttccaagccgcattaggcgacattgctggtgtgtctgaagtatttccaggcggattcgttacctactcgctccaaacaaaagctggttttctggagattgatccggagctattagcagaatatggaacagtcagcaaagaatgtgtggagcagatggccattcaagcacgtgagatagcaagaacagattacagtgtagctttcaccggagtggctggaccggacacgttagaaggtcaatctgcaggaacagtatggatcgctatttcatctaaagacggcgtggtttcggaaaaatatcactttgccagagatcgtgctgctatcagatttaatgcggttatgcaaggatttgatcttttgagaaaacagcttttaagaaaatgataaatgcgaatatttgttcggttttttcttgctttttttcactaaaaaagatatgataaggataatgaaatgttgctctgatttgtaaatataaggaggattatcgtattggcagatgatcgtaaagcagccttagatgctgcactgaaaaaaattgaaaagagctatggtaaaggctctattatgaaattgggcgaaaaaatcgaccagcaaatctctacaattccaagtggctctcttgcgttagatgtcgctttaggtgtcggtggttatccccgtggacgtattatcgaagtatacggacctgaaagttcaggtaaaacaacagtggcgctacatgctattgcagaagtacaaaaaaatggcggaactgccgctttcatcgatgctgagcatgcgttagatccgcaatatgcacaaaaattaggtgtgaatatcgatgaactacttctttcacagcctgacacaggagaacaaggtctagagatcgctgatgctttagtatcaagtggggctgtagatatcgtagtagtcgattcagttgctgctttagttccacgagcagaaatcgacggcgaaatgggtgactcacatgtcgggttacaagcacgtttgatgtctcaagcattgcgtaaactctctggttcgatcaacaaaacaaaaacaatcgctattttcatcaaccaaatccgtgaaaaagtaggcgtgatgtttgggaatccagaaatcactcctggaggacgcgcattgaaattctacgcaacgatccgtttggaagtacgtcgtgcagaacaattgaaacaaggtacagatattgttggtaaccgtacaaagatcaaagtcgtaaaaaacaaagtagcacctcctttcaaaatcgctgaagtagatgtcatgtatggtttagggatctcacaagaaggagaacttctagacatggcagtagaaaaagacattgttgataaaagcggtgcttggtattcttataaagaagatcggattggtcaaggacgggaaaacgctaaaatctatatggctaatcatcctgaaatgatggcagaagtttctgctctagttagagcagcttatggtattggtgaagaagtcgctgtcccagaagatgaaaaaggacaagaagaattgcctttagtagaagaataaaaattatgataaacaaaaacggctggtctgaagagtaggtactctccttgacctgccgtttttttattgaataaagaaatcgtgagttatttaattatacgagtgggtacataaaataaaaatatctgttcatctacaaagaataatttaatagaaaagtttctcaatttaaaggtttacctatatgaaactagtgtcatttattttaaaaaccatcgtttaatgaataagtagaaagccgtttctttgtttatttaaagttgacactacggggtacaaacattagaataaagttgtgcatgttttttgtacacatatatgcgaagatgcatattgacgagtttagaataatttatcatagaagctgtatagatgataaaaatgaaaaagatagtatggaggtggattttatggtattcaacattctcctcgctatcatcggtttaattgtcggtcttggtttagggtttatggtcgcaaagtcacgtcacgagaaagaaatagctggtgcacaatcatcagctgctggaatcatcgatagtgcaaaaaaagaagcagaaactctaaaaaaagaagcattgttagaagctaaggaagaaaatcagaaataccgttctgaagttgaaagtgagctgagagaaagtaagttagaattaaaatctcaagagaatcgtttgattcaacgcgaacaaacgctgaatcgtaaagatgactcgttagaaaaacgcgagaactcacttgaaagtaaagaagaagcacttagttcaaaacagcaattaattgaagagcgagaaaaagacgttgaaaaaatgattgaagatcaacaaaaagaactagaaaaaattgctggtttatcaaaagaggacgcacgagatgtcatcatgaaatcgactgaagaagagctgaatcatgagttaactctaatggtaaaagaatctgaacagcgtgccaaagaagaagcagatcgcaaagcgaaaaacttattatcattagcgattcaacgctgcgcagcagatcaagtttcagaaacgactgtttcagtcgttacccttccgaatgatgaaatgaaaggtcgtatcattggacgagaaggtcgtaatattcgaacgcttgagacgctgactggtatcgatttaatcatcgatgatacaccggaagcagttgttctttccggattcgatccaatccgaagagaaatcgcacggatgaccttggaaaaactgatacaagatggacgaatccatccagcgcgtatcgaagaaatggtcgagaaatctcgtaaagaaatggatgaacgtattcgcgaatacggggaagaggcagcgtttgaagtcggtgctcatacacttcatccagatctaatcaagatcatcggacgtctgcgattcagaactagttatggacaaaacgtcttgaagcattcggtcgaggttgcaaaattagctggtatcttagcagcagagcttggcgaagatatccaattagcaaaacgtgccgggttgctccatgatattgggaaagcacttgaccatgagattgaaggatctcacgttgagatcggtgcggaattagctgccaagtacaaagaaaacccagtagtaatcaacgcgatcgcttctcatcatggagatgtggaagctacttctgttatctctgtccttgtagctgcagcagatgcgctctcagcagcaagacctggtgcgcgaagtgaatcattagaaaactacatccgtcgtttaagaagtctggaaaatatttcgaacagcttcgccggtgtagaatcaagttacgcagttcaagctggacgcgaagttcgggtaatggtcaagccagaagaaatctcggatttagacgctgttcgtttagtacgtgatattcgtaaacgaatcgaagaagaactggattatcctggacacatcaaagtaatcgttattcgggaaactcgtgcaactgattatgctaaataataaaaaatacaaaagaagagccgcggcaaaagccacagctcttctttttttgtaaggcacgaaaaaacattgctatcattattttttattcaacatctcaagatctttctcgatcgtcgtattgattcctttgatgattgctgggatgaatcctgcttcttctaaggcaactacacctgcaacagttgtaccgccaggagaagaaacttggtctacaagttcccatggatttttatcacttgaaaggaatttttgacaagaacccataattgcttttgcagcaatctcagtggctgtctgtttggacaaaccattcagtacaccagtccgtcccatcgcatcgatcagcatgtaaacgaatgcgggtgagctgccagcaaggccaatgaatgtactgaaatctgattctgctaaaggatagacgctgccgattgcttcaaaaatcatcgtagcttgctgaagctgttcctccgtgacagcttcatttttgcaaatcgcagaaacgcctgctcctacgctgacattgacattcggcatcacacgtacgatggaggcctgaggatcttcaagcgctgtttctaaatctgttaatgattttcctgaagcaatagaaatgaataagactttctggctatattctcttagttcttccaatactttttcaatgatttttggtttcacggctaaaagaacgatatctgattgtgatgcaacttcctgattacttttgcatgcatggacgccagtttcagcagcaaatttttgtgcattttcaaaatgtccactggaaacgaacacctcttctttcgagactgttcctttttttaataaaccatcaataatagcttgtgccatattccctgtgccgataaatcctactttcatgttatcctctcctttagcattaggatatctttctttttctatcatcgcaagcaaagaacaggtctaaagtggaaaaattaaaataaataagataacattggggtatgacacaaaagtatacaagttaggaatgggaaaatgtgaaaaataaacgatacttgatgctgcaatggataaaggaacatagtctgattttaaaactgatttttttcggctccgtgttagtctttgtggcaaatcaagtcgcaaatattgctaatggcatgagttggcaagatatttggcaaaggatgggacaacaaagccgcatgacgatcctgctcatgattctggctggactgctgggtgtcactccgatgttgttgtatgattgggtgacgatcagagtcttagaaaaacaaggaaaaccaaaaatggaaagaaaagagtttcttcttgctgcgtgggtaacaaacacgatcaacaatctcgccggttttggtggtgtggtaggagcaagtctgcgggctagtttttatggaaagcagacaaatagaaaaatggttttagccactgtatcaaaagtcgcactatttatgctgactggtttgtctgtatggtcgtttcttacatttattgatgtcttttttattcagtcagaaagtatttttcgaagctattggatctggcttttcggcggtagttttttagcaccagtcattttcttttttgcttatctaaagagaaagacattgttcttcgagttttatccaaaaggcttgcttggtctgctactggcatcctttggacaatggacgggagcccttgcggtatttttgatcatcggcaagttgatgagaatagatatttcgatgctttcgatctatcctatgttcatgattgctacattgataggaatgctgacgatggtcccaggtggaatggggacttttgacgttttgatgatcttaggaatgagtcaattgtctgttcggcaagatgtagcagtagtttggctattatattatcggttgttttattatgttctaccttttatgacgggacttctattgttcatcacacatacaggagtcaaaatcaatcgatttttagataacattccgcgactgtttttccaaaaggttgcgcatatcgtgctcgtaagtgctgtctattttgcggggatcatgatggtacttctatcaacaatcactaatctgtctgcaatcagtcggctatttcaagtattattgccgttctcattcaattttttagatcagacagtgaatctattggttggctttttattactcggccttgctagagcactttcagtaaaagtcaaaaaggcatttctgcctacgattgctttactatcttttggtattttaaatacaatcacacgtacgttatcttggcagttgatattggtatatgtcttgattctgttagctgtgtggttatccagaaaagaattttatcgaacaaaattcgtttattcttggggagctataatctttgatgctagcttgttcggctttttgtttatcgtttacgcaattgcaggctatcacagcggacgctttttagtcggtcgaataacaggaaatcattttattttgtttccttcagatgatgtgtggttctcagggcttattggtttgggcatctcattgctagctttagtggcgctttatcaatatttagctgaagatactacgaagcttggcagtgagtacgaaaaagaccgttttgaccgtttattggaaacatacggaggcacagctacaagccatcagcttcgcttgtcaggttacagttatttttattaccaagaagacgaccaagatcaagtcgtttttggttatcagatcaaaggaaataaatgctttgttttaggagatccagttggcaatcctaaaatgatgcgggcagcaacgaatcagtttatgaaacaagcagattgtttaggctatcagcttgcgttttataagatatcagaaagctacgtagtgatgcttcatgaattgggttttcacttcacgaaagtaggtgaagcagggattgttgatctagcaacagaagacttgtctcggctgagtcagcaacttgaatatcaacgtttgatgaaagaaggataccattttacttggtacgatcaactgccggaagaattacatcaagctgtaaatgaagtttcacaaaaatggcttcaaggtgcacgagaaaaatacttctctgtgggacgatttgataaatcatatgtattatctagcggtgtcggtattgtccgtaaagatcaaaaagtcgttggcttcatcaccgctcagccgatgatgaagaagcaggcgggatatgatttgttgcgggtcttacctaaagaatctgaggaattagctgactatctgttagccaatctgtttattgtatacgagaaaatgggctactcggaagccaatctaggcttagctccattagctaatgttggagaaacagatttttctttctttcaagaaaaagtcatgcatatcgtatataattatggtaattttttctattccttccagtctgcttatgaaaagaaattaaaatatgtcgatcattgggaaggacgttattttgcttataggaaaggaagtaatttcggatttgctaccatgcagctactcagtctgataggaaaagaaaaaggaaatgttccgagtttggcagaagaagtgctcacagaattataagaatcactagaacttgtttggattatgaagagaaaattctgtgaaagctgttgaaacgatgacaaaatcaaccactaggcagacataagctatacttttatttttccctatgatagaatacttgcgacttagacttttcgaatgggtgagaggatggaattgattgaaaaagcgccagccaagataaatttaggactggatgtattatatagacggcaagatgggtatcatgagttggaaatggtgatgtcgagcgtagacttggcagatcatctattttttgaagaaataacagaagacaaaatcattgtagaaacaaataaagcatttttaccggtagatgaacggaacaatgtttatcaagctgctttattgctaaaaaataaatacaatatcaaaaccggtgtcaagatctttgttaagaagaatattccagtagcagctggattaggcggaggaagtacagactgtgcagctgctctaagagggatcaaccaattatggaatctgggctgttcgttagaagaactggcagaaatcggtttggaagtcggtacagatgttccttactgtgtctacggaagtacggcatttgtcggtggcaaaggggaagaaatccaagtattaccttctatgccacagtgctgggttgtgttggtcaaaccaagaatgagtgtctctacacgtacagtgtttagagaagtagatacgcaagccatccaacatcaagacatccacggacttgctgaagccatccgagagcaagattatcagcagatgatcaaaaaaatgggaaacagtttagaagatataacgggaaagcggcatccagtcatccatcaaatcaaagagcgtatgatcaagtacggagcagatgctgcattgatgagtggaagcggaccaaccgtttttgccttgtgtcaacattattcaagagcgcagagagtatataatgggttaaaaggtttttgtgaggaagtttatttagtacgaaccctgcaataaaatataagaagtaaaataggtgatgaaaaactgaggaatcctaaaatggtattcttcagttttttattgtagtgaaatggctagatatgagcagcaactcatccattttacgatttaatcaagaatatacatgcttaaatcagaaattgatggatttctattgactgtgtttttttattttgatacattagttcacgttaataaatcgtaaaattccgatttgttcattgaaaggagcatataaatgaaaaaatatcttttgacagctacggtaatgataggtgctttactgtttgcagcatgtggaaatacgaacaaggaagcagacaaaaaagaggatttgacgatcgttacgactttttatccgatgtatgattttacaaaagagatcgtaggggatgaaggaaacgtgaaacttttgatccctgctggaacggagccgcatgatttcgaaccaagtgcaaaagaaagagcagaaatttccgatgcagatgttttcgtgtataatagttcagacatggaattttttgtggattcgttaaaggattcagtggatagcaaacagaccttgatgatcgaagcagctaaaggaatcgaccgtttagaatcgcaagaagcagacgaacatgaagaatcagaagaagggcatgatcattcacatgaatacgatccacatgtttggctcgatccggtattagctataaaagaagtcagaacgattgctgaagaattaggcgaaaaatatccagataaaaaggaaacttttacgaagaatgccgatgcttatatcaaaaagcttgaagcactggatcaaaaatactccgatgagctaaaagatgcaacaaaccgcacatttgtcactcagcatgctgcttttgcttatttagcgaatcaatacgacttaaaacaagtagcgatttcgggcgtttcaccagatcaggaacccacaccaagtcgcttagctgagctaaaagaatttgtgaagaaaaacaacatcaaagtgatttattttgaagaaaatgcctcttcgaaggtagctgagacattgtcgaatgaaacaggagtgaagctagaagtgttgaatcctttagaaagcttgactaatgaacaaatcaaagcaggcgaaaattatatttctgtcatggaaaaaaatctgaaagctttaaaagaaagtatcaattaagttttagaatggaggttgtaaggtgcgttatatcgaaatatctgatttgaccttttactatgatgatgaacctgtactagaagatgtctcttatcatgtagatgcgggtgaatttgtcattttaactggagaaaatggagcagccaagtcaaccttggtgaaagcatcgttaggattactgaaaccttcaaaaggaatgataaagattgctgagaaaaatcaagaaggaaaaaaattaagtatcggttatattccccaacaagttgcatctttcaatgcaggttttcctagtacggtgatcgaattagtccgttcaggaagatatccaagaggccgctggttcaagcgtctctctgaaaaagatcatcaacatgtacagcgtgctttagaagctgtagggatgtgggatatgcgaaatcggcgaataggtgaattgtctggcggacaaaagcagcgaatcagtttagcgcgtatttttgctactgaccctgacttatttgttcttgatgaaccaacaacaggtatggatgaagaatccagaaatgaattttatcgtcttctccgacatagtgcgcatgtccatgggaaatcagttctaatgatcacccatgatcatgaagatatcaaacagtatgcggacagacagatccgactggtgagaaaggaggattctcaatggcgttgctttcatatgaattcatgagaagagcgtttcttgccgctatcttcattgccggaatcgccccgatgctaggtgtgtttttagtgatcagaagacaatcgctgatggctgatacgctttctcatgtctctttagcaggggtagcgttaggattctttttgaaccttaatcctacacttacgaccatgctagtcgttgtattagcagctgtgatattggagtatctgcgaacgatctaccgaacctattcagaaatctccattgccattttaatggctggtggtttggcgctagcgttagtattgatgaatttgagcggagggaattcagcaacaagtatccaatcctatctgtttggttcgatcgtgactattacatgggagcaagtcatctttttaggaatcttattcgttgccatcggtatattgttctttttattcaaacggccgatgtatgttctgacttttgatgaagataccgcccacgtggatgggctacccgttcatttgatgtcgatgatgttcaatgtgattactggtgtggctattgctgtgatgatcccgattgccggtgcacttttgatatccgcaatcatggttcttcccgcagcaatcggtatgcgattaggcaaaagcttcaatgtcgtgattgctatcagtgtttgtgtaggatttctagggatgctgtcaggactaactagctcgttttatctagatacacctccaggagcaacaatcacattagtctttattgctttgttcctgattgtaaatatcatcaaacgaatattggttgccttcagaagaaaaaataactaaattataaagaaaagaagccttataaaaacgaaaaattttttataggcttctttttattttaataaataccgaactattttcttattttttcataaaatgctcgaatttttgaagaaaaacttatataatgtaaaacgataaaatttcttaaaaggagttggaataggtgaaagtacgtcgcagtgaacgtctagttgacatgacacagtatttattgaatcacccgcatgaattgatttccttaacaagctttgccgaacgttatgaatctgctaaatcttctatcagtgaagatttgggaatcatcaagaaaacatttaaagaacgagggtatggaaccttggaaacaatcccaggtgctgcaggtggtgtattgttcatccctgaaatttcatatgaagaggcgaaaaaatatattgaatctctagcagaacgtctatcagaacaagaccgtctgcttccaggaggatatgtttatctctctgatttgttaggagaacctgaactgctacgtcaagttggaagaatcattgcttctaaataccttggtgaaaaaatcgatgctgtaatgactgtagccacaaaaggcgtacctattgcccaagctgtgtcctattatctgaatgcgccattcgttattgtacgccgggactcaaaaataacagaaggatcaacagtaagtgtcaactatgtgtctggatcttctgaaagaattgaaaagatggaactgtctaagagaagtttgaaacgtggttcacgtgtccttgtagtggatgatttcatgaaaggcggcggaacagtcaacggaatgaagagcttgattgaagaattcgaatcagaacttgttggcatcactgtatttgccgaatcaaaattcaacggtcatcgcgccatcgatgattatacgtcactgctttatgtcaaagatgtagatactcaaacgaaaaatattacggttgtgccgggaaattatttttcagaataagaggttgtgaaaaagccgcttagtttcgagtagtaagaaaaattttgtgaaaatggctttccacattttttcataaatttggcttaataccgagaaactggcttttgaacaccgtttatctagaggttgtgaaatcagcgtcctgtcctgagtattagctcaataaacggaaaaattgctcctcatattttgccgtttattgagctaataccgaaggtcagctgattgaaaaccgtttaatgaagaggttgtaagcctaccgtttaactctaagtcacaagaaacgatttcaaaaaacagcttttcatgttttatgagtagtgtgacttgtgaccgaggagttggcaggagagcaccggttaccaaatagataggcccgttatggtctatctatttttttatccagaaaacgctgggataaaagaaaatcacttgttttgttgaaaaaatgggtatactgggataaactgaaatcagcaaactatatttaggagtgacgcagttggacgcacgttatgcaattattttggcggcagggaaaggtacccgcatgaagtcaaaattatataaagttttacatcccgtttctggtaaacctatggtagaacatatcattaatcgggtcagtgaaacgaaaccagatgaagtgattacgatcgttggacacggagcagaacaagttaaagcacaactaggagaacgcagtaaatatgcgttacaagcagaacaattgggaacaggacatgctgttttgcaagctgcttctttcttggaaggaaaaaaaggaacaacgttagttatcagtggcgatacaccattattgactactgaaacgctgaacaatctttttgaatatcaccaaggaaaaaatgcaagtgcaacgatcttgacggcacaagcagaaaacccaacaggatatggacgaatcatccgtgaccatattgggatcgtagaaaaaatcgtggaacaaaaagatgcaacaccagaagaagctcttgtacaagaaatcaatacaggaacttactgttttgacaacgaagctttgttcgatgcgttaagcaaagttggaacaaacaatgctcaaggtgaatactatctaacagatatcatcgaaatcttaaaagaagaaggcaatacagttgctgcttatcaaacggatgattttgaagaatcaatgggagtcaatgatcggatcgcgttagctaaagcaaatgagatcatgagaaagcgaattaaccagatgcatatggtcaatggcgtaagctttgtcgattcagcaacgacatacatcgatgcaggcgtagaaatcggtccagacacattgatcgaagcaggtgtacaaatccaaggaaatacagtcatcggttctgattgtgtcatcggggcacattcaaaaatcgtagacagtaggattgaggatcacgtcgtcattgaaaactcagtcattgaaagcagccatgtcaagaaacatgcagatgtgggaccttatgcacatttacgaccaaaagctgaaattggcgaaaacgtccatatcggaaactttgtggaagtgaaaaatgctcaaatcggcaaaggaactaaagtcggtcacttgacttatgttggtgatgctacgctgggagaagaaatcaatgtcggatgtggtgttgtcttcgtcaactatgatggaaagaacaaacatcatacgactgtcggcgaccacagctttattggttctagcacgaatatcatcggacctgtcgaggtagctaaaaacagttcgattgctgccgggtcaacaattacagacaatattccagaatatgcgctggcaattgcgagagcaagacaagtcaataaagaaggatatgcaaaaaaactcccttatctaaactaagacttttgcaaaatcacttgatttatttaaaaaatatgactactatttattaggtagaattctagagttgtgaaaaagaaagtggaggtccccatgtcaaaacattactttgacccaagattaaaaatttttgcgttaaattccaatcgcccattagcagagaaaattgcagcagcagtcggcgtcgagttaggaaaatcatctgttactcaatttagtgatggagaaattcaagtaaacattgaagaaagtattcgtggatcgcatgtctatgttattcaatcaacgagcagcccagtcaatgataacttgatggagttgctgatcatgattgacgcactgaaacgagcaagtgcaaaaacaatcaacgtagtcatgccttattatggctatgcgcgtcaagaccgtaaagcacgtgcacgggaaccaatcacagcgaaattagtagcaaacatgattcaaaaagctggtgcaacaagaatgctgactttggaccttcatgcagtccaaatccaaggtttctttgatattccagtcgatcatttgatgggtgcgccacttattgccaattatttcttagaaaaaggaatcaaaggcgatgatgttgtcgttgtttcaccagaccatggtggtgtcacacgggcacgtaaattagcggaatttttgaaatctccgattgcgatcatagacaaacgccgtccaaaagcaaatgttgcagaagtaatgaatatcattggacaagtcaaaggcaaaacttgtgtactgatcgatgatatgatcgatacagcaggtacgatcacattggctgccaatgctttgaaagaagctggtgcaactagtgtgtatgcttcatgtacacatccagtattatccggccctgctttacaaagaatagaagattcagctatcgagcgtctagttgttacagactcgatctatcttccagaagatcgtaaaatcgacaaaatcgatgaagtaagtgttggcggactaatgggagatgcaatcaaacgtatccatgaaaacaaaccagttagtccattgtttgaaacaaaaaataaataataaataaactcacaaaggggagtccaattgggctgagattgaatctatttctaaacccttcgtacctgtatcggttatgcgagcgtaggaattgtgaataaacagctgtttgactattttcgaaagctgcttcctcctttgtgacttttttattcaaaggaggaagtttttttatgggaaaaaatagagtttgggtagaaggaacgattgttgcagcgttagcgatggtgttgtcgttgattccgatccagatcggcagcagtttttctatttcattagggcagattccattgactctttttgcgttaagaagagggacaaaggcagggatgctggcaggtttcatttggggcatcctacattttccgttgggacaagtttattatttaagtgtcgttcaagtgttgattgagtacccgattgcctatacttttgcaggcgcagcagggctcatggcttcaaatgtccaaaaaggctatgtagacgataatacgaaacaaattagaaaaagcatcgtgtttggtgcattgattggcgcactttccagatatttttggcattttattgcaggagtggttttctggggagcgtatgcactatgggggatgaatccttggctcttttctttcgtaatgaatggtgccagcgggttgagtacagctattgtaacgatcatcgttttattagggatccaacaaacgattccttcgatttttgtgccagataaacgacaggagctgtaaataaaaaagaagcaagaaacttgagacagaatcatgtcctagtttcttgtttcctttttattttttgataagaaatagatctacttcaatggcagataagaaagatcggcatcttccaccaattgccagtgtcgatcggtgacagagtagattaaagtagcgatgatttcctcttctcgataccgggtgccttttaatttccaaatataatcttcaatcacatagattgggatacgatattcaccatcgatcaaaccaacttgatcaaaagaaaaaatgatcccttcctgcatcaaattacgcatttctttcaataattccacactgattttttcaacaggtgtttcttttttgaaaaaagatttttttacattgatcttatctgacaagatcgaacttaatttactagcaaaaatcctataaaattcatctaaatagcgataataaatccgattcagctgatcattaagatcgaagtatacaaaattattctgtagtttataaaaaaacggcgaatgaagatgtgttttcatatgaccaaaatataataattctgaaatttctaaaggtgtcaattctttcagcatcgttaaatcagtaaagtcgatccacttcaattcatcgaatccacgcctgttacgagaagaggaaaagaaacgctgaatattttctgtaccacggattactttcagccctgtatgggattcatattctccagcagaagcagatggatcaagcaagagcaagttttgaggaaaatgcacgatactgtttgcaaagtcagtagcagtcagcccttttgttaaaacagcattacttgtggtatcaatatgtacataaactgactcagtcatcatgttcctcctcttatttcctcttaatctcttttattttacaacatttgcattaaaaaagcttgtttcttttattttaaaattccattacaaaatcacgttttcattgaaaacactctcattttcaattaatttttgtgatttttgtattttttatttaaaggaggttttatgaattgttttcttatggaatctacaaagtcgaatacgagactcatgacctttttatgacgtactggtatacttgaagaaaaaggagagagcgatggagataaaaaaagtttacttttcacagaaaatgtcgctgtattcgcctatccagcaagcaaaacaacccctcccattttttcaaagtcatcaagaaagtagagacgctttttggcgttctgcaaaaaagcaatgtgcttttaaagcagtatcgaaaaaatataccgtctattttactattgctaaaagtagaggagatgttatttttaataatctgttgattgaaggtgaaacttttgaatggaaaaaattttttcggtatatggaagcttgcgctcgtttttttattaaagaaaactgttgttttttatttcaatctcctctatcagaagaatggttgcgtatttttcataaaaacggctatcaaggaaccacacaattaaataaaaagctggtctatcatacagcacttgttttaggtggaggaggagcgcacggtgcttatcagattggtgtgtggcaggcgctgaaggaacatgatatcaactttgagattatcacaggtacctcggtaggtgcgttgaacggcgcattgattttacaaggagatatgaaaaaagctgtgaatttatggaaaaagctgtcgacaagacaagtgcttgcgttaccagaaatggctgcggttgaagaccttcgtgaacgcttctatcgagaaagacgccaaatgacgaaaacagcactaattgaaggcggggtttcttctgctccattggaaaagatggtcaaagacaatttggatttgtccttactcaaacataatcccaaaatacgtttatatacggtgtctactaaactgccagaactagcggaagtagtgactgatatccaacagacaaaaacagaagaaataccagattggatactcgcctctgcttcattttatcccgctatggcttatcgaaagatcggaaaaaataaatatgcagatggtgggtatcgcaacaaaatacctattgatattgcgattaacaaaggagcaacagaggcatttgtcgtagatgtgcaagggccaggcccagctaaaaaaattcgtatgccagacatttttatccattggaaatgtcaaacattgtggacactaggcagctttctgctttttgatagccaaaggaaccaattaaatttacaattaggctatctggaaatgaaaaaacgattaggctgttactatgggaactggtatacatttcattctgttaaacctgcaagaacatactggcgaggatttttgtcttacttaacaaaagaaattcagttagaattatcttttttcaaaagcataaaattttggcaaaaactgcgtaatttatataagaacagggtcgtaccagagacatgcggattggcgatgctagaacttttagcaaaaaaacattttttactgcccaatgaaatctatcaagtagacatgatgattcaaatgatctgccaacaagatataaaaagtatgccggatgatttattgacacaaattggtcaattaagtactgaagaatggcgaaggtatcgaaaataccagcaaaaaatacaaaatgagcgcacgaaaactgtttattttgattatctgctacaaggaaaacgcaaggatcgtttgcagcatgaattgcttaagcaaccagttgacacattactgatcctatatttatattatctcaaggaggaacaaccatggcacaagaattttcatatgaaatcgtagaagaaatcgctatattgtcagaaaacaacaaggggtggcgtaaagaactgaacctagtcagctggaatggtcgcccgccaaaattcgatcttcgagattgggcgccagaccatgaaaaaatggggaaaggcctgacattgacgaacgaagagtttgaacaactgcaaaaagcaatagaaaatatgtaatgaggaagggaccctgtcgaatgaaaagtatgactggttttggcaaagccatccgcgaaacaaaagcgtatcagttagatattgaaataaaaagtgtcaaccagcgttttctagatgttcaaatacgaagtcctaaaatcctgaactttattgaaaacgattttcgtcagcttattaaacagcagttaagccgcggtcgaatcgaagtatttgtgaatctagcttatattggcaaaaacgaaaaacagatcgtcatcaactgggaattgattgattcacttatcactcaattgacagacggaattcaacaacgatacggtagtcaaaatcaagtgtcaattagtcggatggcggaacgcttcgcgctggacgaaaacttcgtaacggtagaagaaaaaccggaagagagcatggaagaattggcacagttagctctagatacattgaaaagcgcacttgactctattgaggcgagtcgagaaaaagaaggtcaagctttagctttagtgttgaaaaagaatactgaagaattcaaagaagtactaaaaaaactcgatagttttgtagaaatctatgaaaaggaatttcaaataaggtatcaaaaaaagctggaggaatttcttggagcgaaagtcgatgagcaacggttgttgacggagctagccatcttgttggaacgcggagatattcacgaggaactggatcgtctggcgatccatgtacaaaaactagatgaacttatcgaagcacaatgtcctgtaggtcgggaattagatttcctgatccaagaaatgaatcgggaaatcaacacgatcggttccaaatcaaatgcaatcgaaattaaaaatcaagtcgtccagtctaagacgatcttagaaaaaatcagagaacaagtacaaaatattgaatgacgaaagaggtagagataatgaaatactatgacgtaacgttccacgaattaagtggaaaaactgttgtaaaacgggatatcccttctgaaaaaaacggctttgacgtatggaaagatgcctgtgcagactataatgagaacgaactgtttattttgatcaacgacggtgcttacgtgacgatgaatcggaaatttattgttcgaatcgatacagaagaggtagaagatccgacagaaaaagcacgttctcgaaaagatgagatcatgggtgtagtgaatactttgtccaatatgggcttttagcaaggatgctgaacaaagaaatacaataaataatcagaattggatttcttcgcttagcttctttgctctaggaatacatttaaaggttgtgacaaaattcgtgtcacaatctttttttattttgaataagtgatgttcaaaaaccattttctcggtattaagccaaatttatgcaaaaatgtgtgaaactattttcacaaaatttttcttcatactcgaaactaatcggcttcttcacgacctcttatacacggcgttcaaaagcttgcatctgcggtaataagcccaaccaaacgaaaaacatgagaaactgtttatgtttggctgttcttattacttgatgcagaacagcttttttacgacctcttggtacagggtagcttttttaccaatttctagctataattaaagataaccttgaaagttgcagaaaaaaagtgcaaaataaacgataagtacaaaaagactagttgaaaggacgtcgtcatgtcagagcgtggattattaatcgtgttgtctggtccatccggtgtaggaaaaggcacagtacgaaaagcaatttttgagagtgaggataatgattttcagtattcgatctcaatgactacccgtaaaatgcgtgaaggggaggtcgaaggcgttgattatttcttccgaagcaaagaagagtttgaatcaatgatcgaagctggagagatgctggaatacgcagaatatgtcgggaattattatggaactcctttgtcatatgtcaacaagacattggatgaaggaaaagatgttttcttggagattgaagtccaaggagcaaaacaagtcaaagaaaaagtgcccgatggtgtattcatctttttgactccgccagatttagcggaattaaaatcacggatcgtaggccgaggaacagatgcagatgaagtaatcgaagaacgaatgaaagttgcaaaagaagaaatcgaaatgatggctctttacgactatgctgttgtaaatgatgaagtgccgctagcagttgaacgaatcaaaaacattattgccagtgaacattttcgagtagatcgcgtaatcggtaaatatattaaaatgttaaaggagatgtagtcttatgatgttaaaaccttcaattgactcactattagatcgtgtaaattcaaaatattctctagtgattttagcaagtaaacgcgcgcatgaattggatgcaagtgcacagcctactctagattcttttgattcagtaaaaagcgtcggtcaagctttagaagaaatcgatgcaggaaatgtagtcaatgatccacatcctgaattaaaacgtgaacgtttgaagatggaagaagaggaacgtcaagcacaaaaagagcgtgaacaacacgaattggaatcacgtatccgtgaagagcaaaaaatgtaataaagaaaaatagagcgaacatctaaaaagaaaagcaaacccagctgtttccttttcaaacattcgccacttattgtctggtagaaaaggctgtgtctgaactttttgacacagttcttttttttcttatctgctgttaattttttgttaggatttggcagaagataagacaaatccatcgatctctagtaaaataggcaaggaactttttgtcgcttgataagaaaagacaaaaaaaggaggaaacgaaccatgacattaacagctgaagtcattgtggacgtacctactatgcagaccgatcagccattcacttatttggttccctctgaaatggaaacagctttgcaagtcgggatgcgagtagaagtcccttttggtaatggcaatcgtcatgtccaaggatttgttatggctatccaaaaatcagaagaatcagctaatccatctttgaaggcagttattcgtttgctagaccttgctccggtggtcaatgaagaattgctttcattagctgattatatgaaaaaaattacttacgcattcaaaatcacttgtctacaaacgatgcttccgagtgtgatgaaagcagaatatgataaattgatctatcctttggcagacacaccagaagttcaggtattgtttgatcagcgagaagtgatttcctggaaggaagcagaagaagaaggcagcctttctcaattgattcgctggcgccaagagcaattagtagatatcaaatatgaagtccatacacgaaataaagtaaaaacgattcgtttggtccgttctttgttaactgaaaagcaaatcgaagaagaatgggcaaaattacggcaaaatgccaagaaacaaaaagaacttcttttgtgtttatctgaactgagccaagaagaaccaattgcttatttcaaaaataaaggaatcagtactgctgtcttgaatcaaggaaaagaaaagggctggctggagtttatagaatcagaacgttatcgcgacccttataaagaccgagtatttgaccaaacgacggcattggaactgaatgcagaacaaaaaaatgctgtcgaacaaatcatcacagcaggtcagcagcaaaaagatcaggtctttttgctggagggaatcaccggcagcgggaaaacagaagtatatcttcaggcaatcgctgatgttttgtcagaaaataaaacggcgatcatgttagtgcctgaaatcgcattgactccgcaaatggtcgagcgattcaaaggacgcttcggagaatcagttgcggtcttacatagcggactttcccaaggtgaaaaatatgatgaatggcgcaagattgagcgggaagaagcgcaagtagtagtaggcgcacgatctgctatttttgccccgctgaaaaatatcgggctgatcattatcgatgaagaacatgaatcaagttacaaacaagatgagacaccgcgttatcatgcgagagatctagcaatttggcgcagtaaatatcatcattgcccaatagttctaggaagcgcgacgccctctttagaatcaagagcacgagctcaaaaaggcgtttatcagttattgcagttgaaccaccgagccaaagcagctgcacagcttccagctattgagatcgtagatatgcgtgaagagtttcagaatcatcggacctctactttttctgctaatttgcaggaaaaaatacaaaatcgattagacaaaaaagaacaaactgtcctactgctcaatcgtcgaggatattcgtcttttgtgatgtgtagggactgtggatttgttcttccatgtcctaattgcgatatctctcttacactgcatatggatacacgttcaatgcgctgccattattgcggacatgaagaacctattcccaatcgctgtcctaattgtggcggcaataaaatccgctactatggaacaggtactcaaaaagtagaagaggaactccgagaactttatccgcaagctaggattttgcgtatggatgtagataccactcgaagaaaaggggcacacgaacagattttacaaaaattcggtgcaaaagaagcagatatattattagggacacaaatgattgctaaaggtttggactttccagaagtgacattagttggggtgttgaatgctgatacctccctgaatttaccggattttcgttctagtgagcatacattccaattgcttacccaagtttcaggacgagcagggcgagcggaaaaagcaggcgaagtcgtgatccaaacattcaatcctcaacattacgccatagaattggctaaaaaacaaaattatgagcagttttatcagcaggaaatgcatgtacggcatcgtggaggctatcctccttattactttactgtgaaaataaccgccagccatcctgaagaacaagtagcggcaaagaaaatctttcagattgccaatcagctaaaagaagtgttaagccctcaaagcttgctattagggccaacgcccagcatgattttgagagtgaaaaaccgatattattatcaactaatcatcaaatataaacatgaaccgaatcttcctcatgttttggatgaaattttgaatggaagccagaaagaacagcgacaaggtctttttgtggcaattgacaacgaaccattaaactttatttaagaaagggccaaattatgcgctatcctatattgatccaccctaatgataaattaaaaagaactgctcagccaatcgatgtaatcacggacgagacaatcgctttattagacaatttatatgagacaatgattgcgaatgacggaatagggatcgctgctcctcaagtaggacaaaacaagagaattgctgtgatcgaagtagatgaaggcgagaaatttgaactgattaacccagaaatcatcgaagcaaaaggtgaaagccttgacgtagaaggttgtctcagtattccgcatgtctatggaacggtcaagcgagcagatgaagtgaccgtgcgttattatgatcgagacggagaagagatagaagtgacggcttttggctatttagcccgtgccttccagcatgaaatcgatcacttagacggtatcttgttcattgagaaaatgatacagcagatcccggaagaagaacttgaagaatatatggaggaacatcttgatgactaagctagtatttatgggcacacctgctttttctgtgccgattcttgaagggctgatagaatcaggttacgagatccaggcagtggtaacacagcccgaccgtccagttgggcggaaacgagtaattacgccgacaccggtaaaagaagcggctctgaagcacggtatccgtgtattgcagccagagaaaatctccggttcgccagaaatggaagaaatcattgaattggcgcctgatgtgatcgtcactgcggcatttggccaattcttgcctgaaaagttattgcaagtaccaaaattaggggcaatcaatgtccatgcttctttacttcctaaatatcggggaggtgcgcctgttcattatgccatcatgaatggggagaaagaaactggtgtaacgatcatggaaatgatcaaaaaaatggatgcaggcggaatctatgcgcaagaaagcataccaatcactaaacaagatgatgtagggacgatgtttgaaaagcttagccttttaggaagaaagctattgctagaaacattgcccaatattttggatggacaaaaaccagtacctcaagacgagtcagaagcaactttttcgccaaacatcacacgggaacaagaagcaatcgattggcataaaactgcagaagaaattgacaaccaagtacgcggaatgcgtccttggccaattgcattcacgacctatgagggcatacgctggaaattattatcggttgaagtattggcagaaactacagacaaagcacctggtacgatcatccggaaagacaaaaaaaatctatggattgcttgcggtaaacagaccgtcttagccatcaatgaattacagccagctggtaaaggaaaacaggccgtacatgatttccttaacggaagcggtcagcaagttcagattggtcagcaggtgaaataatgaaaaaaatccctaaaaaaatgaaaaaatcagtacgatatatggcattactgacattagagcgagtgaacaagggtggcgcctactcgaatcttttgttgaatgagatgatcaaacaaagcgagctaaatcaaaaagatgtgggtttatttacagaattgatctacggtacgattagccatcagcgactattggaattttacgttgcaccattgatcgctaaagcaaaaaaagtggatgactgggtcaagacgcttctttatctttctgtataccaattagaatttttagataaagtccctgcacatgctattttaaacgaggcggtcgaaatcgcaaaagtaaaaggaaatcctgggacagggaaatttgtaaatggtgtcttgaggaattatcagcgtcaaggagcaccagatctgcaaggcattgctgatcctatcgaaagactttctgtcaaaatcagcctgcctctatggatgacgaaacgactggtggatcaaatcggatacgaagaaactgaaaagctcggtttatcgctatatcagcctagccatgctagtgcccgagtagatacacgccgactttccagagatcaggccatcactgttttgcaagaagaagagatcacagctgaaaaaagccaagtcagtccatacggtatagtagcgaaaaaagggcatttagcttctagctcattgttccacgatggcgtcatgacgatccaagatgaaagttcgatgcttgtagcgccgtctatgcaaatcgagcctgaacatcatgtcttagatgcctgtgcagcacccggaggtaagacgacgcatattgcttcttttttagatccgtcatgcggtggagaagtggtcgctttagatgtacacgaacacaaagtcaaactcattgaagataatgcagcacgtctaggtgtctcttctgctgtctacgctcaaaagatggatgctagagaagtcagtaaacagttcgaagcagagcagtttgatcggattttagtagacgcgccttgttcaggtcttgggctgcttcggcgaaaaccagatattcgttataaaaaacagccggatgaattagcgaatttaccaaaaatccaattggaaattttagaaagctgcgcaccagctttaaagtcttccggtattctgacttatagtacttgtacgatcttaaaagaagaaaaccaagacgttgtttctgctttcttggaaagacaccctgattttgagaggattgatgttttgaccaatcctatgctacaatcatcaatcgaagagaaaatgttgactttgtatccgcatcagttttacacagatggatttttcatttgttgtttgcgcaaaaagtaatgaggtgaaaaaatgcagattgaatatcaatcagatgtaggaagacgacgtaacacaaatcaagactatgccagtgtatttaccagccgttcaggtctcaagcttgctgtattagcagacgggatgggtggtcatcgtgccggagacattgccagtcagatggcggtaacgaatctaggcgaagcttgggaaaaacaagaagctgttgacgatgaaaaaatcgcccaatggttcattcaatcgattcaagaagaaaatatgctgatttatcaacgtggacaagaacagccggaatataacggtatgggaacaacaatcgtagcggccgctctgtcagatgactggttcacgattgccaatgttggggatagcagagcttatttgattcgtgaagataaaatcatgcaattgacggaggatcattctttagtcaatgaactagtcaaatcaggagaaatcagcgaagaaatggcagtgaaccatccaaggaaaaatattttaacacgttctgtcggcatgcctggaacagtcgaagtagatgtttctactcatctttggcaactaaaagatcgactgctgttatgttcagatggcttgacgaacatgctgtctgaagaagaaataggaacgatcatcaatcaagaaggcccattgtctcataaagtaactgagctgattgatcgtgccaatgaagcaggcggagcggataatatcaccgttcttcttatcgaatataaggaggacagtgtatgatcgagttgggaaaaaaattaaatggccgttatcaaatcactggaaatatcggtagcggtggtatggcaaatgtatttttggcgcacgatttaatcttggatcgtgatgtagcagttaaagtcttacgatttgactttcaaaatgaccagactgcgattcgacgatttcagagagaagctttagcagcaacagaactcgttcatccaaacattgttagtgtttacgatgttggtgaagaagacaacatgcagtatctggtgatggaatacgtcaaaggaatggacttgaaacgatatatccaaacacattatcctgttccttatgaaacagcagtaaatattatgcagcagatcctttctgctatttctttagctcataaccatcaaatcatccaccgagatttgaaaccccaaaacgtactgatcgataatgaaggtgttgtaaaaatcacggatttcgggattgctatcgctttatctgaaacatcgatcacgcagacgaatacgatgctaggatctgttcattatctgtcccctgagcaggccagaggaagtatggcaacgaagcagtcagatatttatgctttagggatcatcctttatgagatgttgacgggtagcgtaccgtttgatggtgaatctgctgtaacaattgctttaaaacattttcaagatgatcttccatctataaaagcacttgatccaaatgtgccacaagcactggaaaacgtgattttacgggcaacggctaaagaacctgcagaccgttataagtcagccgaggaaatgtctgatgatctttctacagtattatcaccagctcgtgcaaacgaagaaaaatggcagcctcatgtgatggataatgaaacaaaagttatcacaccccttacggaagatgcaccaatgcctgattcattcaaatctatgcctctgccaaaagacaagccagaaaacgaaaccttaccagaggaggaagaagttctgcctgatcctaaaaagaaaggacagaaaaaatggtggctgatcctattagctattcttgctgttttaggaatcggaacagctgtattctttgcttctggcgggcgaggagaagttgttgttcctgatgtttctgatctttctgaagcttctgctagagaaacactcgcaaaagcgaaattagaagtagcaacaaaaacagaagaaattgcagatgacaaaatcgaagaaggtaatgtagtgaagacagacccggcagcgggaacgacagtcaagcaaaaacgcgaagtcactctgtatattagtagcggcacgaaaaaaatcaaattagatgattacagtggtaaaagttatgaagatgccgaagcaagtttgaaagaattagggttttctgctgacttgattcaaaaagaagaggaattcagttcagaggtagaaagcggaatgatcatttcgcaatctccatcagaagatacagaagtcgatcctaaaacagacacgattactttcacagtcagcaaaggaccagaaacagtgactttgagtagtcatgtaggagaaaactacgaaactgttcgtaattggcttgttacacaaggattcaatatcaataatattagtgctacttatgactatagcgacactgtaccatcaggttcgatcatcagtcaggatccagcctcgggtgaagttgtagcagaagaaacttacatcaattttgtcgtaagccaaggaacagagcctaaattgaatgatatctccggctatacaaaaagcgaagcacaaagttatttagctagtgtcggtgcagaatatatcgggcatgagacttccgaatattcaaacacggtggataaagataaagtgattcgtacagtaccaggggcaggaacgacaattaccaaaggaatggttgtgaacgtaatttactctaaaggaccagatccagcgtcttctagttctgaaaaagactcttcagacagttctagcagctcaagtagctccagtagcacaagcaactcttcaaaagaagaatcttccagctccacaagttcatcagctagcacctcagaaagttcaaaataagtgctgaataaaatatatcagaagggaatgcgacattgatttgttgcattctcttttttgtgtttctatctcttttgatcaattttcaagccttatactttgagaagtttgcatggaataacacctactttcctcttcgtatggtaaaataaacaaaaacggaggtggcacttatcaaaggacaaatcagaaaagcaatcagcggtttttactatgtatacgcaaacggagagacctatcaaacaagaggaagaggaaatttccggaatcggaaaatcacgccgcttgtcggagatcaggtgatctttgagagtgaaaatcaaacagacggctatcttctggaaatcttgccgagaaaaaatcaattagttcgcccaccagtcacaaatgttgatcttggaatcatcgtcacaagtatcgtagagcctgcattttcttataatctacttgaccgctttctagttaccttggaatacgagtcgatcgaaccgattatttttttgacaaagaccgacttgtcagacgacccagaaaaaatcgaagagatcaagcaaatctatactaaaataggctatccggtgattgtacccaatcatacgggtgatacgacagaactgatccgttacttcccagaacggctatcggtctttatgggtcagtctggagcaggaaaatcgacgctactgaatcaaatatcaccggaactgaatttagcaacaggagagatttctgatgcacttggaagaggacggcatacaacacgtcatgtggaactgattcctatctatggcgggttagtagcagatacaccaggatttagctcgattgactttttgacaattgaagcaggagaactgccgagacaatttcctgagtttgtagaagcttctgtccattgcaaatttagagagtgcatgcatgccaaagaacctggctgtgaagtaaaacatagagtagaaacaggtggtatcgcacagacacgttacgacaattatttgcaattcttacaagaaatcgaaaaaagaaaaccaatgtatgcaaaaaaagaaggtaaacgaaaataggaggaaacaagaatgaagatagcaccatccattttgagtgcagattttgccaatttacaaagagacattgagttagtggaaaaaggaggcgcagattacatccacgtagatgtaatggatggccaatttgtcccaaatatcacattagggccaaatattgttcaggcaatccgtcctgttactaaattaccgttagacgtccatctaatgatcgttgatccagaaaactacattccagcatttgcaaaagctggagcagatatcattactgtccacgtcgaagcaactcctcatattcatcgggcacttcaaatgacaaaaagcttaggagttaaagctggagtagttatcaatccaggaacaccagtctccatgatcaaacatgttttgcctttggctgatcaagtactagtcatgactgtcaatcctgggttcggcggacaaagctttattgaagaaacagtagaaaaaattacggaactcgctgatctacgtagagagaacaattggacttatgcaatcgaagtagatggcggaatcgttccagaaacagcaaaaatctgtaaagatgcaggggcggatgtcttcgttgcaggatcatatatctatggagccgaaaatccagtcggacaaatcgaacgattaaaagaggcattagactaaatgaaaattttattagctgctggaggtaatccgcaaaactggccgcagtctctgctgtccaaatacgatgcctatgtcgggatagaccgtggtgcgctgtacctgcttcaagcaggctacccagtagatctggcagtgggtgattttgattcattgtcgaacgaagagcagaaggaagtatttgcaaaagccaaagagtatacccgttcccctgcagaaaaagacgatacagatacacagttaggtatcttaaaaacatttgaacgttacccgcaagcggaagtcactttgattggagctacgggcggaagattggatcatcttttagccaatctctggttaggtatggaacctcgcttcaaaccctttgcccatcagcttattatcagagattgtcaaaattatttgtcttattatttgcctggagagcatatagtaagacagataccagatatgaagtatttagcttattgctgcttgactcccgtctcgaatcttacattaaaaggcagcaagtatgtattggaaaataaagaagtagaatatccgacatcttatgcaagtaacgaatttctttcagataccgcagaattttctttttcagatggtatgattgcagttattcaaagcaaagattgatccataaacaaataaaaaaatttgtctttcaggctaaaaatgacagaatctattatttgctaaaaaaaagcttaagaggagcaacttaccttttgtttcacggcatttagtgataaaattgaacacaagagtctaattaattcgaggtgtctttgtgaagaagttcaatcctaataaaaatattattattaccttggttattgttatcatcgtggtgacgatactaagtgtgaccgctgcgcagcgagcgaatgaaggaaagcccaatttcttccaatccatcgttaatgacagtgttgcaatggttgataaaacaatctctgccccagtacggtgggtacgaaatggagtagattctgtccataatcttttttcaacttatgccgaaaatgagcggctaaaagaaaaaatcgatagctatgatgacgtttcacagcaaaacaagaattacgagagagaaatcgaatcgttgaaaaaagaacttgagttgaatcagacgctgactagttacgaaaaagtaacggcaaatgtcattactcgttcgcctgacagttggcaggacatgctgatcgtagacaagggttctaaagacggtatcgaagcaaatatggcagtcatgtcgcaaaaaggattgattggccgagtaatcgaggtcaatacggcttcgtctaaaatcgaattactgtcatcctctaatgaaagctccaatcattttccagtacgggtatcttcggctaatggcgaagcgtttggtttgcttaaaaactatgatgaaaagctccatgccttagtggtgacccaattaactggtgatacggatatcaaagaaggggatgttgtccagacatccggtcttggagggaattctccagctaacttgccgatcggtacggttattaaaacgaaaccagatagttatgggctggatcgggaagtttatgtgaaaccttatgcagaaatgtatgacgtgtcagttgtgacgattgtccaacggctagcggaggattagtccatgttgaagaaagaaacaatgaagtactatctgccaatcgttttgttctttttaatgttgatagatggtcatttaacaagaatgctaggggagtggtcgaaaggcacctatatgtcaaatgcccactttctgatattggcattattatgttgcagtatggcgtttgaaaaacgttatttactgattaccacgattgttctcggggctatctatgacgcttactatattggcgttatcggtatctatgcagtagctctccctttaattgtatggttgatgtatgtaatgaaagacgttatccatgtcaacatctttactgaatttttcagtatgatcatctttgtcacgggttatgaattgtttacgatggtggtccagttgatttttaaattagcagtagtaaataacacgtattttattacaaggtttttaggacctacactgctgttgaacatgattatatttgtattattcatttttccatttaagaaattattcagtgatgaataatttctttttttatttttaggtcgaaagcgaaaaagaatcgttgttatcttaagaaatgctagacttaacgcggctttttcatgatcattttctgaaacgaacagttttgtcatttttaaaagttgttttgaaacatttttgtaacataactattatatcgttgacatactgctatggtacaatttttgtatcgttaagaaagacttaaatatatttagatatttattaaattaagccagtcggaggaatgaagagtgaaaaagagtttaatatcagcagtaatggtatgttcaatgaccttgactgccgtagcatcaccgatcgctgccgcggcggacgattttgattctcagatacaacagcaagatcaaaagattgcagacttgaaaaatcaacaagcagatgcacaatcacaaatcgatgccttagaaagccaagtttctgaaatcaacacacaagcacaagacctattagcaaaacaagatacattgcgtcaagaatctgcacaattagtaaaagacattgcagatttacaagaacgtattgaaaaacgtgaagatacaatccaaaaacaagcacgcgaagcacaagtaagcaacacaagctcaaactacatcgatgctgtattgaatgctgattcattagcagatgctattggacgcgttcaagcaatgacaacgatggtaaaagcaaacaacgacttgatggaacaacaaaaacaagataaaaaagctgtagaagacaaaaaagctgaaaacgatgctaaactaaaagaattagctgaaaaccaagctgctttggaatctcaaaaaggcgatcttttatctaaacaagctgatttgaacgtactgaaaacttcattagctgctgaacaagcaactgctgaagacaagaaatctgacttgaaccgtcaaaaagctgaagctgaagcagagcaagctcgtattcgtgaacaacaacgtctagcagaacaagctcgtcaacaagctgcacaagaaaaagctgaaaaagaagcacgcgaacaagcagaagctgaagcacaagctactcaagcttcatctactgcacaaagctcagcaacagaagaatcatcagctacacaatcttcaatgactgaagaatcatcatcagctacacaatcttcagcaacagaagaatcaacaacacctgaatcttcaacagaagaatcaacagcgcctgaatcttcagcaacagaagaatcaacaacagcgcctgaatcttcagcaacagaagaatcaacaacagtgcctgaatcttcaacaacagaagaatcaacaactgtacctgaatcttcaacagaagaatcaacaacacctgcgcctacaacaccatcaacagatcaaagtgttgatacaggaaacggcacaggaagtagtactccggccccaacgctaacacctgaacaacagcaaactgtatcatctggttcaacttcttctggaagcgtgaatggtgcagcaatcgtagcagaagcttacaaatatattggtactccatatgtttggggtggtaaagatccaagtggctttgactgctcagggttcacacgctatgtttacatgcaagtaactggtcgtgacatcggtggttggacagttcctcaagaaacagctggaacaaaaatttcagtttctcaagcaaaagctggagacttgttattctggggatcacaaggcggaacttaccacgtagcgattgctttaggcggaggacaatatatccatgctcctcaaccaggcgaaagcgtaaaagttggttcagttcaatggtttgcccctgactttgctgtcagcatgtaagaatgattaatcaaaaagagttagcccattctggactaactctttttttattgtgataaaatagaaatcagataaattcttctgtcaattccatgaacgtttggatatcttcagtcaccatgtcgatacctgcttgccaaaaatctggttgggtaagatcgacattcaaatgtttcttcgcaagatcttccgtcgtcattgaggcagtatcgcgtagtaaatggatatattcttcttcaaaatttgctcccttttggttggcgtaagcatagatgcccaaactaaagaggtagccaaatgtgtatgggaagttataaaacggtacgtcatcaataaagaaatgcaattttgcagcccagaaatatggatggtaagtagctaaagctccttgatagccttctttttgcgcctcaaccatcatctctgtgatcttatcttctgagactaatccttcttgccgtgcttcatagaatcgattttcaaaaatgaatcgggaatggatattcatgaacatagctaaagcattttgcagttttgtatctagcaaattgattttttcttcttttgtttttgcgacttttaatgtagcatcggctacgatcagttctgcgaatgtacttgctgtttctgcgacattcatggcatattcgcgatttaaagaaggtaaatcccacatcgtgctgctatggaaagcatgtcctagttcatgagcaagtgtcgcaacctcattaacagaattactgtaggtcataaagatccttgattcttttgtttctggtaactcagtacaataaccaccaggacgtttcccaggacgatcttctgcttcgatccagctcttttcaaaagcagattgggcaaatttagccatttttggactgaatttgttaaagttttcgataataaatgctgctgcttcgtcaaaactaaaggttttttctttcaaatcgcctaaaataataggtgcatcttgatcttgccattccattttttctttaccgaaaagattagcttttctagtcaagtaatcaacaaggggttgtttgtttttctggattgtatcccacatgacagacaatgtttctttcttcaaccgattgtactctaatggtttttgtagaaaatctgtgacaccatgaagttcatagtcagaaagtctaaaaccatctaaatgattcaaagtatccgtgaagaggggtgccttttctttccaggcttcttcccatgctgcgaaaagtgtttctctgacttttggatctggatcgcccatcatcttattgaaggcttgtccagcagataattcgactacttgtccatcttgttcgaagggaatcgaaatgctggctacaatcgtatcataatgactgctccaagcatttagaccatctaaagaaagcgtatttataatgttttcttcagattctgataataattgtgagccatcacgacgaatctcgtttaaacgaaaagcaattgtttcaaacgaagattgagaaagcatctgattccaatcattgtcagatatttctgcaaatttctttgacaatacagtttcggctgattgcagacgaggcagcattgcgtaaagcttgcctgataagacctttgcatctgaatcattgacattggcagaaagcaatgcagtaatatagctgctgcattgggtaaagccattcgtaatcgtttcttgcaattgaagaatagcgtttaactgctctgcattgtcagaactaggtgaccattttgttacgcggtgataatactcgttcatttggtcttccaattgcttcatccgttggttcaaagcatcagaatgactgcctccggaaaaaatagaatctagattccaatttaatgaataactcatgaaaaaactcccttcatattgtaatacaaaattaagtatagcacttttttatggaagaagtctctatgaaaatgattgttgtttcttcaaaaaaagtctaagataaaatacagaggtgacttatgaattcttcaaaaaaacaaatgaaaaacggaaatatttatttagtaatcgcactgatagtcgttataatcttattttacagttcttctcaaacttacggacagcaatcacaagtttcgcgattagaaagctggctgcctaatcagccatttaaagacacattagcgggtatacgttttaattatggtggaagtatggtgagtatcgaccatctgggctacgccaaatttttagagttctttttaaggaagggcgcacatttcggtacctattttattttgggaggcagcttgtttttaggtgttttccccaaactaaaaatttggtggctgacagcgatccttgcttggctttcagcaacagggtacgcaggtttggacgaattccatcagatgatgaccggtggacgaacacctatgttccaagatgtcatgttggattcgatcggtgctctgactgctgtgatattatgtgtgctttttgcggcattcaagaagcgtttatagattggctgtggctttgtttttttgtgaaatagtactagaatagaagtgtattctcaaaagaacaagggaggaaaaatcatgtcaggacatagtaaatggcataatatccaaggaagaaaaaatgcccaagatgcaaaacgagggaaagtctttcagaaactttctcgtgaaatttatatggcagctaaagcaggcggtcctgatccatctatgaatccagctttgcggcttgttgtggacaaagcaaaagctgcaaatatgcctaacgacaatgtggaacgggcgattaaaaaggctacgagtgccgtagatgaaacgaattacgatgaaatcacgtatgaaggatatggtccgggtggagtaggaatcttagtccatgcattgacagataaccgtaatcggacagcgacaaatgtccgagtagcttttactcgaaacggtggatcactgggagaaacgggttcagtcagttacttgtttgaccgcaaaggatatatcgctattgaacgcgatgggttgactgttgatgaagagacgatgtttgaggatgtattagaggcgggggcagaagatctgcaaacttctcctgaagtattcgagatttatactgcaccagaagattttgctgctgtacgagatgagttggaaaaagagttcactttggcgcaagcagaattgacgatgattccacaaacgacgattgatttaaatgaggaacaaaaagagcaattggaacgtctagtagataagctagaagacgatgatgatgtttcagaagtctttactgctgctgaaatgtaagtagcacatggttagataataaaaagaaagcacctgtaccaatcgtacgggtgctttctttttatatattatttttgttagaagaccaatacaggcgttcctttttcgaccatcccgaataattccttcattacacttggtggggtgttgatgcagccgtgtgaaccgcgggttttccataagtctccaccgtattcaggttgccagtctgaatcgtggataccaacacctgtccagtcaatcggcatccagtagtttaccggactctcgtaaggtgttccatcgtcatttgttccttttaaagttgcatcttcttctttattccaaacatagaagactccagcaggtgtaggtgtagttggctttccggaaacgatatctgtttcaagggccacttttccgtctttgtaataccacatatgctggttctccagatcaacttcgatatacgtatcttcgatcaatggatgatcagcggttgtgccaccttgcacaatgggtgaacgagtaaaatcttggcctgccagaatcgcttttttcaatgcttctgtctcgctgtctgtttggatcgtccaactgtaagtgccaactgggaccgtaacttctcctctttttgtacttttaaattttgtgtcattcgtacttgtgttatactttgtgcctaaatctgttacatattgacgtacttgttctgtatctaaatcgacttttccatcattgtaggtcagccaactcataatatcacttgatgggatctggaaagtctcaccgtttatactgtaagtagcttttacatttgcgatagcattcatggatgcgagttgttctttcagtgagctgtcttcagatgttacttttggtttttctttgaattcagtcaattcaattgtatctttaccagagtttaccgcactttttaattgtttgaccgcagcatcgacgtcgatcgtatttccattgacttcaggcttgataacgaaagagtcacctgctttttcgatcgttgcatcagtagtaggtgtccggtctttgttcaaatcagtcagcttagttgtcaatgtctgaacggtagtgtctagtttttggtggttttgactgacaggatctatttcttgtttttctgccgctgagacataagtcattccccaagtccatccgttttgttcatttaggatcggagaaagctccgaagtgaaatcatctttgtagccgagctcggattttggtacttcctgccagacttttccatcttctttaatagccagttttttatcagaataagcttcttttaatttttcatttgctttttcgactgttagattgctgacatttattccatttatttctgtattcggcaaaaaatgctttgtgtagtatgtactgcgataggtataaaagctgatcagcactaagagaacaccaagagctgaaagcaaagcaacatgtttcgatttttttcgatgcgaagatcttgtcatatcgacaactccttaagtaaaagtttagggtggaacggtctcatgatagcataatttagaggaaaagacgaaggttatctctactttatgaaaaaatttagaaaccataagggtgataaaataaaaaaacggaaaacaccgaatagatgttttccgtcatgttcaaagattattcagcgtctagtttagcaaaagcttcatctagaatttcttttaattgcttagcagaagcagccatacggtcttgctcgctgtcacttaaaggaatttcgattactttttggataccttgacggttgataacagcaggtgcaccaatgtagatgtcgttcaatccatattcgccattcatgaatactgataaaggaagaacagcattttcatcatctaagatggcacgagtgatacgtgctaatgctactgcgataccatagaaagtagcgccttttttctcgataattgtgtaagcagcgtcacgtacgccaaagaataggttaaccatagcttcttcatcgatttctgggttgttttttacccattcatagatttgcaagccggcaacatttgcatgtgaccaaactgggaattctgaatctccgtgttcacctaagatgtaagcatggacgttacgtgcatcaacgtcaactaattccgcaagtgcttgacggaaacgagctgagtcaagagaggtacctgaaccgattacgcgttctttagggaaacctgagaatttccaagttgagtaagtcaaaatatctactgggttagcggcaactaaaaagataccgttaaatcctgattcaacgatttgtgtgacaacatcgcggttgatttttaggtttttgtttactaagtctaaacgagtttcacctggtttttgtggtgcgccagctgtaataacaactaagtcagcatcatgtgcgtctgcgtaagtagcagaatagatttttttaggtgaagtaaatgccaaagcgtgagacaagtcaattgcgtctccttcagttttagcagtattgatatccacgatacctacttcttgagcgatattttgagtaactagagcaaaggcatagctagaacctacggcgccgtctccaacaagaataactttttgatgatcttttttttctgcagctgcagtcatttagtatcaatccttccattgatttgttttttcccatgcttatgctaacatttctcaagccccatgtcacgctatttggctataaaatataacagataacaaggttgtattatatgtaaaagcttacatgtgcgttatttcactatttttatatatcaattatttcattaaactttgaagaaatttttaatttctttatcatttattaacgattctcttttagccgaaacgccttgttttgtgttatactatgcattgacaagtataaaaaagaaaaaagctcgatggactggaccgctaattagcagtccagccttttgtgctgctttttagaattaggtggaaaacaaaaatgaaaatgatcgtcgggttaggaaacccaggtaccaaataccaatatacaaaacacaatatcggctttatggtcgtggataaaattgcacgcgagcatcaagctactttcaaaaaaaatccgttcgaagcagaagttgccgaattttttcataatggagaaaaggtccttttagtcaaaccacaaacattcatgaatgaatctggtcgtgcagtcggcccactaatgacttattttgggatttatccagaggaattagtcgtaatctacgatgatttggatctggcagtgggaaaaatccggctccgtcaaaagggaagtgccggcgggcataacggtatcaaaagtattatttcccatttgaatacgaatgtctttgatcgaatcaaggtgggaatcggcaggccagaagggaaaaaaacagtagtccagcatgtgcttagtcctttcagcaaagaaaatcagcctttgatagaagaaagcatgtgtcaatctgttaaagcagtcgaatatctcatagaagggcattcgttcgtggatgcgatgaatcgattcaattgaggaaggaggaaaaggaatggatattattcaattagtcggaaaagatccgcaagtaaaagaatgggtcagcaatttagaagaaaaaatgcctagacaactaatcacaggattagcgggctcagcgaaaacacttctatttgctcgagcgtttaagaaaacaaataaaaacatgattattctgatgccaaatttgtattatgcgaatcagttagcagaagatctgcaacatgtgattccgcaagatcagatccatttatttccagtggatgaagtgctttctgctgaaatggccttttcttctccagaagcgcgaggcgagagagttgcaacgcttaacgcacttcaagaaaaaaaagcaggtatctatttgttgccagtcgcatctttgcacaaacgactgccgaataagaaaacttggctacaggcgcaattgaattggcatattggtgatgagatagacgtggaaaatcttcctcgccaattgactttgatgggctatgtacgagaagagatggtcgcaaaaccgggagaattcagtattcgaggaagcattatcgatatttacccgttaacgacaacctatcctgttcgtgtagaactatttgatgtagagatagattctatgcggtattttgaagcagaaacacaacgctcaatcgaaaaaacggaagaaatctgggtttccccaacgagtgaacaagtctacggaccagaggatctagaacatggaatagagcaaatgcaaaaaatgctagaaaaacggcttgctgcgaccacagaagaagcagaccgcgagtttttgcaagattacttcggtcagctgacttcaagctggcaagcaggtgtcccgacagaagaagcaaaattctactcagatcttctttaccaagaatctgtgacgatcttggattatttcccttcaaatagtttactagtcgttgatgattatcagcgaatcatggaaacaaatcgggaaatcgaaagggaagcggcagaatggcagactcaaaaaatcagcgaattgcgggtgttttctgagcagacattttcagcagatatacaaaaaatcgtgcagaaggaaaagttcaccacaacctttttctcactcttccaaaaagggatgggaaatcttcgtttccaagcaatccataattttcaatatcggacgatgcaacagttcttcggacaaatgccattgctgaaaacagaaatggaccgttggcgcaagcaaaaacagactgttgtgatctttattccgacaaaggacagaatacgcaaagcagaacaaatgcttcgagatgaagacatattagtagtagaaacagaaaaaaatgcattgatcagaggacaggtacaattagttgaaggagctttgcaggctggttttgaacttcctcaagaaaaaatagtagctatcacagaaaaagaaattttccaaaaaacgacgaaaaaacaaacgagacgtcaaacagtaacaaacgcagagcgattgaaaagctataatgagttaaaagcaggagattacgttgtccatgccaatcatggtatcgggaaatacattgggatggaaacgctagaagtagatggcgttcaccaagactatatgactattttgtatcaaaacgacgacaaactgtttattcctgttactcaactgaatctgatccaaaaatatgtcgcctctgaagccaaagcgcctcgcatcaataagctaggcggaagtgaatggacgaaaaccaagcgaaaagtctcttcaaaaatcgaggatatcgctgacgatctaatcaaattatatgccgcaagagagtcagaaaaaggatatgcttttggacctgatgacgcctaccaaaaagaattcgaaaatgccttcccctactctgaaactgatgaccagttgagaagtgcaacggagatcaaacgggatatggaaaaagaaaaaccaatggatcgactactcgtaggtgatgttggttatgggaaaacagaagtagcgcttcgagcggcctttaaagctataaaggaaagcaaacaagtagcctttttagttccaacaacgatcttggcacagcagcactatgaaacgatgctggaaagatttgaaggcttccccgtaaatatcgggctattaagtcgtttcagaacaagaaagcaacaaaaagaaaccatcgaacaactgcgtacaggtcaagttgatattgttgtagggacccaccgaattttgtcaaaagatattgaatttagcgatttgggtctactgatcattgacgaagaacaacgttttggtgtaaaacataaggaacgattgaaacagttacgtgcacaagtggatgttttgactctgactgcaacaccgattccgagaactttgcatatgtcgatgttaggcgtgcgggatctttcagtaatcgaaacaccgcctgcgaatcgttatccgatccaaacatatgttatggaaaaaaatcctggggctattcgcgaagcaatccatcgagaaatgggacgaggtggacaagtattctatttatataatcgggtagaaacgatcgaacaaaaagtagaagaaatccaagaactcgttccggaagcacggatcggttatgctcatgggcaaatgacagaggcgcaattagaaaatacgctttttgaatttattgaaggtcagtatgatgttcttgtcactacaaccatcattgaaacaggagtagatatcccgaacgcaaatacgttgttcgttgagaacgctgattatatgggattatccacgttataccaattgcgagggcgggtaggaagaagcagccgtgtcgcatatgcttactttatgtatgagcagcagaagatccttaacgaagtcagtgaaaaacgtcttcaggcaatcaaagattttacagaactgggatctggattcaagattgcgatgcgggatctttccattcgcggtgcaggtaatctcttaggtgctcagcagcatggatttattgatgcagtcggtttcgatatgtattctcaaatgctaagcgaagctgtttctcgtaaacaaggaaagaatagtcaagtggagaagaccactgttgagatcgacctcggtgtcgatgcgtatctacctgaaacatacgtggcagatcaacggcagaaaatcgagatctataaacgaattcgtgaacttgattcgcaagaaatgctagatgaactagaagatgatctgctcgaccgttttggagaatatccagaagaagtagcacatctcttgacaattgggcagatcaaaatggatggcgatcgagcgctcctagaaacgataaggaaacaggaggcgcatatagtctttactctaagtaaagttggaacaaaacgctatagtgtggaacagttattcgaagcactgacagtggcaaaactaaaagccagtctaggcgttgaaaaagaacagatggtgatacgcttgacgatccccaaccaaatggaagaagcagtatggcttcaggaaatccaaaagtttgtcaaagcgttgcgtgagcaaaaatatctgtcagcgtaggaaggagcaatgatttggatcataaagaaatgcggcgcgtcatgcaaggagcatttgtattgacgattgcttctttcatagcaaaagtattaagtgccctttaccgaattcccctccaaaacttagtcggcgacgaaggtttttatgtttatcagcaagtttatccaatttatgggatagcaatgactttagctttatccggtcttccgcagttcatatcaaagtacgttgcagaaagaaagaatcctttcgagcgaaagcaagctttgcaaaatctttatcccttagtattttggacaggtgtctttttgtggttgtttgtcttttcatttagcagctggattgcttggatgatgggagacatacaattgaaaccgctgatccaagtagtttcctttacctttttgctgatgcctggtctatctttttatcgagggaatttccaaggaagattcttgatggaaccaactgctgtttctcaagtagttgagcagttcgttcgtgtttttgtgattgtctgtagtgcgtttgcttttagaaagcttggatggacggtgtaccaaacagggacggcagcaatgagtggagctgtttttggcggtttatgcgcatatgggatccttcactactatgaacaaaagattcatggaggagcgttaagcttccgacggtttccattgttcaaacagccgtcaaagcccttgatccggcgttttctgatagaaggcggactggtttcgatttatagtggattgcttatctttttccagctgatcgactctttctttgtaaaaaatgctttggaagtttacggactgtcagaatacggtgcgaagatagcaaaaggggtctatgatcgaggtcagcctttagtacaattaggtttagtgattgccactgcattaagtgcgacattcctgcctgcgttgactcgtcatttgaccaaccggatctatcgtcagtttttacagacagccaaaatctatcttagattgacgaccgctttagcattagctgcgtctttgggattagccttgctgctcccttatatcaattatgcgttgtttaaagattatgcgggaaatgcagcgcttgtattgtttgttttttccattgctttcactgcagtcatccaagcttatcaaagtattgctcaaagcaagaactcgtttcgcccttctttaaaaggcgcaggatggggactattggtaaaaggattgactacttcttttctgaccggtttattaggaacagcaggtgcaagcctgtctactcttttaggattaggtgtgacgctttggtattttgttcgaatcgaaacaaaagagctaaatgctttttggaaagaacggcattttggacggaagttgatgatcagccttctttgtatggcagtagtactgctgctgtattatggtgtattgaatatagtgtttggtcctgtaactcatcgttccactgctttttttgtcagcgtgataggagttgggatcggggcttctgtgttcatttatacagtgatccgtcttcgtctgtttacagtacgagaatggctaatgttgccttttggtaagaaaatcctgcgattaaataaaaaaattaaaaagtgaggaataagatatgcgattagataaatttttaaaaatttcccgaatcatcaaaagacgatcagtagcaaaagaagtagctgataaaggaagaattcaaatcaacggtaaattggcgaaatcttccagtgatgtcaaagtaggcgatattttgaaagtccagttcggcaacaaaacgttggaagtgaaaatcacggaattacatgaatcaaccaaaaaagaagatgcacaaaaaatgtacgaaattatttctgaaaatcgcacagaaacactagagaaatagattagacaagctttcacgatattggtataatgaaaaagacaatcaaaaagattggagcgaatccaagtgacgaaaaaaagcaataaaatcgctgcgctagatacggaatatgcaaagaaaaagtatgctgaatttcagcaacaacaacgtcaactgatttttcgaagacgcagactggctgcaatttttgttggtgctttggtcattttcgcgataataggtgtgcagattttccatgacatgcaaaggatgcatcaattgaacgaattgagagtcgaagcaaatactgaaatgaaagaagtcaacgcagacgttgatcagctgcaccaagatgtttcattgctgaaagatgatgagtatgtagctaaacttgccagaagcaaattcttttactcaaaagacggtgaaaaagtttatcctatattagaatcaaatacagacagctcgacaaatgaaacagatcaatcaactagttctacaactgcaaaataagcaggaatataaaaaagggaaataattaggaggaacattttttttatgtcaatcgaggtaggagcaaaactgcaaggaaaagtatcaggaatcacaaattttggtgcgtttattgatctaggtgctggaaaaacgggtctagttcatattagcgaagtgtcaaatggctatgtaaaagacatccatgatgttttaagtgtaggagatgaagtaacagtcaaagttatttcagtaaatgatgatggaaaaatcggactatctatccggaaagcgcaggaacaacctgctgaatctggagaagaaagccgtcctaaaaaatatcaacaaaaagatccccgtgacaaccgaaatcgtccagcacagaaaaaatctttttctcgcagtcaaccttcagctcaaaaagaagacttcgattcattgatgagttcatttttgaaagatagcgatgaccgcttatcttcattgaagcgaaacacagaaggaaagcgcggtggccgtggcggacgtcgcagctaaaaagccgcaaataatgatagtgcgactatttgggtcatagtatcaacagagggcaggttaattgtcgttttagacgttttcccgctctctttttttttaggaagaaagggtgtggaaaggatgaacgttgaaaaaggcgggaaaaaagcaccgctattacagcagtcatttattcggcacgggaatgaacaaggattctggcaacaaggatcgagaattttagcagcggtatcaggtggtgttgattcgatggttttgctccatttacttttacaagtgcaacgccaaatcggtttttctttaggtatcgtccacatcaatcaccaattaagagaagaatcagcagaagaagctgcctatcttcgctcatattgtgaagagaagaatctccctttatatgtaagtatttgggaagatccagccaaatccgccatagaaacagaagctcgtaactttcgttatcaagaattcactcgcgtgatggaagaaggacaatatgacacattgatgactgctcatcacggagatgatcaaatcgagacggtgttaatgaaaatcgttcgtgggggacagttaaatactttttctggaatcaaagaagtacaaccatttgctgctggcagactggttcgtccgttgctgagttttagcaaagaagacctatatacttatgcagcggaatcgcagcttgtttactttgaggatcagacaaaccaattgttagatgtccagagaaatcggcttcgtcatttggtagttcctcaattgaaacaagaaaatacacaggcgttgagacatttccagcaattttcgcaacagatccaatgggcagaccaagtcattcaaaaatatatgggacagttgatcgaaaaggaagtcgaacagtgggaggaacaatttcgattttctgcagaaatgattgaagaaatgacagatgctgaacgatactattttttttactcctttttcgacaaagcattctcaaaaacagggattattttgaaagaacaacaaatggagtcgattttagaccagtggcaacagaaaaaaagccaatggcaactcagtattggcaataattggatactgaaaagagagtatcattttgttgtactctctaaaaaagaaaaacaagcaactagccagacagaaaaccagcgcttgttgctgattccagaacaaggaatatatttgaatgaaacagaatggattggtctggtcaaacctgaaaatgcaggggacatcaaagcaacagattcatggtctctattttctcatgacatttggattcctgctgatgtgcaactgtatgtcgaaaaaagaaaagcaggagaccgcattaaattaacagagaatctcacaaaaaaagtatctagatattttatcgatcagaaagtacctaattcacaaaggcagcatgcttggatcattacagatgccaaaagaaatatatatagcttgataccttttgccttttcatatttgagtattcgtgaagaaactgataaaatacactacatacttctttacaaatatcaaaaagaagcaattggaaggagaacctgatgttggaaaaggatattgagagaattttgatctcacaagaagagatacaagttcgttgcaaagaactaggcaaagagttaacagaaatttaccaaaacaccaatcccctagtagtaggtgtcttaaaaggagcggtaccattcatggcagatatcgttcgttctatcgatacgtatttggaattggatttcatggatgtttcaagctacgggaatgcaacagtctcgtcaggggaagtaaaaatcgtcaaagacttagatacgaatgtagaaggtcgcgatctgttgatcgttgaagatatcattgacagcggaagaacacttgcttatttagtggatcttttcaaataccgcaaagcaaaatcagtcaaaattgttacactacttgacaaacctgaaggaagagtagtaaatatcgaagcagattatgttggcttcaacgtaccaaatgaatttgtggtcggttatggcttggattatgcagaagcatatcgtaaccttccgtacatcggtgtattgaaacctagtgtttatcaatcaaattaatgctgtatctcaattaaattatggtacaatagaatggtcaggattgataaaaaactgttaaattaaattgacgcttagggagggcaactatgaacaaaaagaacaacggcatgatgaaaaatgccttgtattatgtcctcgtaatcttagcgatggtaatggtcgtttattttatttttggtaataacggccagcgatcgtcagatatcgagtactcaaaattcacagaacaactacaagcaggcaagatcaaagaatttgaagtgcagcctgcaaatggtgtatataagatcactggtgaatacaaagaacagcagaccgtcgctaacagcggtgggttagctatcttaggttcaacagatacgactactacccatttcacaacaatcattttgccaaatgatacaacattgagccaagtaacagaactggcaaaagaaaacaaagttgctacaacagtaaaagaagaatcaagcagcggtatatgggtttccctattgcttagcttcttgccaatcgtaatcatcatctttttcttttacatgatgatgggacaacaaggcggcggtggcggtggcggccgtgtcatgaactttggtaaatcaaaagccaaagaagcagacaaaaaagctaatcgcgtacgtttttctgatgtagcgggtgcggaagaagaaaaacaagaactagttgaagttgttgaatttctgaaagatcctcgccgatttgttgaattaggtgcccgtatcccggcaggtgtacttttagaaggacctccaggaacaggtaaaaccttattagcaaaagctgttgccggagaagctggagtaccgttttactcgatctcgggttctgatttcgtagaaatgtttgtcggtgtcggagcaagtcgtgttcgtgatttgtttgaaacagcgaagaaaaacgcaccagctatcattttcattgatgaaattgatgcggtaggtcgtcaacgtggtgccggtatgggcggcggacatgatgaacgcgaacaaacattgaaccaattgcttgtagaaatggatggcttcgacggaaatgaaggagtaatcgtcattgctgcaaccaaccgttctgatgtactagacccagcgttactacgtccaggccgttttgaccgccagattttagttggacgtccagatgtaaaaggtcgtgaagcaatcttgcgagtccatgcacggaataaaccgatggcagatgacgttgacttgaaagttgtggctcaacagacaccaggttttgccggagcagatttagaaaatgtcttgaatgaagcagcgttagtagctgctagaagaaataaaaagaaaatcgatgcttctgatatcgatgaagcggaagatcgcgtgattgcaggtccagctaaaaaagatcgcgtaatcagcaaaaaagaacgcgaaatggttgcttatcacgaagctggtcatacgattgtcggattagtattgagtcgcgctcgggtcgtccacaaagtaacgatcatccctcgcggacgcgccggcggatatatgatcgctttaccaaaagaagatcagttcttgatgacgaaagaagatatgtttgaacaaatcgtaggcttacttggtggacgtacagctgaagaaatcatcttcaatgtccaatcaactggtgcttccaatgactttgagcaagcgacagctctagcacgaagcatggtaacagaatatggaatgagtgatcgtttaggtcctgttcaatatgaaggaaaccatcaagtgtttgttggccgcgactatggtcaaacaaaagcttactcggaacaagtcgctttcgagattgatcaagaagtacgaaaaatcttgatggaagctcatgataaagctcgagaaatcatcgaagctcatcgtgcacagcataaactgattgctgaaaaacttttggaattcgaaacattggatgccaaagcaatcaagtcattgtttgaacacggtgtgatgcctgaaggtactgagtcaaatgattatccaagcgaaaaagaagcgaaaacttttgaagaagcaaaacgtgctttggaagaaaaagacgctgaaaaacaagcggaagaaaaacgtgattttgaagaagcaaaacatgaactgaatgaggaaaataaagcagaacatgattcagattctcaacaatcagaagataatcattcagacgatcaatacaaataaaaaaatataggtcaactgatctgatatgactcccgaaaaccggaacaaaaaccggttttcgggagatttctttatttaagttgtaaataggatgatgtcctgttttctagatgattctgaattatttttaaaagaagcattccaaagttgaaaaaagcagtagttgctagtatgattcactatgagtttaaaaacggaaaaaggagtacataacaaatgaaagattatttggttaaggcacttgctcacgacggattcgtccgagcatacgccgttcaagcaacaaataccgtagcggaggcacaaagacgtcatgatacttggcacacctcctcagctgctttgggacggacattggtcggtagtctgctacttggtgcgacgctcaaaggagaagacaaactaactgttcgaatccaaggcgatggtccagcaacaggaattgtagtagatgcaaatggaaagggagatgtgaaaggttacatcaaaaatccgcatctcagtcttcctctaaatagtgaaggtaaaatcgatgtgcggggagcagttggaacacaaggaatgtttactgtcacaaaagacttaggattaaaagaacctttttctgggcaaacgccgattgtttctggagaaatcgctgaagattttacttactatcttgctatctcagaacaaatcccttcagctgttggactgagtgtattggtcaatactgacgacagcatcaagacggcgggaggattcatgatccaaatcatgccaggtgccgatgaagaaacaatcagcaagatcgaagaacaattaaaaacgacaccaagaatctctaccctcttagatgaaggacagacaccagaagaaatattgaaaggattgcttggtacagaagaattgaacattttggaaaaaatgcctgttcaattcaaatgtgactgttcaaaagaaaaatttgcagaagcaattatcgcgttaggtgcagaagaaatccaagcaatgatagacgaagatcacggtgcagaagcggtttgttctttctgtaataacaaatacaagtatagtgaagaagaattagctggattgaagaaagaagccttaggagggatttaagtggaacacacatggaaaatcggcaatgtggaaatccctaatcgtgtcgttgttgcaccgatggctggaataacaaattcagcatttcgagtcactgtcaaagaatttggtgcaggcttagtcgtatgtgaaatgatcagtgaccaaggtattcatttcagaaacaaaaaaactttagagatgctccacattgaagaaacagaacatccattaagtttacagatatttggcggaaataaagatagtctagttgaagctgctcaatttgtcgaagaaaacacagctgccgatataatagatatcaatatgggctgtccagtaaataaagtgatcaaagcagaagcaggagcaaaatggcttttagatcctgagaaagtatacgaaatggtccaagctgtttcttcagcagtagatatcccagtaacagtcaagatgcgtattggttgggatgaagagcacgtctttgctgtagaaaatgcattagcagcacaatcagctggagcaagtgccatcgctatgcatggacgtacacgggttcagatgtatgaaggaaaagcggactgggaagtattgaaagaagtgaaaaaacatttgacgatcccatttatggggaacggggatgtcaaaacgccagaagatgcaaaacggatgcttgactatgtcggtgcagacggtgtgatgattggtcgtgcagcgctgggcaatccttggatgattcaccgcacacagcattatctcgaaacaggagaactgattcctgaaccaacaccagccgaaaaaattgctacagctaaacttcatttacaacgcttagcagatctcaaaggagaaaaagtagcttgtagagaattcagaacacatgcggcttattatttaaaagggattcctcgagcagcgaaagtgaaagtagcaatcaatcagacagaaaaacagcaagaaatcaatgacctgctggatcaatttgtagaaaaagcggaaaaagtactattgaaacaaacgttgtgatttctaagtttttcgtgaattttcaagccgaaattccaagttcggcttgctttttttgtgtttcattggcattataggaaagagattaacatgagaatggaggaacttttgtgacacaggaacaacaacatcaagtagaagatttaaatgatcaaatgcttgtacgtcgtcaaaaaatggaacaattgcgtgaagatggaatcgatccatttggaaaacgatttgaacgcacgcacaactcagaagaattgcatgaactatttgatccaagaacaaaagaagaactagcagaaatgggattgaccgctagtgtagctggtcgtatgatgactcgccgaggaaaagggaaagctggatttgcgcatctacaagatcgtgaaggccaaattcaaatttatgtaagaaaagaccaagtaggtgatgaggcctatgaagtattcaaacatgcagaccttggagatttctttggtgtaactggacaaatcatgaaaacagacacaggtgaagtttctatcaaagcttcagaaatcacgattttgtcaaaagcacttcgtccactgccagataaataccatggcttaacgaatattgaacaacgctacagacaacgctacttggatttaatcagtaatcgcgaaagctttgaccgatttatgaaacgaagccaaattatcagcgaaatccgtcgctatttagatggcaatggctatattgaagtagaaacaccagtattgcacaatgaggcaggtggagctgccgcacgcccatttatcacgcatcataatgcactggacattgatttatatttgcgtattgcgctagaacttcatttaaaacgactaattgttggcggaatggaaaaagtttatgaaatcggccgcgttttccgtaatgaaggaattgatactacacataatccagaatttacgatgttagaagcatacacagcatatactgatttcaatgatgtaatgaatctgacagaaggtattatccgtaacgcagctgaaaaagtactaggaacagcaaaaatcacatatgatggacaagctgtcgacttagaaagtgactttaaacgcatccatatggtagatgcaatcaaagaacaaactggtgtagacttctggcaagaaatgacattggaagaagcattagctttagccgaaaaacacaatgtagaagtaaccgaagctatgggtgtcggacatgttatcaatgaattctttgaaacatttgttgaagaaacattgacacaaccgacgtttgtatacggacatccagtcgaagtttcgcctttagcgaagaaaaatccagaagatcctcgattcacagatcgattcgaactattcatcgtggggcgcgaatttgctaatgcctttacagaactgaacgatccaattgatcaaagagaaagattcgaagcgcaagaaaaagaacgtgaactaggaaatgacgaagctcacggtgtagacgaagacttcttggaagccttagaatacggtatgccgccaactggtggtctaggtatcgggatcgacagattagtaatgttgctaactgatgcacaatcaattcgggatgttttgctattcccaacaatgagataatcgaataaaagctgtctaaggaattccttaggcagcttttgctgtgtagaaaggaataaataataacgaaagttcaaaagctaatgccgactattctagacattaaagaagacgaaaacgaacgataaagaaagaaaagttatgaataatcgtttattgaaaaaaacttgaaaaaatacaaaaaattcgttgaccaagctaaatttagttggtatattattacttgtccaaaagacagaagaaaatatttattcaaaaacataacaaaaaagttattgacatgttactaacgacatgataagataactgagtcgttaaaaaagaaccacttgcgaagcttgattctatcgaaaaaaacttcaaaaaagttcttgacaaataacaaacgataagttatgataaatgagttgctgaaagatttcgaaaaacgaaatcgaaaaaacttttaaaaaagagttgacaaccgcttgtctctagataaaaaaggaggattaaatgagtatttgatagtatttatattaaaattacatatgtaatttaaaaacgcttgacattgtgtttgagatcacttacttttagtatgtaaaagtattggattaaggagctatgcaaatgaaaaagaaatttattactggtgggattgtcgttgcatttctatgtctaattggctacacaggcacgcggtacgcaaatgaaattattttgtggggtggagagacagatattgatacaatcaatgagaatctgacacagcttgatcatacattgacagataaagagcaagcgattacagatcttaccgctcgactagcacaaaaagaacaaacattgcaagattcaaaggcagatgtccaagaataccaaacaaaagtaaatgaattagaaaaccaaaaaaatcaatcggcagcagaaaaacaaaacttagaaagtcaattagtcagcaaggatgcacaactacaaagcaaacaaaatgaaatcaatgtcaaactagatgagatcaaccaaaaaaatgatgaaatcaatcatctgaatgcagattggacagcaagactacaagaagcacaagcaaaactttcagaattacaaaatactgtaaatggtttgaatcaacaaatcgcaacactgacacaagaaaaaacaaatgtagaaactcagttaacagatacacaaaagaaattagacgaaacaactgctgaaaactcaagcttgaaacaatatattcaaaagttataaaaagcaaaagatgaagtggaagatacagctgataaatctcagcaaattgttgaagaacatttgcgtaaataatctttcttaacaagtaaacctaaattagtaaagaagcaacagtaatctatactgctgcctcttttttttagtacatgtccttcatcttcgcaggaagtgccaatatgattttaagaaaggtattagacaaaaagtcaaaaagataaaacagagtttcttctttacaaagggaatgtatgttcgtataatggtattgaggtgaaggttatggagaaaaaatatggaacagtagataagatccgtactttgcaagttagtgccagaccgttgatccgtttcagtttaaatggggtcaattgtttgattgcttcccatagtttgaacttcctagctgaagtagacgaagggatgaagttagtcgttacaggttattataataatagaaagcaatttgttgtgagatcctatcatgtgttagggaaacccaaaattgtggtagaatatgagaaaagtctatacccaagaaaaaaggtccgacaagatgaaagaataaactagaaaacaagcggctgagacaaaaatgtcctagccgcttgttttggaaagatggatgcagacgatgggatttgaacccacacgagcatacgctcacaagaacctcaatctatatataactacatgtatttaagtatttgtgatgaatcactaaactttccaaactcatttgagggatattgcttaaagattgaacagatcaattcgaagccctattagtattcgctcaatggggggatcagaggccataaaaagagactagtcattactagtctcaggtagtggaattgtaggattttaaacgttcctggagagtaccggtatgtaactcgaagaggtgattatcatagtcgtaaaagtaaattgaagaagcctcgcctttcacacgagaacgtcctggttcgacagttaaacctaacatttggatttttgagacaaacgaatctatatcttgttcgtcaattttaaaagcaatatgattgtatgtctttggcagtttattcgacgaattctgcattactgcaatccataggtccttaactaagaaaaatttttctggatataatgaaaattttttttgttgactatcgtagatttcttttgcatcaaataaggtatttaacaatacagaagttttatttaagtctttaacaattaacgtaatatgagaaatttccatatcaaacctcctctttttatcgattctaacatagggtcaatttgatgaaaagcttttaattttattgttttaaaagttatttcaaaagaaaaatatggaagcagaatgagcgttcaagacagtatttcatctatatgatctaagagataaatcgcttaaaaagtgtatttcaagaagtgaaaagaagccatttcttaattcataagtgagaaaaatatagcattatatctatccgcagcaggcgtcaatcttgaaattaaacgattaaaaaagcaaaataaccgactgcaaaaaatagagcgttgtggcgaaaggagtgtacgtaaactacctgtatataggttactgatatataatggcataaagaaacgttcaaacaaaaaaactcgtgaagcaaaattaacttcacgagttgtagtgcagatgatgggactcgaacccacacgagctaacgctcacatgaccctcaatcatgcttgtctgccaattccaacacatctgctcgatataaaatcacagatttactaatagaaagtggcgtgtctgccattccatcacgtctgcgtaataataacacaataatgatagcgaggttttacatagttgtcaagctcaaaaatgggaggacttattaagatggagaaatatgacggagaattttcaggactgggaatgatcttaggtgtattgattggacttgcattcggacgttttttgcttggttttatgctaggaatcatttgtggaattgcaatggattgggcagcgaatctatggaatgactatcatgacaattaagttctcaacgcttgtttgtgtttttttaatacttacgtttttcctaaataagtggcaaaattttctaggatggagtatgatattgaaatagtaaataacaaaaaatttggaaagttctaactttttgaaatgagggattggctaagtgatgagagaatttgaaaaatccaacaaattagaaggtgtcagttacgatgttcgcggtcccgttctagaagaagcggagcggatgcaagaagagggcattagtattttaaaattgaacacgggaaatcccgcaccttttggatttgaagcaccaaacgaagtcattcgtgatttgatcatgaatgcccgtgactcagaaggctactcagattccaaggggatcttttctgctagaaaagcaattgagcaatattgccaactgaaacattttccgaatgtgacgatcaatgatatctacaccggcaacggagtgagcgaattgatcacgatgtgtatgcaggggttgctggacaatggagatgaagtactggttccaatgccggactatccgttgtggacggcttctattgcattagctggaggcacacctgttcattatatttgcgatgaagaggcagaatggtatcctgatattgatgatatcaaatcaaaaataacgagtcggacaaaagctattgttatcattaatcctaataatcctactggggcactttatccaaaagaattattagaagaaatcgttgaagtagctcgacaaaataacctgattatttattccgacgaaatctatgatcgcttagtgatggatggtctagaacatattccgattgctacattagcgcctgatttgttcgttgttacgctgaatggtctatccaaatctcatcgtgtagcaggatttcgagtaggctggatggtcctaagtggagataagtcacacgtcaaaggctatatagaagggctgaatatgttgtcctccatgcgtttgtgttccaatgtattgtctcagcaaattatccaaaccgcgctaggcggttatcaaagtgtcgatgagctgctcctgccaggcggaaggatctatgaacaaagagaatatatctataatgcaatcaatgatattcctggtctttcagccgtaaaaccaaaagctgctttttatatattcccaaaaattgatacaaagcgattcaatattttggatgatgaaaaattcgttttggactttctacatgaacatcatattctacttgtacatggtggtggatttaattggaaccagccagatcattttcgaatcgtttatcttcctaaaatggatgatttgaaacaaacagctaagaaaatgagagaattcctagcaacctatcgccaaaaatgattttaaaaaccaaatttttcagtaggagggccacagacaaacacactgaggctctctttctagtggagttttcttaaataactaaagtatattatttagttgcaagtcttttcttgaagtttgcgacttcctaaagtaaaatacgaatagaatgcgaatacgcatattttggggaggatacttatggaaacgttaatcgagtcctttggaacgatcattaaagagattcgaaaagaacaaaaaatgacgcaaaaaatgctttcgcaagatatttgttcacaaagtgtattaagtcggatcgaaaataatgaggaactgccgaatgtattggtgatgatgcagatttgtcaacggctaggggtaacgattgatcatgtgatgaatctctctcgaaaaactactcggacaaacgataaattatttgaactgttggatagttgtttccaaaaacgtgattatcggaagttagaacaagtactaaaatcttctgatatttctgaaaatctgtatcaagcaactgactttcaacgctattattattatctcggtgtttgcgaattcacgttgcgtcaaaatatctctcagtccctttattatttgaaagaagcattgagttactctagccaaaaagaaagaattcatgtctctgacacagaaatacaactgatcagttgcattggaaaaatatatggtgttgcaggaaaaacggctgaagcacgctactatttgagtcgaagcatccaactgctgcatcaatcagctgatgaacgatcaaaaagtgaattttcgcaaattttttataattatggaaatttcttattccatcaaaatgaaatcgacgaagcgttagaacaggtgaatcaaggaatctattgggctcaagagaagaatagctactattacctcaatgatttatttgtgcttaaaagcttaatatacaagcgtaaagaagaaccagaaagagcagcattctatgaaggcttagcacaagctgtgaaacaaatttcaaaaaatttgtaaatggtgtagaccattcttgacttcttctctaaataagagtactttagaggtagaaaaacaaagggagagaatagaatgagaacttttatctatgctgacaaattctttttagcgtcaggtgtcaaacatgcaggctatcttgaaattaccgatggactttttggtgaatacacgaaagaactacctgagggagaagtcaacattattgaccaaagcggcaaatggattgctcctggtttggtagatacacatattcacggttatatgaatcatgatgtaatggataatgatgcagaaggcatcaaagtgatgtctgaaggtctgttatcttgtggagtgacttcatttttaccaacaacattgacgtcaagcaaagaacgtttaaaagatgtagctgagacaatcggcaaaatgtatcaggaagcaccaggagctaaaatcaaaggaatctattttgaaggtcctttcttcacagaagaatacaaaggggcacaaaacccaagttatttcggggatcctgatttggatactttccatgaatggcaagaagcttcaggcggtttgatcaaaaagattgctttagcaccagaacgtcaaggtgtggaagagtttgtcaaacaagtgactgaagaaggagtagttgtttctctaggacacagtaatgctacactagaagaagcgcaaaaagctgttgaagcaggcgcaagtgtatttgtccatgctttcaatggtatgcgtggattgaatcatcgcgaaccaggtatggtgggtgcgttattatctttagaacatgtcttttctgaattgatttgtgatggccatcatgtacatccaaatgctgcgggaatcctaatggaaaaagcaggacatgatcatgtcgcattaattacagactgtatgatggccggtgggatgcctgatggaaattacaatttaggcgaatttccagtagtagtaaaagaaggaacagcacgtctagaatctggcaacttagctggaagtatattgaaattgaaagaagcaattaaaaatgttgtagactggggattagcaacaccagaacaagcagtcatgatggctagtctgattccagcaatcagctgtaaaatcgatgatacatgtggaaaaatcgctcaaggacgcgatgcagactttatcgtattgaaccctgatatgacattggaagcaacttatctagatggcgtggaacgtttccacgcataatataatttaagttaaccttaaaactaaacttcttaagtttagttttaaggtttttttttgcgttctagtaaaaatcactttacataagtttcaaaagtttctttaatttcctattgttcaataagtaacaatgtaaagataaaattaaaaatgttaatacgtattagcaaaataaaagcgttttttattgtgaataaatgaacatgattaggaggagaaagatgaacttatttgacatttttcgatcgactttgacagatatgtcgattgtcagtgcaatcacttcaacagtttttattatattattagggtttgtttgtagaaaaaaggggattttttctgaatctgttggaaaaattctatcgaaagtcgtcttaacagtggctttgccagcactggcatttcgagctttcatgcaagatatcaatacagaattactgatgcaaggaatcaatgtcttgatttggggattagttatttatattattcttattctagtttcaaaaccttttttcttaagctataaaggggataagcaaacaacgttgcgtgtcctgacgatctttggttctacgacctttttcggaacgcctatcgtcagtgcgatttatggtcctgtcggcgtgatgtattcctcaattttcaatattggctaccgaatctttttgtattcttatggatacataaaaatgagtggcttgaagatggaagctaaaaatatcaaagcgatgttcgtcaatccaatcattatcgctacttttgccggccttttcatttggctgttccaagggtatctgccacaagtgtcagttacaggtgcagaaggagagataagccaagtagcgtttttgcgaattgaccagactgcaccgtggctatttcagccgatggattatttagctggtttaagttcaccattggcgtggctagcaatcggcgcaacattaggtgaagtaagcttcaaaaaagctgcatctgaaaaaacttcatggtattacagtctagtcaaagtggtatttgtacctgcattgaatatcgtgattctagcagttttgacggcaacgaatattctaccagtcaattttgaagcactggcaacaatcgttatcatgatggctacaccagctgcaacagtggcagcagcctatgctatcagttttgatagggaggcacttttagcctccaatgcatccttactgtcaactatttttgctgtggtactgacacctgtatggatcgttgtattacaaatgattcatggcataggtttgttttcataagaaatggaggaagaaagtatgagaatcgcatgttacggtgttcgtccgaacgagatagatttttttgaaaaattgaatatttaccattatgatctcagtctttatgaagaactgttgacacatgacaatatcgtgtcagcaaaggaccatgatgctgtattgttgaggggaaattgtatagcagatgagaccaatcttgcaaaaatgcaggaatatgggattcgttatgtttttacacggactgtgggagtcaatcatatcgatctacaagcggcagctgattttggtatgacagtagcccgtgtaccatcgtattcgccaaatgcgatagcagagttatctttgacttttgccatgatgcttttgagaaatactgcgtatacgacgatccgaacatctttcaaagattttcgagtggatgagcaaatgtttagtcgtgaaatcagaaattgcacagtagggatcataggaacaggcaggatagggttgacggaagctgttttgtttaagggactaggagccaaagtgatcggctacgatattcatcagacagaagctgctaaaaaagtattgacgttccactcgcttgaagagttattagccaaaagcgatatcgtcagtattcatgtacctcatatcccaggtgaaaacgatcaaatgatcaatgaaggatttttagctcaaatgaaaaaaggcagcatcttgattaatacagcccgtggagagcttcaagataatgaagctattttaagagctttgaaaagcaatcatttagctggttttgcaaccgatgtttttgcaaatgaaacagaggtttttttccgatccttcaagccatgggagacgattccaaaccctgctatccggcaattagtagaaatgtaccctagagttcttgtaaccccgcatgtaggttcaaatacagatgaggcattatcaaatatgatttcgacaagtttcgagaactttcgtgaaataatagaaactggaaaaacgaaaaatgaggtatctcttcctaaagcccgtcaattaagataagaaaacatggatattcgtcaataaaatgtttaaaaatagtccaagtaaacagttgttacttctgtatacttggactattttgtatgggataattcgatgactcaacagtaatctgtgagctttttccgtccattatttgtcaattcataacaggttagcggccggccgatttccaaatatttgattctttcgttcaatatatcttgttctactaaaaaattcaaatatttcttgacggatatacgtgacagtgagcttttttgagccagttcttttgttgaaaaaatagtatcttcttttagaataaatgcacttattttttttaaagtcagttttgacagacctttaggcaaatcgatgaatgatggtatttcgtgaatgggagtggtgtggttgaatacttgatcgatcaatttctgatcggctttttcagtcgtttggattgtctgagagaaagcaagatacttttcgatcgccagctgaaaacgttgcaaagtgaacggtttgatcaaataatctaaggcaccgtagcggatcacattctttatggtttcgatatcatctgcagcagtgatcaaaatcactgggatatcatttccttgctgtctaagccaagataaaaaatggataccactttcgccaggcatgtatacatcaagcagcagcagatctgcgtttttttgtctgaaatatttttttccttcttctacatttctgaaactttcgattacgttcatattagggatactttccacaaaagtacgattcaattctgcaaccattggatcatcttcgattatcaggacatttgtcatcattttgatcttccttttttggtaattctagatagacgattgtaccgccatttgtttgtttggaaaattctaaaaatccaccgtggcgtttgacgattgaatggatgagattcaatccaaacccacgattgattcccttcgtcgaaaaacctagcgtaaatattttttctgagatttcttctgatatcccgacaccgtcatcgcagacggtcacgatgaatacttcagcttctgtgtcatagtttaaatgaatccggacctgtccgtttctttcatgtttttgtagcatggcttcttttgcattatcaagtaagttccctaacacttgcaaaagtgaatggatggagtcatccatctccattttagggataaaagaatcgctttctaacagcatttcaacagattgttctttggcttcgtttattttgcctaataaaaaaccggcaattgcaggtactttgatcagacttgagacttggccaatctcttttttataattttgatttagctgctggataaaatgggtgacttcttcatacttcttcaaatcaatcaaaccagaaatgacatgaagtttattcatgaattcatgggtttgagctctcatggagtttatatattgtttcgtccccccaagctcctccattaatttcattacttccgatcggttccgcaaagttgcgactgctcctaaaaaccgatcattgctaaaaagaggtgtaacgctagaaatagtttctatcccatttaaatacatggattgagtgcgaacggtcgtttgatgctcaatcgtctctttaaacaaaacgtcatatagattatcactgattttttttcctacttcgaaatccaatagctgctctgtttggtagaaaatgttttttgcaggtgtattgatcaagaggatagttttatcagaagagatggctaagattccttcatctacttcattttcgataatcgttttttcacttaactgttctgctatttcttgtggttcaagtccaagcagtacttttttcattttttgggcaagaaaaacggcgcctatgatgcctacgctaagtccgataatcaatgaaaaaacaatcattttttgtccatctttgacttgattgtcaatcgtgttgtttgttaagccaacacaaactgcaccaataatctcttgatcataataaatagggacgaaatagcggaagccgaaccctaacattccttctttttcagagaaaaattcttgtcctccaatcacttttttcacatcttcatgacttgagaaaggaagaccgatgtaacttgggtctgcgtgagaatatcgaatgccttcagggtccatgacaacgataaaatctaaattcgatgcaatcatgatttcatttgttattccttgaatcgcatgtgtcgggtcaccagtctgcagctttttttggatgagtttatcattggcaacgattttagcaatgctagagattttatctgacacactagatcggttcatcgaaagaataaaattcctgatcaatatggcagaaacaatcaaagaaacgaatgtggagaaacaaacgacaaggatgatcgtgttctggagctttaatggttttttcttaaaaaaaggaaacataggctacctcgaaagaatttattgtgaaaattttaacatgaaaacagaaatttaacaaattgtcaacgataaacacaaccttcctataaaaaacaccactgagtcggtaaaagaagctatacagaattttcaaacattggtatgatagacgtagaaatggaaggaggcgtgtatatgatagggggaatcgcacttgagacgatttattggtatacattgctgatttgtgcaggattggcagtcctattgattatttttggagatgtattcgattttgatggcccgcttgatccgatgcttattatcccttggttaactttcacaagcttatttggttttctaggtgagcgtttaacagatcaatcatctttatttttatttattgctagtggaggcatatcgatagtgttggtatttttgcttaatttctatatattgatgccgatgaaacatgccgaatcaacgatgtcgtcttctgaaaaaactctggaaggacaagtagctgttgtgatcacaccgatccctgtacgaggtatgggagaaattcagttgaaaagtgttaccggttccattagtcgtccagcttgtttttacagcccccaagaacagacagctgagcggggaacgaaagtattgatcattgagatcaaggaaagaatctgttatgtcatgccttatgaaagcatgataaaagcttaaaggagcgtgtgttaaatggaaataccagttgtttttatcgcgatcgcaatcgcagctttgattttactgatgttgctgatcgtctttgtagcgaagtaccagacagcaaaaccggatgaagcgttgatcatcagtggaagttatttaggaagcaaaaatgtgcacattgatgaaagcaataacaaaatcaaaattgtgcgtggaggtggcgcattcgtcttgccagtttttcaacgttcgaatcggatcagtctattatcgagtaaattggacgtctccacccctgaagtgtatacggaacaaggcgtaccggtgatgtgtgatggtacttcgatcatcaaaatcggttcatctgtagaagagattgctacagcagcagaacagtttttaggcaagacaagagaagaactggaaaatgaagcaagagaagtattagaaggacacttgcgctcgattcttggttctatgactgtagaagaaatctatcaaaatcgcgataagttcagtcaaagcgtacaagaagtcgcttctgtagaccttgcaaaaatggggttgatcatcgtttctttcactatcaaagaggtcagagacaaaaacggttatcttgactctttagggaaaccaagaatcgcccaagtcaaaagagatgcagatatagcagaagcggaagctctaaaagaaacgcgtatcaaaaaagctcaagcagaaaaagaatcacaagcagctgaattacagcgacaaacagagatcgcagaatcattaaaagaaaaagaactgaaattagcaacctacaaacaagaacaagatgttgctaaagcaaaagcagaccaagcctacaatttagaaagtgcccgagcacaacaacaagtaatcgaacaggaaatgcagattaaaatcgtagaacgtcaaaaacaaatcgaactggaagaaaaagaaatcacacgtcgtgaaaagcaatatgattcggaagtgaagaaaaaagcagatgccgatcggtacgctaaagaacaagaagcacaagctcaaaaagtcaaagaagtgactgaagccgaagcagaacgattccgtgtggaagcactggcagaagcggaagccaataagacacgtttagctggacaagcagaagccgaagcagcactagcaaaaggaaaagccgaagccgaagcaaaacaaaagatcgccaatgccttcaaggaatatggcgaagcagctgtcttgagtatggttatcgatatgctaccgcaattgatgcgcgaagcagcacagccgctaggaaatatcgaaaaaatctctgttgtcgatacaggaagcagttcaggagaaaccagtggagcgaaccgagtgacaaattatgccacaaatttgctttcttctactcaagaaacactaaaagcgacaacaggacttgacttgaaggaaatcgtagagaatttgtcgacacgtgggactactagccaagtaaatatgtatgaagcgccaaaagaggcagaacaaaactcgatgaatgaagaataaaatagtacacttcaccgttcaatcaaaaatggaggaagactttttaaagttcttctctccatttttttattttattgcaaaagaaaattagtcctcgctatttttcttttgtttttggatcttagcttctatctcttgtaaatttgttcttagcaatcgttctttcttttggagttcgaccaaatcttctgatagttcttccttcttttctgtttcaggaggacgaagaaagaaattgataccgattgcaatgaatgtccctataaaagtatctagtacacgttggatagcatacaaagcggattcgccttgagggatgctcaacgcaatcagcaacaacgtagcgattgcggaaatgataccggaattattgttaataccatctgacacgacgatcacaataataactagaataggaagcaagatcaattctaccaaaaaatcattgtgaaaatagcttttgacaaaaaaataaatgatagctaatgtaccacctaatgtattgccgatgatcctagactttccaaaagaaacggttgtagtcaagtcctgacgcaaagaaaaaacagcagataatgcagcaatcattgggattcctcgttgagtcaaatgaaaaaacaagatacataaaaaaacagctaaggcacttttgatcgtacgcatacctagtcgaaaacggccaaattgcatagagattctcctttttggtttttttactatcatacctaaacttttgtctgatagctagtttttcattattcaagtataattaaaataaaaaaagggggaagtaaatgcgtataggaatgcgaacagtcaaaacagtgatcagtgtcttcttttcgatggtcacagcgggtagcttatcgctgttgtattggccagctgcagggatcattgcattattaagtgtaggaaataccaagcgctctacattgcgtacgggcatgaatcgaatcgcagcctttatattagctacggcaacagcactgttcagtttttttgctgttgggtatactatttttggcttcagtctttttttattcctattcatcccgcttgcctctcgcttcaaattaaccgaagggatcgtagtaaattcggttttggtcactcattatttagtggaggaaaacatgtcttggcagctgatcggcaatgaagcgggattaatggcgattggattagtatttgctttgcttgcaaatgtttacatgccagatcgtacgaagcagctgaaggaaaaccaaatacagatcgaaaaagaatttcgaaatattttgagacaaatggcagaatttcttttatcagaaaataaagaagatgtgcagatcaaatgcgaacatttactgacattcattcgcgaaagccaagaagatgccagagaacatcaagaaaactactggctcagacagccgctatactacgaaacttacttctctatgagaagagcacaggccaatgtgattaaagacatgctggaaaatctagagagaatccagcaaccagcttattatggaaaacatatctatggtttattgatttatactgcagaaacattttcagagtcaaatgatggcagacaaattttagcacgtattgaagaagtttatgtattgtatcggcaaatgcctctgccgactagtcgccctgaattcgaggatcgagcagaattgttccagtttttgcagtcttttaaaagttttattgaaatcaaggcagaattctcccaacaaaaaatccaaaaatagaggttgtgaattcagctaatattcaggtcaaaaagctgatttcacaacctcttccttaaacggtgttctcctgccaactcctcggtcacaagttacaatattcaataaacatgagaagctgttttttgaaattgctccttgtgactcggagctgaacggcaggctcacgacctcttccttaaacggtgttctcctgccaactcctcggtcacaagtcacaatattcaacaaacatgagaagctgttttttgaaattgctccttgtgactcggagctgaacggcaggctcacgacctcttccttaaacggtgttctcctgtcaactcctcggtcataagtcacaatattcaacaaacatgagaagctgttttttgaaattgctccttgtgactcggagctgaacggcaggctcacaacctctttcttaaacggtgttcaaaagcttgcctctgcggtaataagtccagccaaacgaaaaataggaggagctatttttgtttggctgttcttattacttgatgcagaacagctttttcacaaccttttaaaattacatatttttccatagaacttgcatttgatccaagatttcgatgacatcttttgtcaagaagagagagcgattgggcaagtcaccttcaatcatgtgtaccatattctttatttcgtaattcattgcttcagatgtattcccgctttcgatgaattcctttgtaccatctgtaaataagatctccgcacgatcagcacgcgggtaatcagcaatcgtcacataaccgttctcaaaggcaacgataccgacttttggcatttttgcctgaaaagtcaagctgacagcagcaagttcattttctttgttacgcaagatagtgacggattgttcgtccacgcctgtttcaaaaggaaccattgtagaggcaactacttcaggttgagagctcaaaaagaaacgagcgaaagatacagcatacgtaccgatatccaacagagctcctccagctaattctggattgaagaaccggtttttagggtctggttctttgtaactgccgaaaggtgcttggatcatttttaaagcccccagttttcctgtatccattattgagcgtaactgctgataaagtggcatgttgaagattgtcatcgcttctgctaagatcaaattcttttcttctgctaagcgcatagcgtcagccagttcttttttattcatcgtgatggctttttcacatagaacgtgtttgcctgcttccaatgctgccaagatatggtcgatatgctgtctatttggtacagcaatgtacacgatgtcgatttcagcatcgtctaacatttcttgatagcttccgtaagcttttggaatattgtaacggtgagcgaagttttccgctttttctgaagttctggaagcaactgctgttagttcactcgtctcttgattgaagctttcggcaaactcatgtgcgatggtaccgagaccaacgattccccattgatattttttcatctgaaaacgctccttcatagttggattgagtttcttgtctgtctattattataacaaaaatcacgaagaataaaggggagaggacttgaaacattaaaaaaaatgaaagcagcgatttaagaggtgctttttgatcaaaacttaagtagaatagttaaaaggaggggataaacgtgcatcaagtatatattgatcttattatgagtgtattattagaacagtttgaaactgaaaaaaattttttagatgaatacttgctgatcagtccagaacaatggcaaaaatggaaagatggcgagaaaaacctgccatctgaagcgatgcagaaagtaaaaaatcttttcactgattatgaatggatgctaacgcaaaagattttgcgtcaaacgattatttttcccgaaaaacgaaacgttgccgttgcagagtacaagcaaatcaaaacacgcatcgcgcaaaaatggcttagcagcaaagcagcaaaagtcgagctgatccctttgaaaaataatcagcaggctggtagataccttgacttgaaagtaagtattcaatatgatgaatggggctatgatgatattttgaattttcgtctgccagcagatgttcaaaaacagatcgaaggagaaaaaatcgaacttctcgattgggtgaatgaaaatctggaagaaacttacgttcatgaggcgaatggggaacgtgaagaacaacgaaaggatttttcaagtgaataaatttttaggatttggagcagttgtgattatgatcgtagcaatgggctatgttatttttagcgatgatgattcgcatgttcaagccggcaatcaagcagtcgaacgaacaagcaccaaaacaactgctagtaaagaaaagaacagtcaaacaaccagcagcaaggtaaaggacaaagaaacaaaagatcgtacgtccaaacaattgccagatgttaaaacagacgattggaagctagttttggttggtccagatcacaaattagaaaaagaaatcgatgagtctactcaattggcatcattaagtaacggatacttgatcgacaaacgcattgctccagaatatgaagcatttgccaaggctgctgaagcagctggatttccattagtgatggtctcagcttaccggtctgtatcatcccaacaacaagttttcgaacaaaatgtccaagatgtgatgagtcgtcaaggtgtatcagaagaggaggcgacaaagattactaaagaaacgattacggagccaggatacagcgaacaccacacaggtctggcagtcgatgtcgtcgatcaaaactggtacaacagttatccttctactgtattggatgcaagttacggagatcagcctggagctaaatggatcgcagataatgctgcgcagtatggatttatcgttcgttatccaaaaggacacgaagatataactaagatcacatatgaaccttggcacttacgttatgtcggtaaagaaaatgctgagtatatcaccaaacaccaattgacgctagaagaatatctgaatgaattaaatgaaaagtaggaattgatcatggcgaaaaaaaagtggaaaaagcaaaagcgcaagaatatccgttggccagcagtggttgccggtgtagcagtgatactcttagcctttgttttttccttgaagaatctgtcttctccttttactgataatcagcaagaaaatgaagcgcaatcccatcagcaatttattgaacggcttgttccgcatgcccaagaactacaagatggttatggagtgcttcctagtatcattttaggacaagctatattagaatcaaattggggaaaaagtaccttggctagcaaatacaataatcttttcgggatcaaggcttatggggatcagaagaaagtaagcctggaaacaaaggaatttgttaacgaagaatggataactatccaaggagacttcaaagtgtatgattcatgggaacagtccatggatgaccatacacaactgttcgtccaaggagtagattggaatcctgcactgtatgaaaaagtgattacggccaccaactatcaggaagccgcacaagcattgcaagatgcaggttatgcgacagaccccggttatgcgcaaaaaatcatccaggtcatcgagacgtatcgattgaatcagtatgaccggagatagcaaaggagaagtggctgatggcagaacaatttacgccagaaatcatgacggaattgagaaaagatatcgtaagagtaccggaaatcattttagaagcaagcgggatcaagatatttggaaaattgatccgttcgatcatctttactacggatattgcgatcatacgtaatacaaatgcgaatgcagtaattgctgtgtatccttttacacctcatccagcgattactaaaagcattattgaggcagctgacattccagttttctccggtgtaggtggtggtttgacacaaggtgctcgttcttcctacatgagcatgttcgcagaagcgcaaggttcgttaggggtcgttttgaacggtcctacgcctttagagacagtaaaagaagtttgtcgagtagttgatattccagttatcagtacggtaacgtcgaaatatacagaaatagatgaaaagttagcagctggtatttcgattatcaatatcagtgcaggtaaagaaactgcagaagcagtacgccattttcgtaaaaaatatcctgaacttcctatcattgcgacaggtggtccaacggaagaaagtattgctgagaccattcaagcaggagcaaatgccatcacatatacgccaccaagtagcggagaactttttagtcgtaaaatggaaaaatatcgggaaactgagaaaaagaatcatgaataacaggtgataatcaaaagacgaggaagagcagatagtggctcttcctcgtcttttgtactccagtactatttgttcagaattcaaaaaaaagagaaatttttttgtttttttatctgtaatgtacataagaagagttaaaaccttttgttattattagcattctaacaaaaaaatgtcttgatttattgaagcgctttctatagaatgaaaaacgaataaaaactaaaaaaaggcacccgacaatttagtagcagctaaattgtcggggcttgaaaagtcagcgggaactgaccaatcaagttgccatagtcaatgcttgtgcatcgacgtgtatattgtacctaatttcatacagaattactagttatttttctgttttttagggaagagcgtacacgaagaagcatgcttatttagctatgtcaaggatattggacagttgtctgatatccttttttctttgcgtaattattctcccatcattgaagcaagaagtgtttttagcgatgaaagaagaatcagcactatctaattttccttgaaagtattgagttgttcaacctaggcagaacgataaggcaagtcttggtttttattccccttgaaaaagatcgtttaataaatatgttctgtataaaaatacagtatattgaaaaataacaatggaagtagaggtgcagagaatgaagaaaagaatgagaatcatcttagctttaagtgttatgttattcttcttgacggcttgtgggcaagaagatgacaaaaaaatcacgctgaacatggcttggtggggttcgcaagtccgacacgatgcaacagtaaaagtaatcgagctttatgaagaaaaaaatccccatgtgacgatcgattatgaattttatgattatgaaggatattacacaaaattaggtacactagcagcatcagatgatatctgggacattttccaactgaacaatcaatttcctcaatacatcaatcagattgaaccattagatgaatatgtggagcaagggataattgatatttctaatgcagatgaatcctatttagcaacgacgacttacgatgggcaattagttggactgtctaacggggtgaattcgtttgcgattgcttacaataaaaatatatttgaacaattaaatatccctgaacctgcttcaaattggacatgggatgaatttgaacaaatcagctatcaaatcactgaagaattaggaatctatgctatttcaagattcgaagattttatagctggctgtattattcaaataccacaagttgagaaaggattgaatttttataatcgggaagatctatctaacagcttgggatttgaaaatccagactatctaacagattttttccagctgcgtaaaaatctggtagacaaaggtgcccatccggaaccaggtggtggagctgcaagtacgacggatctgtcttttcaggcggttagggatagagaagcggcaatggtgtttctatcaagtaaccagttgacagaaatattgtcaggagcgcctgaagatatggagattcagttgattaatccacctcgcagaaaagcagatggagaatctggtatccctttacgttcttcgcaaatgctgagtatggcaaaaagctcagcccataaagaagaagctgctaagtttattgatttctttcaaaacagtgaagaagccaatgaaattttaaaaggagaacgtggtgtaccaatcatgtcgaatattcgagaacagctcgctcgtgcagatgatgcaactttgcaagcgacatttgactatttagaaatgatttccgatatggacaacggcgaagtgaatgtctttgatagtgctttgaatccggaaattcaagaccaatacaatcttttagttgaaaaagtcatttatgaagaagtaacagcagaagaagcagcagagagtctttatgagtttgcgtcaaacattctaggatagcagcaggaggaaggcatgaaaaaagaaaaactaaaacggttcttggatcaagacaatgtggtcggttacgtatttgcttctccattcatcctaggatttctattgataacagtgataccgatgatcttgtcactttattattcgttcaccgattatcgtttgggaaatccagtctcatggatcggcttggataattatataaagatgctgagtgatgcccgttttttgaactccatccgagtcacttttctctatgtatttgcatctgtacctgtgaaactgatctttggtctattgattgcttatcttttaacgaggaatatcaaaggaacgactttctttcgttctttgtattatgtgcctagtttgatcggtggcagtatttctatcgctctagtttggcgggagttgttttctaaaaacgggttagtgaatatttttctggaacgattaggcgcacctgcgctttcctggtttagcgatcaaaaactggtcatgatccctcttgttttgatgtctgcttggcaattcggttcggcaatgatcatctttgctgcaggtatcaaagagatcccaggctcgtattatgaagcggcagagatcgatggagcgaacaaatggcagacgttttacaagattacgttacctcttctttcgccgatcattttgtataacttggttatgcagacaatcgcggcgtttatgacttttacgcaggcatttatcattacccaaggtggtccgaatgatgccacgaacttttatgctctttatgtgtataaccaagctttttcttttaattctatggggtatgctagtgctatttcgtggatcatgctgttgattatgggagctgtcacctttctgattttcaaatcatcaaaaaaatgggtcgttgtgtgaatgagaggaggaagaaatgaataatacagtaacgaaatggtttcaatacggttttattttgctattaggtctagtcatgatttatccggtcttatggatgatcgcaggttcttttaaaacggatcaagagattctgagtggttcgctgaatttgattccagagacttttcaatgggaaaattacgcaaaaggatgggcgggggttgctggaatttcattttttactttctttaggaattcgtttgtcatctctgcagtttcgacgatagggacagttctgagctcgacttgtattgcttacgcattatcgagaatcgatttcaaaggaaaaagattctggttcgtcgtcatgttagtaacgatgatgattcctgcgcaagtgattttgattccgcagtttattatttacaatcggctgaatttggttgggacgtatgtgccgctgattttaccacatttttttggacaagcatttttcatttaccagatcatgcaattcatggtcagcatccccaaagagttagatgaatcagcgattattgacggatgcagcaagtatagtgtctttaccaaaattatttttcctttgctgaaaccttcgatcatcacgacgatcatcatccagttttattggaaatgggacgacttcatgggaccattgatttatttaaacaagccgagatcttacacggtatcgattgccatcaaattatttgcagacgctggatctagtacgacttacgcgagtatgtttgcgatgtctacgttgtcgctgctaccggtttttctgattttcttattcttcaataaatatcttgtccaggggatcagtacaagcggtctgaagggctgaatatgaaaaagccaatagaagagatgtttctttacaagctcaactactatttctgtcggatttttttaaccagtcttatcagtaatgctcttttcgctttagttctaggatgtttgttcactttaggattagtgctgtctgctcgtgttgtctatctgatttattttttgatgatgtatccttcttattatctatctgtccattacttggcagaaaaaaaggtatgttggaggaaagaaaaaatcaaacggatgtgtttcatcattacgttgtttcagctgtttgtcattatttttgcagttgattggtatttattagtgggaaagattggagcttggtatctgattccttttctattgtgtctgttgctttttgtatcccatagtttttttagtacgctaattgatatttgcaaagaagataaagcagatagtcttgtttatttgatcaaaaggaatatctggctgttgtcaaaaaacgtcaaagggtttctgtggtatttatgccttttgtatggactgttctggtgtatacagcatgattttttactcactgcattactgtatccagggctgccatttgtcacagtattttgcttaaaagaaaaggagaatgactttaaatgaagaaaaaatatgtacaagtcggacttggtgggagagcgcgttttttttatgaggcaattgcctctacgtatcatcaaacttgtgaactagtcggtttttgtgatgtatctcaaacaaggatggattatgcaaatcggatacttgtgaacaagtatggacagaaaaaagtaaagacatgtatgccatcacaatttgagcaactactggatgacgtacggccggctgaagtcattattacgtcagtagatcgaacgcatcatgattatatcattcgtgcaatgaaaaaaggatatgatgttatttgcgaaaaacctctgactatcgatgaggaaaaagctcaagaaataataacggtccaaaaacagacgggaagaagcctgcgagtcactttcaattatcgttatgcaccgtatcacacgaagataaaggaactgatagaaagtgatgtgattggtgatgtgttttctatccacttcgaatggctgttaaatacgcaacacggggcagattatttcagaagatggcatcgaaataagcacaatagcggcgggcttcttgttcataaatctacccatcattttgatctagtgaatttttggttgaacagccgtcccaaaaaggtatttgcattcggtggattaaacttttatgggatgcataatgcagagaaacgcggagtagaaacattttacagtcgatgctatggaagcgaactagctaaaactgatccatttgctatagacctgtcagccaatgaggaattgcgagaaatgtatttagaagcagaaaaagacagtggatacattcgtgaccgcagtgtattttccgatgatatctctattgaagatacactaggcgtaacggtcaaatatgaaactggtgcgattttgacgtattcgctaaacgcgtatatgccgtgggaaggattcaatgtttctttcaatggcagcaaaggacggatcgaaatgaaagtgatcgaaaagtcttacatcaatgcaggtggagataaaaaggatgaaggagcagccgttcttcagtccatccatgtctatccgatgttcggtgagccatatgaggtaatcgtcgaacaagaagcgggcggacatggcggaggagatccgcgtttattagatgatctatttggtgaagaaaaagaagaagatccgtggaatcgggcagcaactcacgtagatggtattttgtcgattttgacaggaatcgcagcaaatcattctattgcttcaggaaaagcagtagtgattgacgagcttgtcagcttaaaagaataagaatagatttacggaaattacttcccgtagtttataaaatcttgccttattgccgataggctgtcttttgaacactatttattcggaaaaaggggctatgacatgctttttgtcatgccttctttttatgtgggctgcttttttagataggagaaaataaaaataactatttaaacccgaacaaaaaggaataatgcattaaaaatcattagattttacaaaaaaataagtaaaccacgttgtcagtttcagaaagtagtgttagactgttttcaatatttgaaacaacattttttattcaaatatggcaaactgccttcacgtgcaaaacagttgcaagaaaatgaatttacactattattagttttacatacctacttatatatcgtcataatatggatgacagtttctagccagtaccgtaaatgctggactataagtaaaagattggctatttcacccttcttttcttatgataaagtggagggtgtttttctttaacagaaacatagtaggtttttgcacaaaagcggttatttcggtattaataaatgataaaggagcaaataaagtgaaagaattagttgaacgtattcaaaaagacggacgtatattaggcgagggcgtattaaaagtcgacagcttcgtcactcaccaagtagaccctgtattgatggaacaaatgggaaaacggtttgcagaagtatttaaagaacaaggaatcacgaaagttgtgaccattgaagcttctgggatcgcaccagctttatttgctgcaaaagaattagatgttccaatgatcttcgctagaaaagcaaaaagtttgacgatggatgaagaattattgacagcttctgtttattcttttacgaaacaagtgacaagtacgatttctatttctcgtaaattcttatcttcagaagacaaagtattgattatcgacgatttcttggcaaacggacaagcggcaaaaggattgatcgaattatgccagcaagctggagctcaagtagaaggaatcgggatcgtcatcgaaaagtctttccaagatggacgtcagttacttgaagaaatgggattgagagtcgtttctcttgcgcgtattgcttccttgacgaatggacaagttgagtttcttgaggaggacgcataatcgtggaaaaagaaacacaaaatggaaaagctgcggttttagggctgcagcatctgctagcgatgtatgcaggagcagtagcggtgcctcttttgatcggtacaggactaggctttaatcaagaacagatgacttatttgatttcaattgatatctttatgtgtggattagcgacattattgcaattgacagttaaccgatttttcggaattggcttgcctgtcgttttaggatgtgcgatccaagcagtagctccactgatcttgatcggaaccaatgaaggagtaggagctatctacggatctattatcgcttctgggatctttgttgtgttagtttctggtgtcttttctaaaattaaaaaactattccctcctatagtaacaggaacggttatcaccgttattggtttgactttgattcctgtagcaatcgagaaaatgggtggaggtaatgcaacagcagctgattttggtgacaaaacaaatctactacttgcatttgtgacgattctcctaattgtaggcgtgcaaatgctggcaaaagggttcattcgttcaatcgcggtattgattggtttagtcggaggaagcatcttagctgctttcatgggaatgattgatctgagcgcgattggagatgcgccgttgttccatgttccacaacccttttattttggtaaaccgactttcgacgtatggtcgattttactaatgatcatcatttccatggtcagcatggtagaatcaacaggtgtatattttgcacttggtgacattactgggaaaaatgttggagaagaagaattgaaaaagggatatcgtgcagaaggacttgccgttatcttaggcggtattttcaatacattcccttatactggcttttctcaaaatgtcggattggttcaactttcgggaatcaaaacaagaaaacccatctatttctctgcattcttcttgattgttttaggattatttcctaaaatcggtgcgttagcacaaatcatccctgagccggtacttggtggaggaatgttagtcatgttcgggatggtggcagtccaaggaatccgtatgctgttggaagttgatttcagcaatgataaaaatctattgattgttgctgtttctgttggatttgggctgggtttcaatgttacgccgacattattcagtcaaatgccgcaaacattgcaaatgttcactggaaatggcatcgtaatgagtagcattacggctatcatattgaatttgatctttaatggattgaaaaaagatgaagaaatattggaagaagccttcaagaagtaatagagcaaaagaaaggttgtgaaatcagcgttttgacctgattgttagagaaacaaacggaaaaatagttcctcgtattttgccgtttgtttgagctaataccgagggtcagctgattgaacaccgttgaaggaagaggtcgtgagcctgccgttcatctccgagtcacaaggaacaatttcaaaaaacagcttctcatgtttgttgaatattgttccttgtgaccgaggagttggcaggagaacaccgtttatccataaaaaggaatgtgacctaacttttgtcacattcctttttttcatctttaataaacacgaacaataagatgtttttttttgttaacattcgaaatttctttgacatcaaaaaatgtgattgttaaaatatgaatgtagaaaaactgggaggaaaaacaatgacagcaaaaatctctgtgattatggggagtacttcagattgggaaacaatgaaagaagcatgtcaaatattggatgaattcggtgtgtcttatgaaaaaaaggtcgtttctgctcatcgaaccccagatttgatgtttgaatatgcacaaaacgctcgaaaaaaaggaatcaagatcattattgcaggggcagggggagccgcgcatctgccgggtatggtcgcatcaaaaacaactttgccggttatcggtgtaccggtccaatcacgaacattaaatggtttggattcgcttctttcgattgtccaaatgcctggaggagtacctgtagctactacagcaatcggaaaagcgggagcaattaatgctggactacttgcgatacagatgctttccatgtatgatttagaattggaggctaaattggctgaaagacgttcaatgttggctaaaactgttatagaaagtagtgatcaacttggttaaacctttgttgcctggttcaacgatcgggatcgtcggtggcggtcaattaggtcgtatgatggcgattagtgcaaaagaaatgggctttaaagtaggtgtgctggatcctgtgagcgattgtccagccgcacaagttgcagattggcacattgaaagtgtctatgatgacacctttgcgctgaaagagcttgccagaagaacagatgtcattacctatgaattcgaaaatgtcagtgtagaggcgttaaatgcgattttacccatgtcatttattcctcaagggacagacttgcttgcgattacgcaagaccgcctgttagaaaaatcttttttggaaacgaacaacatcgtgattgctccttatgcaacaatcgtcagtccgacggatatccaagatgcgattgacgggatcggctatccttgtgttttgaaaaccactcgaggcggctatgatggcaaggggcagtatgttttgaaaagtcgggcggatctagctcctgccatggaccttttaagagaaggaacctgtgttttagaagcatggatcccgtttgaaaaagagatttcgatcatggtggcaggaaatggtcaaggagatttcacgacttttccggtcgtggaaaacatccaccacaacaatattcttcatgaaacgattgctccagctgcgattgatcaggatgtgatcgaggaggctgagcgtattgcccgtgtgattgcagaagcagtgagcctttcaggtgttttaggggtagaaatgtttttaacaaaaacaggcgggctatatgtgaatgaattagctcctcgtcctcacaattctggacattattctatcgaagcttgttctattagtcagttcgatgcccatattcgaggtatttgcggatggccattagtagaaaaagtgcgtctgacaagcaatgcagtgatggtcaatgttttgggagaacaactgctggaaagctatcgcttgattgagaataagccagactggcaattccatttctatggaaaaaaacaagcgaaaaaaggtcgcaagatgggacatatcactatcttgacagaagacatccagcaaacgctggaagaaatcaaacaaacgaatatttgggattagaggagaaaaaacatgttagaacgttatacacgccctgaaatggggaatatctggacggaagagaacaaataccgtgcgtggctcgaagtcgagattttagcagatgaagcttgggcagaacttggtgaaatcccgcaagaagatgtgaaaaaaatccgtgagcatgcatcatttgatatcgatcggatcttggaaatcgaaaaatcaacacgccatgatgttgttgcttttacacgagcagtttctgaaacattgggagaagaaagaaaatgggtccattatggtctaacaagtacggatgtcgtagatactgcttatggctatctcatcaagcaagcaaatgatattttacgggaagacttgaaacgttttacggaaatcattggcgaaaaagcaaaagaacacaaatatacagtgatgatgggtcggacacacggtgtccatgctgaaccaactacttttggattgaaacttgccacatggtattcagaaatgaaacggaacatcgaacgatttgaatatgcggcaaaaggagtagaagcaggaaaaatctcaggagcagtggggacgttcgcaaatatcccgccatttattgaagagtatgtatgtaaacaattggggatccgtccgcaagaaatctctactcaagttctccctcgggatctacatgctgaatatttctcagcgatggcgcttattgctacaagtattgaacgttttgcaacagagatacgcggattgcaaaaatccgaaacacgtgaagtagaagaattttttgcgaaaggtcaaaaaggttcttctgctatgccgcacaaaaggaatccgatcggttcagaaaatatggctggtctagccagagtggtgcgcggacacatggtcactgcctatgaaaatgtcacattatggcatgaaagagatatttctcattcttcagcagaacgaatcatcttgcctgataccacgattttattgaattacatgttaaatcgttttggcaatatcgttaaaaatctaacggtctttcctgaaaacatgaagcggaatatgtctgcaacatttggtttgatttatagccagcgcgttatgctgaaattgatcgataagggaatgacaagagaagaagcttatgatcttgttcagccaaaaactgcgtacgcttgggacaaccaagtgcagttccgcccgctgttagaagaagatccaaccatcacatcggtattatctaaagaagaaatagacgatgcctttgattatcatcatcatttgaaaaacgttgacgtgatattcaaacgagtaggtttggaataaagaagagtgagttgcaaaattcaattaaaatagaatagcaaaaataaccaaaaaagaagcagatccgttagcggttctgcttcttttagtttattatattttcttatcaataataggaacctgattttaaaagcggctacctctttaccgtgcctctttacatacaaaaaatagaggaattaagcgtaaatggcttggctattataactaaaatgctggttatggagatgttgcagcaagttttcgagaaaagcgtattccatctcttgtccattgaataagatctggatacgataatgatttttgaaacgcttctgttcatgaatctgactgattgaaagttcgcctttgtgttctgtctgataactaaaagtccttttacggcattcagcacagcgcttggttgctcggcggatttttcggaatgtataaaaactagtatctttattgcataaataaacgtctttgatcgacagcaaatcattatatagacaggaacgttcttcagctgttaattctgataaaaaaagctgaccttgttttattgcatcttccatcggcaagtgcctcctcgaaccattatccaaatttttagttaattctaatataccatcattaagtataaatgtaaacgcttgttgatggtataagattttcgtttttgataaaacacgaacattaaaagaatctaatgccttgaatgtacatatttttgttgatttataaaaagatgattgctaaaatttaaagtgaaaacacgaacaaaaaaacgatgtatttgcttttaatgtaaacaaaaaggagagacgtacatggagaagaaagaacttctgtatgaagggaaagccaaaaaaatatatcttacttctgatgagaacttgatttggatagaatatttagatcaagcaactgcgttgaatggcgcgaggaaagaccagataagtggaaaaggagaattgaataatcaaatcacaagtgcaattttccgttatctgactcaaagaggaataaaaaatcattttattgaacaattgtctaaaaccgaacaattagcaaaaaaagtacaaattatccctctcgaagtggttatccgaaatattgcagcaggaagtttctcaaaacgtctaggtgttcccgaaggtaaagaattcatcaaaccaatcattgaattctactataaggatgaccagttggatgatccatttatcaatgaagagcatatctatttcttacaacttgcaaaaccggaagaaatcagtgagctgaaagcccaagcgttggctattaatgaaattttgaccgaattatttgctaaggtcggtttggttttagtagatttcaagctagagtttggccggtcgaatggacaaattttgcttgcggatgaagtaacaccggatacttgccgattatgggatgaacgtacgaatgaacatatggacaaagacgtttaccgcagagatctaggtgatttgatcccagtctatcaagaagtatataaccgtctatcggaactaactgaagaaaaggagcgagtttgatgtatttcgtaaaagtatatgtaacctataaagattcagtgttagatcctcaaggggaggcagtaaaaaaagcagtccatcgtatgggatatgaaacaatcgaagatatccgtataggaaaatactttgagatacaacttgctgatgcagaagaaccaatcgatacagtgattgaaacgatttgtgacaagctgcttgcaaatgtaaatatggaaacataccgatatgaaatcaaaaaaatggaggaagtataacatgaaatttgcggtcatcgtttttccaggttcaaattgtgacgcagatatgttatgggcagttcgcgagatcatgggcgctgatgccgaatttgtacggcatgatgagtcctctttagaaggatttgatggggttttactgccgggaggattctcctatggtgactatttgagatgcggtgcgattgctcggttttctacaatcatggaagaagtgattcgttttgctgaagaagggaaaccggtattcggtacatgcaatggattccagatattgacagaagcaggacttttgccaggtgtactgagacgaaatgagtctttgcattttatttgcaaaactgtaccattgaaagtcaaccccaagacggcctttacttcagagtatgaagccgacgaaataatctatcttccagttgctcatggggaaggaaattatttctgtgacgaagaaacacttcaagaactaaaaaaaaataatcagattgcctttacttataatgacaacatcaacggcagcgtggaaaacattgcagggattacgaacaaagcagggaatgtgttaggaatgatgcctcatccagaacgtgcagtagaagacttgctaggatcagaagatgggaaacggttctttgcttccattttaaaaaacttcggaaaggtgaccgtatagatgaaaacattgaaagaaccgacagctgaagagatcaagaaaaaaagaatctatgccgaatggggattgactgatgaagaatatcgaatgatcgaagaagatatcttaggaagaatgcctaattatacggaaactggactgttctctgttatgtggagcgaacattgttcctataaaaattctaaaccggttctacgcaaatttcctactagtggacctcatgtgttgcaaggccctggagaaggcgcaggcatcgtcgacatcggtgatggactagcagttgtcttcaaagcagaaagtcacaatcatccttcagccgtggagccttatgaaggagctgcgacaggagttggcggaatcatcagagatattttcagcatgggggctcgtccaattgcgttgctagattcattgaggttcggcgaattagataatccaagaacgaaatatttactagaagaagtagttgcaggtatcggcggatacggcaattgtatcggcataccgactgtaggcggcgaaattgcatttgatccttgttatgaaggaaacccattagtcaatgcaatgtgcgtaggtttgattgaacacaaacatatccagaaagggcaagccgctggcgtcggtaattcgatcatgtatgtaggtgcaaaaacaggtcgcgacggtatccacggagcaacttttgcctcagaagaatttaatcaagaagaagaacagcaacgttctgctgtacaagtaggcgatccttttatggaaaagctgctgcttgaagcgtgtttggaattaatcttgcatcattcggattctctaataggtatacaggatatgggagcagcaggacttgtttcatctagtgcggaaatggcttcaaaagctggttcaggacttatattgacattagatgaagtcccacaaagagaaactggaatgacgccttatgaaatgatgctatcggaatcacaagaacggatgttgatttgtgtcaaatcaggagaggaagaaaaaatccaagaactatttcagaagtatgatctagatgcagtcactatcgggaaagtaacagacgacgggcagtatcggctatatcatcaaggagaagaagtagcaaatctgccagtcgatgcattagctgaagatgcaccagtttatcataaagaaatgaaagaaccagctcgaatcgcagaatttcagcagttagctccttatcagccagttatcgaagaacctggacaagtattgcttgatctgctgcagcaaccgacgattgcttcgaaacgttcaatctatgaaacttatgattcacaagtacaaaccaatacagttgtccgtccaggaagcgacgctgctgtgatgagggttagagggacgaataaagcgttagctatgaccacagactgcaacgcgcgctatctgtatttggatccaaaaatcggaggacaaatagcagtggcagaagctgctagaaatattattgctagcggtggcaagcccttggcgatcaccgactgcctgaactatggttctcctgataaaccagaagttttttgggaattatcgacttcagctgatggaattgctgctgcgtgtgaaacgttaggaactcctgttatttcaggaaatgtctctttatataatgaaacggatggtcaagcaatctatccaacaccaatgattggtatggtcggattgattgaggatcataaacatatcactactcaggaattcaaaaaatcaggggatctaatctatatattaggtaagacgtttgcagattttgatggcagtgaattacaaaagatgcagcttggaagaatcgaaggtgtgatccgaaactttgatctatccattgaaaagagaaaccaagagttagtattgacagccatccaaaacggattgattgaaagtgctcatgactgttcagaaggtggcttggcaattgcactggcagaatcagctttcaaacatcagctagggatatctgtacagtttgaattgtcctctgctcaattatttgcagaaactcaatcaagatttgtgttgacagtcgcaccggaaaataagacacgattcgaagaaatgatgggtgattctgctattttagcaggaaaagtgacggaagaagcgatgatcgaaatttcagcaactgacggtcagatcaaaatagaaactgcaatagcaagaaagtgctgggaggatgcaatcgtatgtcttatgaagtgaagagtttaaatgaagaatgcgggatcttcggtgtttggggtcatccagacgccgctagtgtggcatacttcgggctccatagtcttcagcatcgaggacaagaaggtgcgggtatcgtgtccaatgatcgaggaaagcttaaggggcatcgagatttgggtctactttctgaggtattcaaagatcaaagaaaattgcagcagttaacaggaaaagctgcaatcggacatgtacgttatgcaacagcaggcaatggaagtgtggacaatattcagccttttctattcaaatttcatgatcagtcgatcggcttagcgcataatggtaacttgatcaatgctcgttcacttagaaaagagttagaagaaaatggagcgatcttccattctaactccgatacggagatattgatgcatttgatccgacgaagtgaagaaacagattttttaaataaattgaaaagtgctttaaatgaagtcaaaggtggctttgcctatttattaatgacagaaacggcaatgattgccgctttggacccaaatggttttcgtccattagcaattgggcaaatgaaaaacggagcatacgtgattgcctcggaaacttgtgcattagaagttatcggggcacgttttataagagatgtccagcctggagagatagtgatcatcaatgacgaaggaatccagattgattgctttacgaagaatacgcagctttccatttgttcgatggaatatatctattttgccagaccagattcaaacatcgcagggatcaatgtgcatactgcacggaaaaatatgggacggaatttagcgaaagaatcgccagtaaaagcagatatggtcgtcggcgtacctaattcttctttgtcagccgcaagcggttatgcggaagctagtggaatcccttatgaaatcggattagtaaaaaatcaatacattgcccgaacatttatccagccaacgcctgagctaagagagcaaggtgttcgaatgaaattatctgctgtacgaggagtggtggaaggtaaaaaggtgattatggtcgatgattcaattgttcggggtacgacaagcagacggatcgtccatcttttgaaagaagcaggagcaaaagaagtccatgtgaggattgcttctcctcctttgaaatatccatgtttttacgggattgatattcaaacgcgtaaagaactcattgcggcaaatcacacgattgatgaaatcaaagaatgtatcggtgcagattctttaggatttttaagtgaagagggtctgatcgaatcgattggactgaaaaaggatggcccgtattcaggattgtgtatggcttatttcaacggagattatccaacgccgttatatgactatgaagaaaagtatcaggaatcgctaaaagaaaaagtatcgttcttttaaaagcagaccaagaagggagtatatgaattcaatggcaaatgcatacgcaaaagctggcgtagatgtcgaagctggatatgaagtagtagaacggatcaagaagcatgtcaaaaaaacggaacgtttaggtatgatgggcgctataggaggattcggcggttgttttgatttatcggtctttcaattaaaagagccagtccttgtctcggggaccgacggtgtggggacaaaattagcagtggcaatcgaagcagacaaacacgatacaatcgggatcgactgcgtagcgatgtgtgtcaatgatatcttagcacaaggcgcagagccgttatatttcttagactacttagcaacggggaaaaatgatccgttacgtttggaaaatgtagtaaaaggtgtagcagatggatgtgttcaaggaaatatggcgctgattggcggagaaacagctgaaatgcctggtatgtactcaggtaatgattatgatctagccggatttgctgtagggatagctgaaaaatctcaattattgacaggagaaacgatcaacccaggagatgtgttgcttggaatagcatctagcgggattcattcaaatgggtactctcttgttcgcaaaattttctttgagcagcagcagttttctttatcatcaaaactgccagaattgaaaaaaacacttggcgaagaattgcttgagccaacgaaaatctatgtttcttccttgcttccgctgatcaaagaaaagaaaataaaaggagctgcacatatcactggtggagggtttgtagaaaatatcccgcgaatgttaccagaatctatggctgcacaaatcaaacttggctcatggccgattcttccaatattcggctgtttacaaaaatatggtgaaattcctgagatggagatgtatgaaatcttcaatatgggcatcggcatggtcctggcagtcgaagaatcgaaagtaaaagaaatagtacacgaaattgagcaagctggcgaaaaagtttatgaaatcgggaaagtgatcgccaaagaaaaacatcgtgtggtgtttacaggagaagaacgatgagaatcgctgtttttgcttctggaaacggaagcaactttcaagcgctagccgattatctatcgaaaaaaggattggaatcttcgattgactggttgttttgtgatcagcctgaagcatatgttttgaaacgtgcaactgcgttgagtgtaccggcagattgtttttcacctaaagaatttgattcaaaaaaagagtatgaagaagcaattttgcataaattgaaagaaaaaaagatcgatttgatcgtattagctggatatatgcgaatcattggaccggtattgctgaaaaattatgataaaagaatcatcaatatccatccgtctcttttacctgcattccctggtttgcatggcatacgtgatgcctttgaagctggagtaaaagaaacgggtgtcacaattcattatatcgaccaaggtgtagatactggaccaatcatccggcaggaaaaagtgagaattgaacaggaggacacgttcgattctttagaagaaaaaatccatagagtagagcatcgaatctatccagaagtgattagtgaaattattgaaaatggaggctatctgaaatgacaagagcattgatcagtgtatcagataaaactgggattgtagcatttgcccaaggtttgattgaacaaggagtagaaatcatttcaacaggaggaacaaagcatgcgttggataaagctgggatcaaaacgctttcgatcgaagaagtgacagggtttcctgaaatgatggatggccgtgtcaaaacacttcatcctaaaatccatggtggtcttttaggaagacgcgatctccctagccatatggaggcaatggaaacggaaaatatccaaccaatcgactttgtttgtgtcaatttatatcctttcaaagaaacgattatgaaaccagatgtcgaaatagcagaagctattgaaaacattgatatcggtggtcctagtatgctccgtagtgcagcaaaaaaccatgaatttgtcaccgctgttgttgatccatctgactatgaagaagtactttcagaattacgtcagtatgggcatacttcactttctttcagacaaaaactagcggcaaaagtctttcgtcatactgcggcatatgatgcactgatcgctcaatacttaacggattgggtggaagaaaaagaaccggaaaaattgacacttacgtatgaacgaaaacaaacgcttcgttacggtgaaaacagccatcaagccgctgccttttatcagtccgctcttctggaaaaatattcgatcgcagcagcaaaacaactccatgggaaagaactttcttataataatatccgagatgcggatgctgcgctacggatcatgaaggaatatgacgagccaacggtagtcgccttgaaacacatgaatccttgtggtattgggacagcatctacgattttagaagcgtgggaagcagcgtatgaagcagatcctgtttcaatctttggtgggatcatcgttttgaatcgagaagtagatctgccaacagcagaacagatgcataagctgtttctagaaatcatcattgccccttcttatacacaagaagctttggaattactgcaaaaaaagaaaaacatccgattactgacagtagactttgcgcaggaagaaaatcaaaatcgagaagaaatggtctcagtcttaggtggacttcttgtacaagatcaagatctggcaatagaaaatgaagaagagtggaaagtcgtgacaaaacgtaagccgactccagcagaagcaaaagcattggcgtttgcttggaaagctgtcaaacatgtgaaatctaatgcgatcgtgctggcaaatgaacatcagacagtaggaattggagccggacagatgaatcgagtcggttcagtaaaaattgcgattgaacaagcgcaagagaaaatggaaggtgcagttttagctagcgatgcttattttccaatggatgattcggttgaatatgcagccaaacatggtataaaatcaatcattcagccaggaggaagcatcaaagaccaagattctattgatatggcgaataaatacgatctagcaatggtctttactgatgttcggcattttagacattagagaggagtcggataaatgaacattttggtgatcggtgcaggtggtcgtgaacatgcaataagtaaaaaacttttagccagtccgaaggtggatacggtgtattgtgcgccaggaaatccggggatgacaaaagatggtatcaattgtgtcgctatcagtgagcgagatcattcagcgttaatccattttgttaagaaagaggctattgattggagtatcgttggtcctgaagttcctttgttaaatgggatcgtcgatgattttatggcggaaggattgaaaatcttcggtccgacaaaagcagcagctctgatcgaaggttcgaaaagttttgctaaacaattaatggatacttatcaaatcccgacagctaaatccagaagttttgaatgttacgataaagcagcggcgtatatcaaagaaaacggtgcgccaatcgtagtgaaagcagatggcttagcagctgggaaaggtgtagtcgtggctaccacagtgaaggaagcgctggatgcggcagaacaaatgttgaaccagcatcgatttggggatagcagcaaaaaaatcgtcgtagaagagtttttggcaggagaagaattctcccttttggcgtttgtccgtgataccaaggtgtatccgatggtcatttcgcaagatcataagcgggcatttgataacgataaagggccaaatacaggcggaatgggtgcttattcaccagtaccgcaaatttcaaaaaagatgattgaaaaagctgtggaagaagttttaaaaccagcggctttgggaatgaaagaactaggacgctctttcacgggtgttttatatgcgggtttgattgctacgaaggaaggaccaaaagtgatcgaattcaatgcgcgtttcggtgatcctgaaacgcaagtcgttctttctcggttgaagagtgactttgcgcaagtaatcgatgatttattagagaatcgtacagtagagttaaagtggcagcaagaaggatacaatgtaggcgttgtggttgcagctgccggttaccccgaagaatatgagacaggaatggttctaccagattttccggaagaagagctttctgtttactatgctggagtttcctcaaataacggcaaactagttggagcaggaggacgtctttatttagtagaagcatacggtgagacgatcaaagaagcacaggaaaaaatctacaccgcgttaatggataaaacgacagatggaacattttatcgtacagatattggagaaaaagctgccaatagcgaactggtcgtgaagtaaatcagctgcttccatttataaaaaatacaacaaacataatcggaagcgccgattttagtgaagccttttcataaagagtgtggtacacttttgttgtgtatataaataaggaggagttcagatgaaaaaaattcaattaggtacttctgatcagaaagcagctgcagtgatcttaggctgtatgcgtatcaacaatgcggaagatccagtaaaagtgattgagacagcttatgaaaacggcattgatttttttgaccatgcagatatttatggaaacggtgaatgtgaagaaatctttgcagatgctctagcaaaaacatcaatcaaacgagaagatctttttattcaaacaaaatgtggaatcgttccaggtgtgatgtttgatttttctaaaaaacatatcattgaatctgtagaaaaaagtttgacccgtctgaaaatggattatgtggatgctttacttcttcatcgtccagatacattggtagaaccagaggaagtagctgaagcgtttgatgaattggaacggtcaggaaaagttcgttattttggcgtcagcaatcaaaaaccaatgcaaatcgaattgctgaaaaaatatgttcgtcaaccattagtagctaatcagctgcaatttggcttgaaacatactggaatgatcgatcaagggattcatgtcaatatgacagatgaagcaagtatcgatcatgacggtagtgtacttgattattcccgattgcatgatatgacgatccaagcatggtcaccataccagtatggattttttgaaggtgtatttatcgggaacgaaaaattccctgaattaaaccaaacattagaagaactagcagctaaatatcaaacgacaccaactggcttggcttctgcttggattttgcgccatccagccaatatgcaagtgatcgccggtacgatgaacgtagggcgaatcaaggaaatcgctcaagcttcagaaattaatatgtctcgggaagattggtacgaattgtaccgtgctgctggaaacattttaccttaaagattgtcataagcaggtcaaaagggctataaattaaaaagacagaataacttgaaagctgttttcagcttcgagatattctgtcttttttaattgcaaatggaaagagtatcattgtacggatttcgtttattggttatttttgtttttaaggaaaagctgtgtccgatattcttttggagaaatcccttgttttttcttaaataaataactgaaatagttagggtcattataaccaatttcaaaagcaatatctgaaatacgatagtctgattgctgcaataatttttttgctaattcgattctttgttctgtcagataatcgatgaatgtttggttaaacgattgagaaaaaatcgtactgaaatgagagggacttaatgcaacttgttgagcgacccaagttaaggacatatctggatcggtaaaattttctttgataaaatccaatgcatggttcaaaattggctgatatttgttccttgaaggctgtgagggcagagcagttaagaaagaaatgaacatataaacagtcgaacggtaaagcgaatcgtcggcgctgattgctaagcgttgactggtggatgtgcaatgaaccatttcttgcgggattttcttttctttcaggcagacatgctggagtagcttagtcaagacaaataaacgatataatcgtgttcgagttggtgtgccttgtggtttcgtcaagtgttcgatgtacttagatacttcgtttttcgataatgaagacaaatcaagtgagaggtcaaagtaaaagacagaatcaactggaagtttcgcttcttgaatcaaatcctcatagctgataatttgttctttaagggaactggcggtttcaagtatcatctgcgtgatctcaaaagatgcaggtaattcgctgattctttctgcgacaggaccaatggcgacagaaaaattatttttttgtcccttttctaattcatggaccaacgtttgggctacctgataactggtctcgatcacattttcttcaagagaatcaactattaaaaatttgatgaatcgagaggaaacagcagagaagatcacttgttgattctccctaaataaaaacttcaaataatcactgagatgagcgtaatcttcaaagtctgtactgacttggtttgctgctaataatacggtcatttttttccctgctaaagagcgattgaaagattcagcaagtttcaatgtttcactgatcgtaagtgagcctttgaacaaaccgttcaagaaatgattttttttcaattcgaaaacaagatcagaagaagtgtgcgtttctttttgctgcaaatctaaagcagttactgctttttctattgcttgtttcaattcgttacttttaatcggtttaagcagataatcatctgcctgtacctggattgctcctttcatataatcgaaatcgtcgaatccactaataaatatgagacgagtccaaggaagtagtttccttgcttcttttgaaaaagtcaacccgtccatgaaaggcatttggatatcagtcagaatgatgtcgggctgtaagtcgataattgaagacagtgccatctcaccatctccagcttcgccgacataagtgattggataataagaaccaaggacagttatttgttcccgcaagttattgcgaatgaggtattcgtcttcgatgataaaaactttatacatgtttgtttcctccaattgttttgggagatagagggatcatcagtgtgacagttgttccttctcggtatttgctgtcaatcgtgataggtttttgatcatttccgtaataaagaaggagacgcttgtttacgttgtaaagtccgtagccgatactgaaatctgaatcgatacctttggctaactctttacgtatttctgccagtttttctgcagggatgccaatcccgttgtctgtgactttgaattggatcatctcatcgattttgcatgcggtaatacgaataaatcctttgtgacggacgtacttcgttccatggtatacagcattttcaatcaatggctgcaagatcatttttaaaatagaaacaggaaaaagtgtttctggtatatcgatcttatagtcaagcatacggccgtatcttatttttaagatgactagataatcattgatatggctaatttctttttcaagaggaatccagtcttgtcctttgcttaaagacgtacgaaaaaagccggaaagtgcatgggtcatagtcagagcttcttcaaagcagtcttgttcgatcaaagaaataatggcatccaaactgttataaataaaatggggagtaatctgagcttgcaatacacgaacttcactttgtgctaaatggtattgtttcaaagcgttctcccgtaaagactggtttagatcttccgccattttattcatgctagcggtaagtgtttgtaattccagtgtttccggcagggttaaacgaaagccaaggttccctgaagaaagttgttctgacatctcgatcagctgattgatcggttcttggacctttctctctaaaaagcgacgattctttttcgcatagaaaaaaatggtactaagaactccaagttccactattgttaatagaatgagcaagcggacaagtgtcgtattttttttgcttgctaagtcgatctccacacgaacaaaatcttgtaagatatctgacagcagttgagtgacagaatctacctgattgatgatctcttcattggtatccataaaatcttttgccaagatattattgatcagctcgttttgataatcttccagtgtatcgatcgtacgcaaagacacatctaacgtactgatttctttaagcgtattcgtattacttttgatctgtcgaatatcatttctaagttcttctaggatattttcttttttaaactcatccacgcttacttggccagaaatcaagtcccacatactttccaaaactctctggtcaacctttaaagcaattgcatccgctttttgaatatttgcgatcgtctgttgataaatcaaaagctgttgtgagtataacagtatgctaagtaataaagggataacagcaaatagaagcatggctttgtttgcttgggcaaaaatctgtttaatgcttaaacttttcgtcatgatacttctccagtcaataatttctggttggaatattagtcatattctgttgggaaaagacagtctcggaaataaaaatatctttaggtaatgtttttcctgtttgaagatttccaaaataacgagtaacggtattggctacataccagccgacatcaggtttacactcgactacgcaattgacgattcctgaccgcagcttctcgatcatatcttcttgtccatcaatcgttacaataatcaaatcttttccaggtttaaccgatgtttcttttatcgcagctaaagcaccgtgggtcatttcatcactatggctgtataatacatcgatttcggataaatcatttgtttctaaatatcgtttcatctggtcttttcctttcatccgaataaaatcaccgacaattcggtgaacaatagtcatcggaggtttatggtcgatggttccatctttttttagggttggtttacgattgattgattccaaaaatccttcggagcgtagcttggtcggtgtggagttctctgaaccagcaagttctaggattctgatttcctgtttctttgaatttgtgaagtgattgctgacaaataaacccgcccgatttccttctgctttgaaactggggccgatgtgggtgacgaaaagctcgggatcattcgtttgaatatgtctgtcgacaagtatgacagggatccctgctcgctttgcttcttttaatacagagtcccacccggattcttgcaaaggagtaaaaatgatcatatccactttataggcaatgaacgtccgtatatcttggatttgccgttcctgattcatgtagccatttcggtagagaacttggtaatcttctttttcaagcgcagtgataattgattcagtatgctttttccgccagctactctccgttcctgattgcgaaaaaccaacgactagtgggtcaggtgcttcctttgtattaggtgtacaccccatcatttggtaagcgattacaacaagggctaaaaaaaataaaacacgtttcactttaaatcactccatctggatttgttagtactatcttatcagataaaagggaaaatcaaagtcaaaaggaatcaatcgaaaaaaatccaagaaacttaaaaaaatccaagacaaaaaaagtacacctaaaaaatttaaagtaaatcccataaaaaaatcaatgttaacgctttctttattagctatactcggtgtatcaattgaaatgggggataaaaaatgaaaaacaaatttagaaagattgttgggagtatcgctattttgaccgcaagcattctattaagtgcgtgtggcaattcaggatctgcagatgatagtacggggtatgtaggaatcgctatgccgaccaaatcagcagaaagatggatcgctgatgggaacaacatggtctcggaattagaaaaactgggttataaaacagatcttcaatatggagaagataaagtagaaaatcaagtagcacaaatcgaaaatatgattacaaaaggggtagatacacttgtgattgcttctatcgatggttcggctttaactgatgtgttagctaaagcaaaagaagcagatatcaaggtgatcgcctatgatcgtttactgataaattcagaaaatgtcgattattacgcgacttttgataattttggagtaggtgtatcgcaagcagcttatattgaagagcacttaggattgaaagaaggaaaaggaccattcacgattgaattatttggtggctcgcctgacgacaacaatgcactaattaattacaacggagtgatgtctgttttacaaccatatatggacaacggtcagttggttgtgccatctggacagacgagtttcagtcaaatcgctacgcttcgctgggatggttctacggcgcaagcaaggatggataatctgttaagcgcaaattatactgaccaaacattggatgctgttttgtcgccatatgatccaataagtttagggatcatttcgtcattaaaaggcgtggggtatgggagtgaaagtaaacctttacctgtgattactggacaagatgcgacagttgctggcgttaaatcgatcattgccggggaacaaacacaaacgatctttaaagacacacgtatcttagcaaaaaatacgattgaaatgatcaaagcaatcagtgatggagaagaggtcccggtcaacgatactgaaacttatgataatggggtgaaaactgtccctacgtatttagcaaatacagtatctgtcgataaagataattatcaagcagagctgatcgacaccgattattataaagaatccgatctgaaaaattaagaggaaccaaacaaggaactaaagagatctaagtcagagagaggataagaattatggcggattgtattttaaaaatggcagatatcaccaaaaaattttctggaatccgagcgttagattgcgtgaatctgatgattgaacgtggggaaatccatgcattgtgcggagaaaacggagcgggaaaatcaacattgatgaatgtcttgagcggcttgtatccatatggctcctatgacggggaaatcttttatgatggaaagctgtgtcaatttaaagatttgaaagatagtgaagaaaaaggcatcgtcatcattcatcaagaattagcactaagtccttatctttcaataaaagagaatatttttctcggaaatgaacaagcagaaagaggcgtgattgattgggaactgacagaaaagaaaacgtatgaactgctgaataaagtcggtttgtctatcgacccgaatcttctagtatcccagattggcgtagggcaacagcaattagttgaaatagctaaagcattatcaaaatccgtccgtctgttgattttggatgagcctaccgctgcattgaatgaagaagaaagcgcgaatttgctgagattgatccgagagttgaaagagcaaggtgtaacctccatcattatttcacataagctgaatgaaatcgtggatatcgcagatcgaatcaccattttacgggatggacagacgattgagacactagaaaatgaaatgatcagcgaagagcatattattcgcgggatggtgggcagagatttagttgatcgttatcctgaaagaaaaccggatattggagaagtttattttaaagtagaagactggacggtctatcaccctcttgatcatgagcgaatcataaatgaccacatcaacttgcatttgaaaaaaggagagattgtaggaatagctggactgatgggagcgggcagaactgaattcgctatgagtctatttggacattcttatggaagcaagatatccggacgtatattaaaggaaggggcagagatatcagttaagaccgttccttcagccattgcaaacggactcgcttatgtctcggaggaccgaaaatctttaggactgaatctgctgatggatattcgggaaaacgtgacgctgagcagtttggataaaataagtcaaaaaggagtattagataaagaaaaagaagtaactgaggcagaaaatttccggaaaaagatgcgtataaaaacaaactccatccatcaaattgtcagtagtcttagtggtgggaatcagcaaaaagtcgttttatccaagtggctgatgacacaacccgatattctttttttggatgagccaacccgtgggatagatgttggggcaaaatatgagatctacacgattatcgaagaaatggcagcaaatggcaaagctgtctgtcttatctcttctgaacttcctgaaatattagggatgtgtgatcgaatctatacgatgaacgaaggacgtattacaggagaagtctcgcgagaagatgcagatcaggaagtcttgatgaaattaatgacgaaagaagaggtgggttaagttggaacaggcaaaaaatcttacggataaaaaagagaaaaaactaaatttgaaaagtagagcagctgatctttttggtcgctacagcatggtgatcattttagcgggactacttattgcgtttcaattgatgacggatggtattttctggcgtccattgaatataactaaccttgttctgcaaaatagccatatattagtactagctgcagggatgttattagttgtgctcttaggtcatgtggatttgtcggtagggtcagtgatggcgtttgttggtgcaattgcgggcatgatgatggtcaatcgccaaatgaacccgtggatgacagttatcgcatgtcttgcagtaggcgggctgatcggcgcatggcaaggtttttgggtagcttatgcagggataccggcgtttatcgtgactttagcaggattgctgatgtttcgtggactcacacaagttgttctaggaggccaatctctagcaccttttccagctgttttccaaaaaatgtctacgggttatttaccagacttaagcgaaggaagcagccttcacttcttgacattgattttaggaatgatcatcacgatcgtgttagttgttggtcaatggcgaacaagaaatcgtcggaaaaatcatttatttgaagtggaatctccagcagctttcttggtaaaggcggtatttacagcagtcgttgtactaggaataacttatatctttgcctcttatcaagggtatccgattattttgatcattcttggtttgatcgttgcagcatatgggtttttgacaaataaaacagtagcaggtcgacagatttatgcgacgggcggaaatcgaaaagcggctgaactatcagggatcaaaacaaagcgaatcacgttctgggtattcgtcaacatgggagtcatggcagctttagctggattagttttagctgctcgattgaatgcggcaacacctcaagcaggtacatcgatggaactggatgcaatggcggcagtatattttggtggtgcttcgacttccggcggcattggaacaatcatgggtgcgattgtcggtggcttggtcatgggtgtattgaacaatggcatgtcgattttaggcgtcggggtagactggcagcaggcaatcaaaggattgatcttgcttttagccgttgtgttagacttgtataataagaaaaaacgaacaacgtaggagaacgccggttattcagaaaaaagactgtgacaagacatttgtcacagtcttttttttgctaaaagcgaacattcattgtttcgtttgtatagactaaaaataatatatgtttttttaccattcgtataaattctctttttgctcttgatttttttgcttaattgagttaaattacatagggcgctaaaaaaagccttgattaaattaataatgttcgtgttttgctggatgtgaacatcaggaggataatgtaatgaaagtatttgattacgaagatattcaattaattcctaataaatgtatcgtaaatagccgttctgaatgtgatacaacggtcacattaggtaaacatacattcaaaatgccagtagtgcctgccaacatgcagacgattattgatgaaacaatcgcagaattcttagcggaaaatggttatttctatatcatgcatcggtttgatgaagcagctcgaattccgtttatcaaaaaaatgaaaaagcgtggattgattacctcaatcagtgttggcgtcaagaaagaggaatattcctttatagagaagttggcagaagaatcgctaaatcctgattatatcactatcgacatcgcacatggacatgctaactcagttattgatatgattcagcatattaaaaaatatttgcctgaaacttttgtgattgccggtaatgttggtacaccggaagccgtccgtgaattggaaaatgcgggcgcagatgcaacaaaagtagggattggtccaggaaaagtatgtattacaaaaatcaagacaggctttgggactggaggctggcaactggcagctcttagatggtgtgcgaaagcagctcgcaagccgatcatcgctgacggtgggatcagaacacatggcgatattgcaaaatctgtccgttttggtgcgacaatggtcatgattggttcattgtttgccggtcacgaggaatctcctggcgaaacaaaagtcgaaaatggaatcgtgtataaagaatactttggttctgcttcagaattccaaaaaggcgaaaaacgaaatgttgaaggaaagaaaatctggatccagcataaaggatctttgaaagatacactagtggaaatgcaacaagaccttcaatcatctatttcttatgctggaggaagagatctggaagccattcgaaaagttgactatgtcatcgtgaaaaattcgatttttaatggagacacaatctaaaaaataaataaaatattaggatgttgtgaaaaagttgtcctgcattaagtaataagaacagccaaacaaaaatagttctttatatgttttgtttggctggacttattatcgcagatacaagcttttgaacatcattattcagaataagggactgtgataagacttttgtcacagtcccttatgttttgcaaaaaaagtttttcttttttctcgtaaattcggtaaaatcaaaagaaaaaatagacaatagaaaagagaagcttatgtgggaaaaagtagagaaaaaacaaggaccgatttatcgtcaaatcatggaacagattatgagagaaatcgaaaacggaaggatcaatcctggaagtcaacttgaatcagaacgaaaactagggcaactttttggtgtgaatcgttccaccgttgtccatgcattggaagagcttagggagcttggggtactaacgagcaaacgtggcagcggatggtttgttaatcagactgaatgggggaaattcgctgttccaagaatcgattggcggcaaatgatctctcctcgttatgagcagatggactggtatgagcaaaaaataagagaagcaaagcagatccaaaaaacatcgtttcttgatttatacgctagcgagatgccagatgagcttttgccgaattttgagtttccttcttattctcttgaagaaatcttagcggaagaaaaagaaatggatcttttaggctatactccgttacgtaacaaaatcaaacggtatttggaaagtaaatttgaattggcattttcccccaaccagcttcttgtgactggtggcggtcagcaagcaatctttttgattttacaaacgattctttcagctggagaggggatagctgtagagtcaccttcttttttttaccgattacctcttttcaaagcttcaggaacgcgtttatttgggataccgatggatgaagaagggatcgacttagaaaaactgaaagaatcgatccataaaaataaattgaaagcagtgcttatcaacccgaattttcaaaaccctacaggaaaagtgatgagtcaaaaacgacgagaaaagctagtagaattgtgtcgacagtatcggcttccaattattgaagacgatgtatttacggatctttcatttctaaatcaagaagaagtccttcctatacgaacgattgatccggataatgtgttatacgtcggttcgttatctagggttttaggaaaaacaacgaaaatcggttgggtgataggacctgagacttttatctcgcaactagctcaagcgcaagaaatgatggagttttcgatgaatatccttacacaaatcacagtggctaatgtatttaatgaagcaattgatttgaaaatgcaagatgtaagaaaaaagttgaaagaaaaaagccgactgataagcgcttggggagattcacaatcgtttttcaagcttcattcaattttaggtggttactatgcctggattacttgggatgggaaaaaactagaccccgaactagcagaaaaagtagtagatatgggtcttggaattgcaccaagtctactttttgggcaagatataaatggaatcagaatcaattacagtaggctggatgaaaaccaaataccgttgttttattcaaagatgaaaattctagaaaagtggttaacagaataatttcacaaagtaaatagattaaagaatataacagcttggatttaaatttcaagctgtttcttttttttcggaaaaagaatacgatataaagaaactaagaaaaaaccattatttgtacgtccgttcacgatgtgtaaataaaataaatatttgcaacaaaactgtataacaccaacgtttctaaatagaaacagatggttgtaagtttgattagaaaatagaaaaaatgcagatgaaatataaaacgctttccttattgtgattttattcactaatgctgttaatatgcggattggcataatttcctttcatcgtgaaaatttgtgcttttagcttgtatttctcataaatccatgataatttattaatgaagacggttaaatagtgatacagttttattcactgtttcaatcgcagaatgaagagattttcttatagatgagagaggaatgtgtgacaaatggcaaacaaaaaagcaccgatcgacttccaagcactgctagatgaagtcaatgcagatttccaagtatatcaagcacttgatcaagatggaaacgtagttaacaaagatttagtacctgatttatccgatgatgaactcgttgaattaatgactcatatggtatggtctcgtgtattagaccaacgttcaacagcgctgaaccgccaaggacgcctaggcttttttgcaccaactgctggacaagaggcaagtcagctggctagtgcttacgcatttgataaagaagatgttcttcttccaggttatcgggatgtacctcaactagtaaaacatggtttacctttatctcaagcttttttatggtctagaggacatgctgcaggtaattcttatccggaagaattgaaagctctaccaccacaaatcatcatcggtgcacaatatgtacaagcagccggtgttgcattaggtttgaagaaacgaaacaagaaaaatgtcgtcttcacttatactggtgatggcggttcatcacaaggtgatttttacgaagcaatcaatttcgctggcgcttaccatgcaaatgccgtattttatatccaaaacaacgggtatgcgatctctacacctcgtgaaaaacaaactgcagcaaaaacacttgcacaaaaagctgtcgcagctgggattcctggtattcaagtcgatggaatggatccgcttgcagtatatactgtatctaaaatggcacgggaatgggcgatcagtggaaatggaccagtcctaatcgaaacactgacttatcgttatggaccacatacactatctggtgacgatccaacccgctaccgtacaaaagacacagatgacgattggcagaaaaaagatccattgatccgcttccgtaaatatttgacggaaaaaggactttggtctgaagaaaaagaagaacaagtcatcgaagcaactaaagaagaaatcaaagcagctattgctgaagccgacaaagtaccaaaacaaaaggtttcagatttcttgaaaaacatgttcgaagtatctccacaatcaatcaaagaacaaattgcaatttatgaagcgaaggagtcgaaataatcatggcacaaaaaacaatgatccaagcaatcacagatgccttagcacttgaactagaaaatgacgagaatgtcgttgtttttggtgaagatgttgggaaaaacggaggagttttccgggcaactgaaggattgcaggaaaagttcggagaagaccgagtattcgatactcctttagctgaatctggaatcgcaggattgagtttcggtcttgcgttagaaggatttcgtccagttcctgaaatccaattctttggttttattttcgaagcaatggacgaagtagtagctcaaatggctcgtacaagatatcgaatgagcggcactagaaatctacccatcacaattcgttcgccatttggtggcggtgttcatacaccagaattgcattcggataatttagaaggtttgatcgctcagtctcctggtattcgagtagtgattccttccaacccttatgatgcaaaaggactattgatttcttctattagaagtaacgatccggttgttttcctagaacacatgaaactatatcgctcattccgagaagaagtgccggatgaagcttacgaagttcctttggataaagcagcagttactcgtgagggaacagatgtatctattatcacatacggagcaatggtgcgtgaagcaatcaaagcagcagacaatcttgcaaaagaaaatatatctgttgaaatcattgatcttcgtacagttgcgccattagatgtagaaacgatcattcaatccgtggaaaaaactggtcgcgtagttgttgtccaagaagcacaacgacaagcgggcgttgccgcgcaagtagtttctgagatctcagaacgcgctatcctttcattagaagccccaatcggacgagtttctgcacctgatacagtcttcccatttggacaagcagaaaatgtctggttgccaaatgcaaaagatatcgaagacaaagtaaaagaaatcgcggaattttaagaaaagaagggacgaaacaaagtcatggcttatcaatttaaattgccggatatcggtgaaggaatcgcagaaggtgaaatcgtcaaatggttcgtcaaaccaggagatacgatcaatgaagatgatacattactagaagttcaaaatgacaaatcagtagaagaaatcccgtcacctgttacaggaacggttaaaaatgtgattgttccagaaggtaccgtagcaaatgttggggatgtattagtagaaatcgatgcaccaggacacgaagacaatgaaggggacagtggtgtagccgcagaatcccaaactccagctaaaccggctgctgaacccactgttgatacagaaccagctggatcgtcaagcgaaggagtcttccaatttaagttaccggatatcggtgaaggaatcgcagaaggtgaaatcgtcaaatggttcgtcaaaccaggagatacgatcaatgaagatgatacattactagaagttcaaaatgacaaatcagtagaagaaatcccgtcacctgttacaggaacggttaaaaatgtgattgttccagaaggtaccgtagcaaatgttggggatgtattagtagaaatcgatgcacctggacacaatagtgcaccgtcaactagtgcgccatcagctgaagcaccaaaagaaaaagtggaaacatcaggttcagcaagtgtcgttgaagctgccgatccaaataaacgtgtattggctatgccatctgttcgtcaatttgcccgcgaaaaagatgtagatatctcacaagtaactgcaactggaaagggtggcagagtaacaaaagaggacatcgaaaacttcttggcaggagctccaagcagcgcaccagcgaaatcagaagcgccagaagcggcaactccgaaagaagcagctcctgcagcagaaagcaaacccgctgaaccagcaaaaccattcaagtccaacttaggagatttggaagagcgtgtagcaatgacaccaacacgtaaagctattgctaaagcaatggtcaatagtaagcatacagctccacacgtgacattgcatgatgaagtagaagtgtctaaactatgggataatcggaaacgattcaaagaagtagctgctgcaaatggtacgaaacttactttcttgccatatgtcgtgaaagctttaacagcgactgttaagaaatacccagtattaaatgcatctattgacgatgcaaaccaagaaatcgtttataaacattactacaatatcggtattgcaacagatacggatcacggattatatgtaccaaatgtaaaagatgcagaccgcaaaggaatgtttgctattgcagacgaaatcaatgagaaagcaaaattagctcatgacggcaaactatctgcagaagatatgcgcaatggaacaattacgatcagcaatatcggatctgtaggtggcggttggtttacaccagtcatcaactatccagaagtagctattttaggtgtaggaacgattgcgcaacaaccaatcgtaaacgctgaaggcgaaatcgttgtcggtcgtgtgatgaaactatcactaagttttgatcaccgtatcgtagatggagcaactgcgcaacaagcaatgaacaatatcaaacgtcttttagctgatccagagctattaatgatggaaggatgataaacaaatggtagttggagattttgctgtagaattagatacagttgtaatcggtgcgggacctggcggctatgtagctgccatccgtgctgctgaaatgggacaaaaagtagcaatcattgaaagagagtatattggcggtgtttgtttgaacgtcggctgtattccttcaaaagcattgatagctgcgggacaccattatcaagagtcactagattccgaaatgtttggagtaactagcgaaaatgtcaaactagattttgcgaaaacacaagaatggaaagaaaacaaagttgtccatacgttgacttctggtgttggttttctattaaaaaaacataaggttgaaacaatcgaaggcgaagcgttcttcgtagatgatcacacactacgcgtcattcatccagattcagctcaaacttattcgttcaataacgcaatcatcgcaacaggttcccgtccaatcgagattccaggatttaaattcggcggacgtgtgttagattctactggcggattagcattgaaagaagtacctaagaaatttgtgatcatcggtggcggtgtgattggtgccgaattgggcggagcgtacgcaaacttaggagcagaagtaacgattcttgaaggctcaccacaaattttaccaacttacgaaaaagatctcgtaaaattagtagaagatgatttcaagaaaaaaggtgtaacagtcgtaacgaatgcgatggcaaaagaagcagtcgataacggtgacagtgtgacagtgaaatatgcagtggacgggaaagaagaatctgttactgctgactatgtgatggtcactgtaggacgtcgtccaaatacggatgatatgggcttagaacaagcgggtgtcgaagtaggagaacgtggattgatcacagtagataaacaaggacgtacgaacgtacctaatatctatgccatcggtgatatcgttccaggggcggcattagcgcataaagctagttacgaagcaaaaatcgctgctgaagcaatctctggcaaaaaagtagctgtagattataaagcaatgccagcagttgcctttactgatccggaattggcttctgtaggtatgacaatcaaagaagcaaaagacgcaggtatcgaagcgaaagcatataaatttccattctcagggaacggtcgagcattatcgctaggtaaaacggaaggattcatccgtttagtcacgacgatcgaagataacgtgcttattggcgcgcaaatcggtggagtcggcgcaagtgatatggtctctgaattagctttagcaatcgaatcaggaatgaatgctgaagatatcgccttgacgattcatcctcatccatctcttggcgaaatcgtcatggatgcttcggaattagcattaggtttaccaatccatatttgatttgaataatacaggcgaaacgcaactgaaaaatcagttgcgttttgttttttagaattatcaataatattattatgtaaacttaaaaatatgacaacttcttggtttattaccacttcctatgctacactgaagaggaatatgaaataggagagttgaagatgcaagaatatcagtatccacttgatttagattggacaacagacgaaatggtcattgtaatgaagatgtgggaagatctggaacgtgcgaatgaaaaagggataaacaatgaagcttttttgaagacttatcagcagtttaaaactgttgtcaaatccattggtgaggaaaaacgattgggacgggaatttgaaaaagcttccggttattctttatatcgtacagtgcagcaagcaaaaaaaaatccaaacaaaactttgagaatgaacgggtgagataaatggaacagatgattgatcatatcaagtcctggcttgaagaagctggtgagaaaatcaaatcttctcaacaaacattaacaatctcgcaaaaatcaaatcgaacggatctagtaacaaatgtcgatcgaaacatccagaattttctaatcgaaaaaatccattcctttgatccagaggcgaaaatattggcagaagaagaagggtgtaatcaattatcggatctcgatggaagagtctttatcatcgatcctattgatggcaccttgaattttgtgattgaaggggaaaatttttgtattatgctcgctgtttatgaatccggcgttggaaagcttggtttcatttatgacgtgatgagaaatgaacttttttggggcggaaaaggaataggcgtgtataaaaatgatgagccattgcctagaccagcaaataaatccttatcggaaggcttacttggtgtgaatagttatcttttcggtcataataaatatggaatccgagaaattgcggaaagcagcatggggacacgtatgtacggatgcgctggtcttgaactagtggcaatcttgaaaggaaaccacattgcttatatttcaaaccttagcccttgggattatgcagcgggaaatgtcttattggaagagtttggtatggtaacaagcggtctttttggtactcctttgacatttgaaaaaagggaatactatttagcaggaacttcttgtgcatatgcagaaatcgcagaccttttgaaaaaagaaggctgaaaaaaaggtagaaatcattcacaaaaatgataaaaacgggcaaaagattaattttctcgaaaaaatgaaaacattttactatatttcatgaaaaaagtctgctataattagcagtcgagtaaaatttgccctgtcataaagaaccaataaaaaaggagttagttacattgaattatagaaacgatatccgtaacgtcgcaattattgcccacgttgaccacggaaaaacaacattagttgatgaactattaaaacaatcagatacattagacgcacatacgcaattgcaagaacgtgcgatggactcaaatgcgctagaaaaagaacgtggtatcacgattttagccaaaaacacagctgtagactataaaggaattcgcgtaaacatcatggatactccaggacacgcggacttcggtggcgaagtagaacggatcatgaaaatggttgacggcgttgtgttggtcgtagatgcgtatgaaggaacaatgcctcaaacacgttttgtattgaaaaaagcactggaacaacatatcacaccaatcgttgtcgtaaacaagattgacaaaccttctgctcgtcctgagcatgtcgtagatgaagttcttgaactattcatcgaattaggagcagatgatgatcagttagactttcctgtgatttatgcatctgcactaaatggtacgtcaagcttgtcagatgatccagcagatcaagaaccaaccatggcacctatttttgatacaattattgaaaaaatccctgctcctgtcgataacagcgacgaaccattacaattccaagtttcattacttgactacaacgattatgtaggtcgtatcggaatcggacgtgtatttagaggaacaatcaaagtaggagaccaagtagcattaattaaattagacggaacagttaagaaattccgtgtaacgaaattatttggtttctttggactaaaacgtctagagattcaagaagcaaaagctggagacttgattgctgtctcaggtatggaagatatctttgtcggtgaaacagttactcctgtggatcatcaagatgcgttacctatccttcacattgacgaaccaacattgcaaatgactttcttagttaataattcaccatttgccggtcgagaaggtaaattcgtaaccgctcgtaagattgaagaacgtttgatggcagaacttcaaacagatgtatctttacgagttgaaccaacaaactctccagatgcatggacagtttctggtcgtggagaattgcatttgtctatcttgattgaaaacatgcgccgtgagggatacgaattgcaagtatctcgtccagaagttattgaaaaagaaatcgacggtgtaaaatgcgaaccgtttgaacgcgtgcaaatcgatacaccagaagaatatatgggtagtgttatcgagtccttgagcttacgtaaaggtgaaatgcaagatatggtccatacaggaaacggacaaatccgtttgacattcttaacacctgcccgcggtttgattggttattcaactgaattcctttcaatgacacgtggttacggaatcatgaaccatacttttgaccaatatctgccaatgcttcctggtcaaattggcggacgtcaccaaggggcgcttgtttcgatcgatacaggaaaagcaacgacttattctatcatgagtatcgaagaacgcggtacagtcttcgtagaaccaggtacagaagtatatgaaggaatgattatcggggaaaacagccgtgataatgatttgactgtcaacatcacgaaagcaaaacaaatgacaaacgtacggtctgctactaaagaccaaacatctgtcatcaaaaaaccaaaacaattgacgttggaagaatctttggaattcttgaatgatgatgaatattgcgaagtaacaccagaaagcattcgcttgagaaaacaaattttagagaaaaatgctcgtgaaaaagcatctaaaaagaaaaaataatctgtaaaaggatgaagagagaaaccagcttgttataaaaaatagctggtttctttttttgtccaactcttttctgtggagaagtcatctttgtcaatggacataaattcagaaaatacgccaaaagacgtttaaaagacttttaaaaaacttatttctagagagtttttgtttcataataagataatgtttcacgaaaggagatcaacttgtccttcgaagaaaatcgaagtaaaatggcaagagaaaggagcgggaagatgaacgacttattaaaacaatactttggctatgatgagtttagacctggtcaaaaagaaattatccagaaagtcattgatcaggaaaatgtattaggaatcatgcctaccggaagtgggaaatcaatctgttaccagcttccagctttactattagatgggcttactgtggttgtgtcccctttaatctctttgatgaaggatcaggtggacgcggcgaatcaattaggtatacccgccacttttatcaatagctcgttagatggttacgaaacagctagacgcttccaagaaatcgatagacagcagtaccgtttactttatatcgctcctgaacgttttatcataccagattttatccaagcaatgaagcgatggaacgtccgtatgatcgctattgacgaggcacattgtatctctcagtgggggcatgatttccgcccaagttatttacagatggcgaaccagctagatcaactgccaaatcgtcctgtaattgttgctttgacagctacagcgactatgcaagtagctgctgacataaaaagacttttaaaaattccagaaaacaaccatattcagactggttttgaacgagaaaatctacgatttcaagtaattaaagatcaaaaaaaagaacaatatctaatcgaatatttaaagatcaacaaaaatcaatctggtatcatttatgcagcaacgagaaaagaagtagaccgtctctatcatttgcttaaaaaattcgatttttccgtgggtagatatcatggtggtctaaatgagaatgagcgaacagaaatgcaagaagcctttttatacgatcgcttgcagctgattgtagcgacaaatgcatttggtatgggtataaataaaagcaatgtccgttttgttatccattatcaaattcctggctctctagaagcatactatcaggaagctggtcgggcgggaagagatggtctttccagtgaagccatcctgcttttctctcctcaagatatccaagtccaaaagttttttatccagcagtcccaaagagaagaagggcaaaagcaaaaagaatatgaaaaattaaaagcgatgacagaatacgtatatattgagtcctgtcttcagcaatacatcctaaactattttggcgagacaagcagtccgtgcaaccgttgtggtaactgtttagatgacagagaaatagtagaagtaacgacagaagcacagatggttctttcttgcttaaaacgtatgggtgagaactatggtaaacaaatgctgatgaaagtcttagcaggatcgaaagaacaaaagctgcaagctttaggttttggacatttatctacctatggactgatgaaaaaccaatcgcaaaaagaaacgatgcagttaattgaatatttgatatcgaatggctatcttctgaccatcaatggtgagtatcctgttttgaaagtaacagaaagagggatacaagtattgaaaggacaagaatctgtttatcgaaaggaacccaagaaagtccagcagctatcggatgaagaaaccgatacactatttgaagtgctgcgggaactgcgaacggatctagcatcagaagcaggcgttcccccgtatgtcgtattttcagattccacattgaaagaaatgagccgaatacgtccatcaagcagattggagatgcttcagataaaaggagttggccaaagcaagcttgataaatatggcgaagcctttttatctcggataaaaaatgcggactctaacgttctggataagtagaaagaacgaatacgtaaaaatgaataaaaacaactggttaaatctgttttttttgctccttatgaaaatcaaatatgttataattaaggaattagaatgggaggtaagcacagatggattctttgtcgaaaaaacttgcgatccaagtattaaatgatgaagcagaacggatcaaacgattaatccgaaatcaaaacaacagtctctgtatctcacaatgcaaagccttcgaagaagtggtagatacacagatgtacggcttttcccggcaagtcggttttgctgtccgtataggagtaatcggaaagaacgagggccagctgatgttaagtgagctagaacgagaattgaatcagttatatagtgaggtttaccaagaaaattatgataaaaaagaagttggcaaggaggaatagacttgcctaagaaagtgaaaaaaaggcatctattagactatagcatcttgattccctatttaattttatgtgtattgggattgatcatggtatatagttctacgtcgtatctattattagaaaacggacaaaatccgtccgcatcagtcattaaccagagtattttttgggtgcttagcttgattgctatcgcactactttataaaatgaaaacagatgttttgaaaaaccagcgtttgatcatggcagccatcgcagttttgacgattttgctgctgattgttgtgttttttggtaaggaaatcaatggggcgaaaggttggctgcaaattgcaggattctcgatccaacctgccgaatacctaaaaatcatttctatctggtacctgtctctgactttatctaaaagacaaaacagtgtacaaaaagattttcttgggactgtgaaacgtccacttgcaatggttatcggacttactgcattagtcgctattcttcccgattttggtaatgcggcagttatctttttgattattttggttctgcttttagccagcggagtcaattatgtgtatactttgattgtaggagtaggaggcttttgtctaagtacttttacgatctggctgatcaatatcacaaacggaaagatcttacctggacgtttacagtatatctataatcgatttgctatttaccaaaatcctttctcagacgaattaaataaagggcatcaactagtcaacggctactatgccatgttcaacggaggactatttggcaggggattaggtaacagtatccagaaaaaaggatttttacaagaagcacaaaccgattttatttatgcaatcgtagtggaagaactgggagtgattatggggattttgatattagcgttgctattctttatgattgtgcgcattgtccttgtaggtatccgttcaaaagatccgttcaattcgcttttgtgcattgggatcggcgcaatgtttttgatccaagtatttgtcaatcttggaggaattactggtgttattcctttgacagggatcacgttcccatttttaagtcaaggaggctccagtttgctgatgctttcgatttgtgtcggctttgtcctcaacatcagtgcggatgaaaaacgcaagagcttaggtttataataaaaaaagatgtaggagtggttcgatgaaaaaagttttagttgctaacaggggtgaaatcgctgtacgtgtatttcgtgcttgtacagaattaggaattaaaactgttggaatctatgcagaagaagatgaatattccgtacaccgtttcaaagcggatgaagcatatttagtaggacaaggaaaaaaaccgattgatgcgtatctagatattgaagggatcatttctatcgcgaaagaatgcggagctgacgctattcatccgggttacggtcttttgtcggaaaacttgaattttgcgcaacggtgcgaagaagaaggcatcatttttgttggacccaaactgcatcatttagatatttttggagataaaatcaaagcaaaagctgcagctatcgaagcggggattgcttcgattccaggcacagatggaccaatcgcttctatagacgatgccttggagtttgcgaaacaatacggttatccgattatgatcaaggcagctctaggcggcggcggacgcggcatgcgtgtagctcacgatgaaaagagtgcaagagagggctacgaacgtgcgaaaagcgaagcaaaagcagcctttggtagtgatgaagtgtatgttgaaaaatacatcgctaatcctaagcatatcgaagtacagattctcggggatacgcatggaaacgtcatccatctttttgaaagagattgttctgttcagcgccgtcaccaaaaagtagtagaagtagcgccttgtgtctctatgaatgaacagcaacgtcaaaaaatctgccaggcagctgtccaattgatgaaatatgtcgggtatgtcaacgcaggtacagtagaatttcttgttgaaggagatgatttttactttatcgaagtcaaccctcgcgtccaagtggaacatacgatcacagaaatgattacagatattgatatcgtaacaacgcaactgttgattgctcaaggtttggatctgcataaagaaatcggattgcctcagcaagaaggaattaaattaaatggttcagccattcaatgccgaatcactacagaagacccgttgaataactttttaccagacacagggaaaatcgatacgtatcgttcacctggtggttttggcgtacgtctggatgtcggaaatgcttacgcgggctatgtagtgacaccgtattttgattcattgctagtaaaagtatgtacgcatggtgctacttttgaaacagccattcagaaaatggaacgttgcttgaaagaatttagaatccgtggagtgaaaacaaacattccatttatgctcaatgtcatcacacatcctgaattccaatcaggaaatgcaaaaacaaccttcattgatagtacagcaacattatttgaatttcctcgactacgagaccgcggaaacaaaacgatgaaatatatcggtgaaattactgtgaatggttttccaggtatcgaaagtggcgaaaaaccattttatgaagaaccacgtatgcctaaagatctaatcacaagaactgattacgtaacggctaagaatgtattagatgcgaagggtgccgatgctttggtcgaatggatcaaaggacaggaaaatttgttgttgacggatacgacatttagagacgcccatcaaagtctgctagcaactcgtgttcggacaaaggatttcaagcagattgcacgtttgactggagaaggtcttcctgaactcttttcaagtgagatgtgggggggagcaacatttgatgtggcttaccgctttttgaatgaagacccttggcaacggttgagaaaaattcgttctttaatgcctaatacgttgctgcaaatgcttttcagaggttcaaatgccgttgggtattctaattatcctgacaatgtattggtggaatttgtcaaagaagcagcagcgcaaggaatcgatgtatttcgaatctttgatagtttgaactggactccacaaatggaaaaaagtatccaagctgtacgggatactggtaaaatcgcagaggcagctatttgctatactggcgatatcaacgatccaagtcgggcaaaatacaatgttcagtattataaagatatggcaaaggaactagaacaactgggtgcgcatatcattgcaatcaaagatatggctgggctgcttaaaccgcaggcagcttatcgtttgattagtgaattgaaagaaacgacagatctgccaatccatctgcatactcatgacaccagcgggaatggaatcatcacttattctgctgcttcaaaagcaggagtagacatcgttgacgtggcaatgagtgcaatgagtgggaatactagtcagcctagcatgagcagcttgtattatgcactggtcaatggtccacggctgccagaaatcacgattgaaaatgcacagaaattaaaccattattgggaagatgtgcgcatgtattacaaaccgtttgaaaacggcttgaatgctcctgaaacagaagtatatatgcatgaaatgccaggaggacagtattcgaatctacagcaacaggcaaaagctgtcggattaggtcatcgctgggatgaaatcaaacaaatgtatcatactgtcaacttgatgtttggcgatatcgttaaagtaactccatcatctaaagtagttggagatatggcactatttatggtccaaaatgatcttacagaagaagatatttatgaaaaaggcgaaacactaagtttccctgaatctgttgtgactttcttccaaggagaactagggcaacccgttggcggatttcctaaaaaattgcaaaagattattcttaaaggcagacctgcattgaatgaacgtccaggtcttttggctgaatcagtcgacttcaacgaagtaaaaaaagaattggcagaaaaaatcggctatgaaccaaaacaagacgaagtattaagctatttgatgtatccgcaagtctttttggactatcaaaaagcatataatcaatttggcgatgttacattactggacacaccaacatttttccaaggtatacgtttgggtgaaacaatcaatgtacaaatcgaacgcggaaaaacgcttatcattcgtttagatgaaatcggagaacccgatatcgaagggaatcgcgtactgttcttcaatttgaatggacaaagacgtgaaatcactatcaaagataattcgatcatcagtacggtccaaacccgattgaaagctgaaccgacaaaccgagaacaaattggagcaacgatgtctggttctgttttggatgtattagtgaaaaaaggcgataacgttaaaaaaggtgatacgttgatgattactgaagcgatgaaaatggaaacggccatcgaagcacgttttgacggagaagtcgcacatgtatatgtgtcttcaggagacactatttcgtctggtgaccttttgattgaagtgactgagaaataataagcgaaaggtggggaaacatgaaaagactgggtttgttttggctgattctgctattagttattgtggcattctacatggaaccagtcttgtttccgccaaaacttgaagtgaaggaaaactctgatcaacaaatagcaaaccaaatgacaacgtggaaataccaggagcttaaagcaactggtttttctacttatatcggaaaaccgatcgatcagctggaaaaggattttggccaagcctatgatcgattaactagcggatttggttttgaaacaagatattatgaaaataaagctagtcatctcacatttgaagcgaacatccaagacagcagagtcacaactgttaaagtactgcaaacagggcctgctgatatcgcgccgttttatttagggatgacgatgcaagatcttacgaaaatcactactatctatactaatttcacttttgagtaccatgatacagaagttggaatcgaactaatggaagaggatatgaattaccgtccgctaattgcttttgataacgacacttttgctattttattttttgatcaaacaacaaacggcctattttcagttgtgtatttagataaagatagtcttttgaaactattgccatatcaagtgtttggtgaaggccttccacattatcaagcagataaatcggctgattgggaatcaatcaatcgtgttaaagaacgaaaaagtacgactttattaaatatgcttagaagagaagacgaacttcccatatacaatcaaacacttgcctttcaaaaccacagtcagctgctactacatgattttttgacaaggcctgaggaaatattgtcagaggaacgtatggctgattggcaaaaatcgctaggcagtgctcaaacgacagtgaaattctcactgacgaatgatgaattggagaagttaatcagtaaacaaaaattagaaaatactagtgggctatttattcatccggcgatcgacgctactttttcgtttttatattggtacagcgatccttacaaccatgaccgtttcatggacccgggaacggattctgtaggcattgctttttctaaagaaaatatgttagtcttattgcaagaagaaaacggagaaagtagtgatagcagtgatcgttaacgaagagctgtttcaactggaggatcaatgcctccaagtcgctgaaatgataaaaaagagtaaaacgatggcttcttatctcgaacataaacagtcaatggaagaatctgcaaaagtttgccagttgaaagaagcgttcttgtctaagaaagaagcatttgaaaatgtagcggcatatggtgagtatgcacctgattatcgtgaaaaaaaacgagctgttcgaaaagcaaaaagacagcttgatatggatgagcatgttgcagctttccgatatagtgaaacacagctgcaaagtctgttggatcaaattgtccaagtacttgccgaagaagtttctaatgaaatcaaagtagatgcaggtagcccgttttttgaaacgaaaaaacactttggatgcggaggtaattgtcatgcaattagacaatagtgaatttgaaataacaaaacgacgcgggctgatcgtatgggtctacagcttaaaacaattaaagaatctgaaaaagttcggcttgttgcattatgtctcaagaagaatgaaatatgtcgtgctttacttaaatgaagagacatttgaagaaacagaagaacgaatccgtaaattacattttgttcgaaacgtagaacgttcttaccgaccggatatcgaaatgaattttgccgaaaaaataggaaacaaaacagtattaaaagacgaaggtttcgaaatcgaagagctaaatacagaaatccgattagctgaacatctttaaaaatctcttatgagcagtttttaaataaaaaataacttggataacgatcgatttttgatcattgtccaagtatttttttgtcttttttttggtatactagtaccagtaccatttctaaggagtgagtagatgcggataatatcaggaaattatggcgggcgccgtttaaaaagtttagcaggggcgaacaccagaccaactacagataaagtaaaagaatccatattcaatatgattggaccatattttgatggagagatagtattggatctgtttgcaggaagcggtggtttagctatcgaagcagtatctagaggctgcagtcatgcggtatgcgtagacaaaaattaccaagcgctaaaaatcatcaaagaaaacatcgaaattacgaaagaaccagagaaatttaccacaataaaacttgatgcggacaaagcaatcgaacggctagcagcggagaaacaacaattcgactacttgtttcttgatccgccatatgcaaaacaaaaaataatcgatcaaatccataaaatggaagaactgggacttttttctaaaaccgcagttatcgtatgcgaaacggataaaacagtcgaattgccagaaactgtggctggattccatcaaataagaaaacagatttatggcataacggccgtaactatctatagaaaagagggaaatcaatgaaacgtgcattattcccaggaagttttgatccttttacaaaaggtcacttagatacggtggaacgtgcggctaaattattcgatgaggtagtaattggtgtttttatcaatacttcaaagaaaagtttgtttcccccagaagaaagaatgacattgatcacaaaagctgtttctcatcttcctaatgtaaaagtcatgcatcaagaaaatcaattgacggtagaaacagcaaaagagattggtgcagatgcgttgatcagaggcatacgaagtatcaaagactttgaatatgaacgagagattgctcagatgaatcatcatctatatgatgaattggaaactgtcttcttattagcaaaaccagaatatagtcacgtgagttccagtattttaaaagaagtactgcactttggcggagatgtgagcagctacttaccgccagtgatcaacgaagctttagctggaaagcgtgaatcaaatgaaagctaaacaatggttgaaaacagtactaattatcatatttggaatgttgatcattggatttgtagtagttcccttgccgtattatgtagaatcaccgggagccacgatcgatctgaaagaactaattacggtcaatgataaggaagataaaggttctgggtctttctctcttacctctgttggtatcaggcaagctacaggtttcttagctttaaaagctaaaatgaccccttttgaagaattgatcagtgaagaagaattgactggtggggcgacaaatgaagaatataatcaaatgcagcagtattatatggattcttcccaaaatgcagcaatcgaacaagcgttaaaacttgcagacaagccttataaaatggaattcaaaggcgtatatgtcatgagtgtagagaaaacatcgaatttctttggcaagctttcagttggagatacagtaacaaaagtagacgggaaaagctttcaaagtacagaagcatttatggattatgtaaaaatccaaaaagttggacaaacaatcgaaatcagttatttgcataatggtgaagaaaaaacagcttctggtgatctgatcgagttaccaacagataaaaaggcaggaataggtatcacgcttactgaccataccgagatcgaatcagatacagatgttcgtattaattctggctctatcggtgggccatcagcgggattgatgttcactttagaaatctatgaacaagtcactggtaaaaacttgcgacatggtaagcaaattgcaggaactggaacgatcaacagtgaaggagaagttggccgaatcggaggaatcgataaaaaagtggcaagtgcggataaagctggcgtagagattttctttgcaccagatgatacgatttcagtcgatgttaagaaagaatatcctgaaataaaaaccaactacgaagaagcaaaagctgccgctaaaaaattgaattcctcaatgaaaatcgtaccagtaaaaacagtacaagaagcgcttgactatctagagaaaatgaaatgaaactaaataattaaagaggggttgtgacacgagttctgtcacaacccctctttttcgtcaaaaatcttcacgataaaaataaaaacaaaagaaaaaattgacgtaattagatgttgaagggacgattttgccagagctcactgtttcttcaattttaaatgaaaggagtaatgaatgatttttactggtcattctttggaaaaagaacaatgatagaaaaaatcagcaagaaaatactagcttcacccaaattgatcatttggatgtctatgatagttcttatcttttgtatcgcaagtggttttttattatcaaatttgctattttatagagaaccagaagagactgctgcaaaagaaatactttctccgtttagttccagtggagaagatccatcagctgaaggaaacgatgtagaagaggatgctcgtccaaaggtcatgtacaccgatatcaaaggaagtgtgaaggagccaggtatctattccttttcttcagaagaacgggtctatgatgtactaaagcgtgcaggtggattattagaagaagcggatagcgatcgaatcaacttttctgcgaagatagaagatcagcaagtcctatatatccctgctgtaggtgaagagctgccagaacatcttgatcagttggcatcctcggaaggaaaacagcctacagcagattccgagcctcccaaaataaatatcaatacagccactccatcagaacttcagcagattcctgggatcggatcagtcaaagcgcaagaaatcattcgatttagagaagaaaacggatccttccagaaagtggaagacctgcaggagatttctggtatcggtgaaaagacagttgaaaaactaaaaaacttcgttacaattaaatagaatgactcaaaatcgactggcacgagcaataaatggacgctaatggatactaagaataatccaattctaagagcttggcaggacgaggaggtagtatttttggataggaaatagcttgattgttcgcaaagaaacattaaaaaaaccaatgctgaatgtctatctccaaaataaaatatctgggattcatattatgaatacggctgtcagcggcaataacagtcaagctctacgagaacgctttgccaaagatgtacttagctatacagcagataaagtatttattctcattgggacgaatgatctagcagagcataaacaactttctaaagaaacgtaccaaaaaatctgcagtggatgatagttcagctgaaaaaagactatagttctgatcatgctttctttatcacgccaccagcagtcgatgagacaaaacaaaaatatcggaataacaagttgatcaaagaatatatctctgttctcacagaagtagcaaaacgccatgattgtgaagtatcgatttttatacggaatttcttgaacaaatggattcgaagaatttttataatgggctaatggatgacggacttcatttcggcagtgaagggtaggatcttttgtcagacaggatgattcgttatatttaaagaatattttgtttaagcaatgagtactttttaatcaacttgaaaaaacggaggaatataaaacatgttagaaaaatcttcaaaagcatgcgatacgaataaagaaaaagttactgataagtcacataatgaacgcattccttgggaccagtactttatggctcaggcagtactgttatctttacgtagtacgtgtacacgtttagaagtaggagcgacactcgttcgagaaaaaaggatcattgctggcggctataatggagcagtcagtggagatgtccactgcatagatgaagggtgttacgtcgtggatggacactgcttgcgaacgatccatgcagagatgaatgcactcctacagtgtgcaaaacttggtatcccgacggaaggttcagaaatctatgtcacacattttccatgtttggcctgtacaaaggctttgttgcaagctggtgtgaaagggatcaattatctccatgactatcgaaatgatccttatgcccaagcgttgatcgaacaattaggtgtatctgtacaccaagttgctttagactcacagcatttttcaaaacttcaaaatgaattaacaggaaaacatgtctagcgttttagaaaggcatgttcgaaatcggttgatttttccggcaattacgtcgatgattatctgtttgttgtattacactgacaattggggttatcgtttgcttcttgccggaatttttttatggttttcgctaaaagaaggacgttttatcgcgtacttgtgtattttgtgtagcataacggtatccatttcttataggctacaagagtattcatttttagaggaaaaaacaacatctgcgcaaattactgtatttacagatacgattcgtgcaaatggtaattttttgacaatggaaggaaggttatcagagaataaacaaaagctccagctttcttatcaagtaaacacagaagcagaattgaaaacatggcttaacttccgaggaaagggaatagaattgactgctgaaggcgagttcatctctccagcaaaaaagcggaatctttataattttgaccaagaagcttacttcaggaaccatagaatttctggacggttccaaattcaaaagattgaacagatcaccatgcaaaatcactggcgaaactggcttcagagaaaaagaggatcttttatctcctttgtccaatctgaatttccgcaaaaaacaagtgtatatattaattctttattatggggctataaagatgcaggattcagagaatcagaagaaatttttagggagagtggtttgctgcatctgttcagtctatcgggtctacacatccaattttatttagggtggctgtattatttatttcgacgtatcggatggccactacacgtcagtattattccgttgagtctactaactatctgttatgtttctattgcaggaagttctatttctgttttgcgtgctagtttgctgtttttattgcgattgctagtcaaattgctgaataagcattattccaccatggacttatttgcagttgtcttttggcttcttttactatttgatcctcgatttctttttcatgcgggtggacagcttagttttttcatgagttttttgtttatcctgatttcttttgatggagattggttgaaaaaaacggcctctcacgtcctgtttactatgatcacgatgccgttgattgtatggcatttttatgagtggcctattttaggtagtctttttacattactgattgcaccggtattcaagtttctttttcttcctggtgtgttatttctcacactcttcaatcgctggctgccggaaactttacttttgctgatagaagagggattaatcttatttgagcgaataatcgatttttcttcagggtcgtctctcattataggacgtttgccccttgtgctatctgggatgtatattttcggattactgatttgtatggataggttgaaagaacaacctgtgaaacacttgttttatgttggtcttttttcttttatttttttgactttgccatttttacgcttttcttcaacgatcgcttttatcgatgtcggtcaaggagacagtatctttttgcaaagtccttttcgaaaagaaacgattttgatcgatactggaggtcagttacactttgaaagagaaaagtgggcgcaaggtatgatacgtcctcctgctgaaagaaatatcgttccatatctaaaaggtcaggggataagtgtaatcgataaactcatcttgacacacgacgatacggatcatgtgggagaattacccacgttatctcagcattttactatcaaaaaaatttatatcggttggggcgctggacgaaatgagccattacaaaggcatttatctgaagctcaaaaaaatggtactgagatcattgaaatcaaacatggggacaggatcagcggttattatgatctttatgtattgactccttttgaaaagggagagggaagaaatgaagattcgattggtctatggatggaatataacaataggcgctttttatttttaggagatttgaatcaagcaatggaaaaacaattgcttttgatttatcctaatctgaaagccgatgtagtcaaattaggtcatcacggtagccgtacgtcaagtaacacagattttctttcccatattgaagcaaaacatgggattatatcctgcggcgtaaataatcgttatggtcacccgcacagcgaagtattggagacactagaagaaaatcagataaaaacatggcgaacggatcaacaaggaatgatcacctatcgctggcatccagtttttcatcctcatgggctagtggaaacaatgatagactagtaattctcatctgctcatggtaggataatttttgaaagtggtgagtaatttgagtatacaagcagagttacaaaaaatacgtaaagaaaaacttgcatcttgttacttgattttaggaacagaaaagtttctccaagatcaagttcggacagaaattgtcaaaaaaatccaattagagggcgaagatgacttaaattttttaagttttgacatggaaaatgcaagtttagatgaggtagtagctgaagcagagacgttgccgtttttcggagatcaacggttagtattcgtagagaatccttattttttaacaggtgaaaaagtaaacaatggaatcgaacaaaatactgatttattgacggcttatttgaaagaaccattagaatcgactgtattagtattctttgcgccatatgaaaagttggatgaacggaaaaaagtaacgaaacaattgaaaaaaacagcaattatcatcaatgtccaacagttgaatgaaaaagaagtacgtcaatatctgatgaataccttagagaattcctcaatcaaaatggaacgaagtgcaattgatttattcttgaggttgaccgacttagatttatccaaaatgatgagagagttacagaaattggtcctttatggacaaaatcaacagcaaatcacggtaagagaagtagaagaattagttcctaaaacgttagaacataatatttttgacatgacccaatatattttaaaagggaagacggaacaagctttgcgtttatacgaagatttagttatgcaaggggaagaaacaatcaaaattaatgcgattttgctttctcaattacgtttatttttacagacaaaatttcttgtaaagattggttatcagcaggcaaatattgctgaaacattgaaaatccatccatatcgtgtaaaacttgccatacaggaagtaaaaaaattcgatgaacatttgctggtacagttgtttgatcaattagttgagatggattatcaaatcaaaacgggacaaatcgaaaaagaattaagttttcaactattcgttttgcgcacagggcagttgttaagaaatcgataagaagaaagacgagggcaaagcatgcgggaaggtcgtttgtttttgtcctttttttgacaaataaaaaaatcggccgaagccgattcttttatttagcgatttttttgcttaaacgagatttgtcgcggttagctttgtttttgtggattagaccttttgattcagccatatcaatagctttaacagcttctttatataacgcatctacgttgtcagcacctgaagctacagcatcttcaaattttttgattgcagtacgcatagcgcttgtttgagatgaatttttcacattagcgttttcgcttgtacgaacacgtttgattgcagattcaatgtttggcattagtttcacctccgataacttaagttcttacgcgtgttaccgcataattcaacattcattattatacctaaaggcagcgtgctttgcaatatgaacatgacaagtttttttccttaacagtcttttattaggattttttttcagtaaaaacggatagtacaagctgaaaaaaatcaaaaagacgctattgtgggaggcaatagcgtcaaaccaaactagatttttatttatctatttaaacaaagtttgaatgggaatgtttggtactaagttattatataacaaagagaaccgtttgcaaagttttttttgaaaagggatacgattccctgttgttctttgtttttctattaagaaactgcagttattttataaccagtatcctttgatcagtaaaggctattctggtgtaccgattattttaatgtattcatcgatattttttatcaacattttttttatgaccaactggttccgacggttccatttgccacttacttccagcacatatttatttaggggcaaacgtaagatatattttgccaaatagcgatctttaagcaggccattgatcacacggtcctcaagctgcaagttgatcccagtcagcatcattggctgttcttgtaaaacgtacgtatcaattaaaagaccttcaaaagtttccacaagcgtcttcctttcttttcaaagtaacctgaaaacaggcactaattcttccattttgatattcgttgaagtggatgcgatcattctttcttttgtccactgtaatctagtataacaaaaaagagcagaagagccaaaaagaaaaaagagcatcgaattctataggaagtctcattggcacggcctaaattattacaaaacattgattaaaaaaagctcctgcatcgcaggagcatcccctatatcgttttaataggtcaatcaaaaagcagtatcaaacacattttgtatcaaatcaggaaataatagataagctaagcccagaatcaaaagtaccgctagaagaaaccagccgattgttcctatgaaatactttaatttttcgaacattgtatcacctcgttgtcagtatatcacggatcagtaaattgggggtgttaagaatctcctaaaatagacaaaatttgttctattttcctaaagcaaatacttgtaagatacagtaagtgataccagaagcaatgaccggtccggcggcgattcctcttaagaagacaacacctaaaatcgtgccgaaaacaagtgcaacagtgatttgtggatcagaagcaatcaatcctacacccttggaagataagacagccactagcccaccgcaaaaaacagctacccagccaataggggatttaaaggcttctaatagatcacgtagaccgatttctcctgttgcgatagggattagaatagccgctgtgatgatcgtcaccccaatattgattcctttgccttgaagccaagggaaaaaggaacgggaggctggtatgagcttcataatcaaaacaaaagctgccgctatcatcagactttgattcttagctaaaattgctacaagtaaaataattcctaaaaaaagccaactttccatgaaatatattcctcactttcttcgaaacaatcataacatgtttttagaaagttgcaaaagtaggaattcatccttcaagacttattcataagctgtttttttcataaaataaacaaaatcataaaaaaacactttgcttatttgacagaagacagccgcgctttgtatagtggacaagacttacatttttttgaagaatcagaaagatcaggtaaaggtcttagtaaacgcaagccattcagaataaccaatattgtgcttccttcgtgtcctacaactccaagaggtagatttaaaaattgcaggaagttagaagcaatcaacaagagaataacaagaatcgaaaaaataatattttgtttgatgatccgccgcatttttaaagatagccgatgactgtagacaaatttatttaagtcgcttttcattaagacgatgtctgcgatatccatagcggcatctgtcccttgccccatagcgacacctaaagaagcggctgctaaagcaggcgcatcattgactccatcaccaaccatcgcatttacttggtaaaattcattctcttttttgactagttgtgttttttcttccggagtacagcttgcatagtaatgttcaatccctacttgttcagcaatggcctttgctgtgccagaatggtcgccggttatcatacttgtatggatgttttgggatttaaagtaggaaattacttgttgggtatttgcttttggaatatctagcagacctaaaacagcaattaactgctgatctttagaaagataaatcacggttttgccttgattttccaaacgttcgatcatttccgcaatctctttgctgattatcatcgtctcaggatcatatgcgtgcttgccaactttccattgcgcacctaaataggtagtttgtaatccaaaaccagtaatttcttctattggtaagtattggatttcttcaggtattgtgcaatcgaaatattgcaaaatcgcatgagcaagtggatgcgtcgttttttgttccatagcaacaagaagttgttgtgccaaatccttttcatcaaagaaaaagctgtcagttacaactggttttcctttagtgagcgttcctgttttatcaaaggcaatcgcttttaattcagaaagcttttctaaatggataccgcctttgattaaaatcccattttttgcagaatttgaaagagcagctagagaagctggtgtagcagatgccacaagcgcacaaggagaagccacaactaataataccattcctcgataaaagctttcatcccaactccatcctaggaaaaagtgggggagaaggatcattagaggaacagcaagcaaaatcaattttacataattattttcgattcgttcgataaatgaagctgtttgagttggcgtattctgcgcttcttctactaattggataatcttagcaaagacagtttcggaactcgtttttgttactcgaatcgtgatgggatttccttgattcagcgttcctgcatacatctcatcgcctaaatatttttctacaggcacagattcaccgcttaatgcagactcatcgatcgttgcctgtgtgctttctaaaaagccatctatcggaacagctgctcctttagcgacaaataccaagttatccacctttagttgagaaacatctacttcttgcatttgtccattttcttttaataattgggctttttgtggttgaagattcatcaaagcagtaatttctttttgacttttattagttgtgtattcctctaatgcaccgcttaaacaaaagatgaatgtcaacattgctccttcaaagtaattaccgatcaaacaggcaccaatagcagctaaagccatcaataaatccacattcagtgtccgatcattccacaattctttcaagccttccgatgtttgtttgtatccaccgatgataatggcactgatataaaaaagtggggtgatggtaagagagaatcggtcgaagataaaaccgaagatcataaataaaaggcagccgattgttgctgcaaaagcttttttctgattagtcatcgttattagacctccttgtcaaaacaaggatagcataataaaaatgtaattgataataataacagctaaatgagaacgataatggttatcatttggtgattaagctttatgttgtttttattatttataataattattattaaagaaaataaaaaaccagaacatttctcaaataagagaagtgttctggttttttctacattgcaataaaccaataaccaatcaaaatgataccaaggataatacgataccagccaaaagcggtaaagtcgtttttcttcaaatagcttagtaagaatttgatagctaagacggaaaccacaaaagatacgaatgttcctacaagaagaacaacagtttcttccattttgaatgaattcccttcagctaaatatttgacgatcttcaagccgcttgcgccaaacatgacaggaatccctaagaaaaatgaaaactctgtagcgacaaaacgcgaagcaccaatcaagatagctcctaggatcgttgcgccagaacgggatgttccgggaacaagtgccaagacttggaataacccaacaagaagagctgcttggtacgtaaagtcattcagagaagtccaacgaggtgttttgtttttgttgcgtttttcgacaataataaaggcaataccgtaaacgatcaaaacaatggcaactggtaagaacttgtggaaatttgcttctaaccaatcatccaaaggcaaaccaatgatgatggctggtatgcaagcaacgatcactttaaaccaaagtgtccacgtatcttttttttctaccgttgatttacttggagaaaatgggtttaacttgtgaaaataaagaacgacgacagccaagatcgcccctaattggataacgacattgaacatcgacataaattgtgaactggcatccagtttgatgaattcatctgctaggatcaaatgaccagtactactgatgggcagccattccgttattccttcaataataccgagaatcactgctttgataatatttgcaaaaaacataaattccttccttcccaattaagatacatcttatagtataccgttattttttgagaaacccaatctgttttttaatattaagaaaaacttgagaaataaagcagataagtacacgaagagaaaaaagaagacaaagccctcattcagactttgccttttatgattctctggtaaaaattaaaatatccccattatagaaacgagtcgcgactatgtgttttcccgttatcgatataagacgtatcattgatgccgtggatagaaaatcgaccgtttgcataagtgacctttgttacgctgccatttaaaagcccagcacgaacaggctgtttaggatcgatcagattaagcaaaaaggcgatcgtcaaaccatgagatacgactaaaacatttccaccaccatttttttcgcagtgatgggcgatatcttcaaatcctgtccatacacggtctcgcaatgtttcataagtttccgcccacccagcggtatctaagttgtatacagcattagcaatttgttcaaaagaaacttctgtggtaaacatttcatcatatgttttaaaattcaatacacgagggatcacaccccacatttccatgtcatatccaccttcaagagacccgaaacaccattctctaatccttttttcaataaaataaggaatttcttttcccttagaatgttctcctagaataatacgggcagtttcgatcgcacgaccactgtcactagaataagcaaatgaaaagtcgacattttttaacccgcgacctaaataatgaatgccttcttgtccttgctttgtgaggggtgtatcacaccagccttgtactcgttcaattgtattgaacatcgtttttccgtgtcgtacgatataaagtgtagtttctgtcattttattctcctcctaagtcgttttaacgattgaaaaaaggatttgtccttttttcctgttcaatcgtcgttgcatcgccatgtcctggatagactgcaaattcatcaggtaatacaaacagctgggtccgaatactatgaagtaattgttctaaattccctgtatacagatcggttctaccgatacttcctctaaacagggcgtcgccagaaacgacaaaatcatcaaaaataaagctgacgcttcctatagagtgccctggggtagggacgacgcgaaaagacatgtttcctaaagtataagttttcatttcaaattcatattctgcaggcgagacaataacatcagcaatatcatcatgtctaccgagtccagaaagattcaaaatcggatcacctagccatttttgctctagtgggctgacataaactgggatttgataatacgcacgtaaaggttccactgcaccgatatgatcgtagtgggtatgggtaagcaaaatcgctaccggctgttggtttgtttttttgatttcttgtttgattcgttccgcatcttctccagggtcaatgatcaaaagtgcttcttcgttgtagaccaaataacagttttcttcaatcattcctgtttttaatctttcgatatgcatgtgcattcctccttgatagccaaaacttctttcatccattagtataacgcattcattgctaggaaacaaaaacaggtacttatttctctttacttatctgaattatcagactatatgaaaagtatttggatattctaaagagaaggaaagtaagttttcatagcattttaatatgtccttgttacattagattcatccaaaaatccaaattctatatcctatatccctgcctaatcagcagggtgtttttttatgtttggaaagagagctctttttgctaaactaggttttttcaggtaatcttagagagaaagaggtggtggaaatgatcaaacagtcaaaaatatctgtgcggcacttagtagaatttattttgcgacgtggaagtatcgacaatcgtaaaaaaagtaaccatactgcattagaaggagcgagaatccaccgcaagctccaaaaagatgcgggagaaaactatgaaaaagaagtctttttaaaaacaacagttcaattagatgaatatcacctgatcgttgaaggacgtgcagacggtattttcaaaagagacggtatttattatatagatgaaatcaaaacctccgaaccacgatttgaagatttagaaccagaacaagtggaacttttctttcatcaagcaagggtgtatgcctatatctatagtcaagaacatgatttacaagaaataaatctgcaattgacttacttccagacggcagaagaagtgatcacgagaaaggttgaacatcagacaagagagcagttagaaactttttttaaaaagctgactgaagattataaagaatggcttgtttttcaagaaaactggcgcactgtacgcaatgcctctttgatggctttgaaattcccccatgatgagtataggaaaggacagcgtgaactagcggtagctgcttataaaacgatccgtacgaaacagaaattgtttgtagaagcacctaccggaacaggaaaaacaatctctacgttattccccgctttgaaagctgtaggggaagaagagggagaaaagatcttttatctaacggctaaaacaataactagacaagtagctgaagatgctatgacagcattaaaagatacaggagctgaagtaaaaagtgtcactttgacggcgaaagacaagatctgctttttagatgagacgacctgtaatccagatcagtgcccatatgccaatggttattacaatcggattaatgaaggtttatgggatcttttgaatcatgagaatcagatcactcgtgaagtcatcgaaacttatgcaagaaagcatacactttgtcctttcgaactatcattagatgtcagtatctggtgtgacgtaatcattggggattacaattatttatttgatccaactgtttatttaagacgtttttttgaagatgaaaaaaacgaggactatctgtttttgattgacgaagcacataatttggtgaatcgttcccgagagatgtattcggcagaactatcttatgaaaaaacgaaacgaagtaaggaagctataccaaaggaattcaaaaaacttcatcgccgtttcaacaaactattaaaagaatttgattcgatccgagaaatagcaaaagaagatcattgggattatcatcatcaaaaagcaccggctgaatctttagtaaaggcaggttatcaattaagcgaaaaaattaaagaatggctggcagaatttcctgagcacccatcacaagaacaattgcttccttattattttgatttgcttcattttttgaaggtcagtgaattttatgatgatcactacgaaacaacagtcgaaaaaacgtatcgcgatctgatagtaaaagagttttgtattgatccaagcttgtttcttgagcagtcgttggataaaggaaaaagcagtattcttttttctgctagtttttcaccactctcttattatcaggaaacactggggggacaaaaaagtctggcttacaaactgccgagtcctttcccagaaggaaaccagcaagttttcatcgcaaattacctagagacgacttatcgaaaaagggaacacagtctggcaaaattagtagagacgattcatgcttttgctgatggaaaggtcgggaattatttcgttttctttccttcttatcaatatttagatcttgcggtggaagcattcagacagcaatatcccgacagcaatgtgctaatccaagaaacggacatgaatgaggaagaacgcgaacgatttttaacaaaatttcaaacaaatcccgctgaaacattgattggattttgcgtacttggcgggattttttcagaaggaatcgatttgagaggggaccgattgatcggcagtatgatcgtaggtgtaggtttgccgcagatgaatcatgagcaggaactgatcaaatcatattatgatgagaaggaacaccttggatttgcttacgcttatcagcttcctggaatgaacaaagtcttgcaagctggtggtcgagtgattcgtggcatggcggatcaaggaatcgttgtattggcagatcaacgattttctagtttttcttatcgacgtttattcccacaacattggcaaacagcaagagaagtacgaagtgttggggaattggaagaaggaatacagcgtttttggttatcaaaagaagcagtaaatcaaaaaaacgaggaatgacagacgtcagcctcgttttttgattaacgatagttagtgaattgcaactcgattggtaagtcaagtttacgtaataaagcaatcacagcttgtagatcatcacggttcttacctgtcactctaatctgatcttcttggatttgtgcttttactttcagtttttcatttttgatagctgtagtgattttcttcgcgttttcacgatcgattccgttgaccaaatcggcagtttgtcgagctttgccacctagagcgtgttctgattcggaaaaatggatatttttgattggcacatttcttttgatcagcttaccaaataatacatctttgatctgttcgattttgaaatcatcatcgctcaatacaactagattgctgttctctaatttgatttctactgtagaatccttgaagtcaaagcgattggacaattcttttgttgtttgctgaatcgcattttttacttcttctgtattgacttctgatacaatgtcgaagctagcatcttttgccataggaaccctcctgatatacatataaatatttaccatacatctatcttatcataggattagggcagattcttacctgtttgctaaaattcttctcatttgagttcgaagtattttattttaatagataaactgttattcttacatttggaataccaaagtaggggagaggtgcttgtgagtaaaattatgactgcgtatcataaaaatgaaagattaaagaaaatagtggttattttgataaccggattgaccgctgcggtcgctttaaattattttttgattccagccaatgtcttttctgcagggatgaatgggatcgctcaaatcatttcctcgcttttatatgaatggtttcatatcaagatagacacaggaacatttatttttcttttgaatatccctgtgtttgtattagggtttctcaaagtaggaaaacgagcaacgatccttagttttgtgaatgttgtatgtgtatcggtgatgacgatgctgcttccagtcggacagatcactgataatattttgatgaatgccctagtaggcggtgttttattaggtcttggcgtaggattatctttaaaaatgggctttacaactggtgggatggatatcatctctcttgtactttcacaaacaactggaaaaacagtcggaaactacatgctgattctaaatggtatcattgtagtcatcgcaggcttcttctttaactgggaaagtgccttgtatacgattatttccatttatgcaatgactcaagtaattgatgccatccacacgagtcatcaaaaagtaacagcaatgatcgttaccgtcaagccagaagaggtaacagaagaactagcaaaacggatggtacgtggaatgacattactgccgtctgtcggtggctattcaaaaaaacaagggaacatgatcatgatggtcatcacccgctacgaaatgtatgatcttgatcagatcgttcatgaaatcgacgacgatgcatttatcaatattttaccaactcattcagtatttggccggtttgcaaatgaaaacgaacaaaaaatgtatcgaacaactggcgtattgccagaaataaaaaatcgttcacaaaaaaaatgaggaatcaggtttattttagaataaatttaatctattacatctaataagaacatttttataaatttaaacgagaatcttccttctaaattctcatttacaagcagctaaaaaaagagtatgataaataaaaatcgtgttaaggagtgtcgtacgatgagcgaagcaaaccaagaacggtctggacaagaaatagaactaatcaaagaacgtattcttgctgccttggaaatggtgattgatcctgaattaggaatcgacatcgtcaatttaggcttgatttatgatatagaattcaatcctgaaaatggagaaacagtcattaagatgactctaacaactatgggctgtccattagcagatattttaacagaatctatccatgacgcattaaaagaagtgccagaagtaacgaaagcagaagtcaaactagtctggtatccagcatggacgacagataagatgagccgttatgcacggattgcgttggggatacgatagatattttcgttgatttaaccgcgtttctcactcatttagtatgtagtccaagccactttttggacttcggataacagacataatgagggtgtttttgataatgataccatattcaacgagaaaacaacttctaaactcttttattaacttttagaaaaagttaataaaagagtttttgttttgtaaaatttttagttagatgaactattagaagaaatgctgttcaatgaaaaagccagagaaatctcacgaaaacgatgaagaagcacaaaaacgtaaggtaattgtacaagcatttaatgataaataaggaagatagccaaaaaaattgactttcttcagttacaaaaagtatagaatattacttatttttgataaaagtgggtaaacgatacaattgtatcttagcaaaacgtgcgataagtaaaaattgggaataaatgtcagattagagaatcaattagagtagtccgcatagttttagacactattttgttcaaaattggttcgtattggaaagatatttataaaaattcaataattattgagcatgcatcaataaagacaactgaagtttatttgagaagattgactgtcgaaggggatgtattagcaatttagcttggaatttatttcactctttcacttgaatatggaaatgaattacatttcaaattggaatttttttaaaacaaaagaaataaaaacaagaaaaagtaaatttaaaagaagtttctcttatatatgaagaattgagaagtatttatcaaaattaaagcttttttcttcaaattgcaaactccaaaaacgatgcgataacggaccatgtcagagtggtacttttataattaatatcccttacagatgttgatttatcaataataaaacagaccatctgattttacaataggaacttttgctggtctgagagtcgcggatattttaaaactaaaagtatcagatgttcaaaataagataactacgatgactgttgaaaaacgaagaaacgaagagaattaaatttatcgaatctagcaagtctaattattgattataaaaaaatattatatttgggaatcaggatggttattttatagaccttaaacccgttttaagtatcttggtactcagtaacattataaaagtcttgcgagttaccaaggctcttgaattggattatattggcacacacaatgaggaaaatctttggctatgaatcttatcgacaatttagagatattctactttaatgcattcatgaaattttaaatcatagtaaccagtcagtgactatccaatctattggattagaagaaaaagaaataagggcaagcctagataagttcaatactctggattagttagtgtgtataaagattgttttaataaggtataaaaaagcacagtcaatttttgcaccgaccctaaaaaatctaactttttagggttggtacattttggactatgctttttttatttatttaacgactcaatataaaaggaatacacataatcaaggtaataataccaaagattaatgaacacatagaaacaatgaaaattttcgtcatcagatctttttttttatttattgatgtttcggtctgcaacagcagaagccggatatgggaaacatgactatcttgccaccattgaagatcgtgtgaatggaattgtttctattgtgttagaggataatatactgggatacgtaggcaccgtggaaggtagcgtatatattgatttcccaaacgatcgatcgctagatacagctggtcgttttactttttacatcaaacgcagtccaattgatgatagtacgccagaactagaagattactatttcaatggtttcagtcagactattgataaaatcgaaaaaattctagctgatggaaagctagagattgaacagaaaattgcggaatccgaaacgcagattgatgcgaaattaaaagacacaaacgacaaaatcacgaaagccaatcaagatgtcgcaactctcaatactaatattgataaggcaaatgatcgtatcgatcaaaccaatcagcaaatcggcgatctaggcaagctgaagaaaatgtactccaacagcatcgacttcggggactatgattatagtgggaatccgaatttaatgcctgttttaaaagctaaggatttttctccaaactcacagataacaatagaagattctggaaacagtttaaaagtcacttttgctgatagtgagggagcgaaatttttaacatctattaaaagtgtcccagcgttactgccaggtactcaatatactttaagtgcagacgttactgttttagaaggatataaaggtgacttaaacagtctaagattggcatatagaaaaacaccaggtggaaatatattactatacgcaacagctagaaatgctcaagttggtaaaaagacaaaaatatatgcaaccgctaattctagcgcagcaacagacccgtcaatttttgatagaatgtacttcactattgatacaacttctacagacccatttgttggaacagttttagttgaaaatattaaagttgaacgcggctctacagccactccgtaccagcctaacttacttgatgatccttactgggtaggtaaagcgccattgggtgataacttaatgacaggtacatttccggtttcaaatagtcaatacgctattttaggtagagttttgaaaaaaaatttagagattggtaagacctatacagcaacacttaagggtacaaaacctactacacaaacatttgcggcttatagtggtgggacggttaagtttggagattttaaaccagttgagggtttaacagatgtctggagcgttacattcactgtatcaaacttaagtaattcaccagcaaactttactctctatcaacaaccacaatccacaattggcgcatgtcaaatcgactggctcaagatcgaaaaaggcaacacacgaaccccgaatattagtcagtttaaatacttcggtgaaggcttgaaagacagcaacaatccgaatgattacagttgggatatcacacctgaatatgctgaaaaagctttaactaatactttaaaccttaccgatccacaaacagctctaggactaaaaaatttcaaagatggggtccagatcgacggagtagatgtggcaacagttaaaaacttaggtagtgtgttacagagtggatctagtttgactactattcaatcagataagcaaagcgcatttgatgaattttcatacgaattcgaacgtattggtgatagggtattctttcacgcacgagtaaaaacaaactcgacaacagccgtagcttcacatgtgaatctactagaaattcctttaggatttcagtttcctattggatggacaattgtagggattccgttgtcagttgtacagtggactacgccacaaggagaaattagtgctttggttatcactgattctaatggtaaacaagtagttaaatttgcaactaatcgagtaggaaatcattatatttcaggagaatggagaacagctgatagttatccagaaacaaagtaggagggaaataaatgaaaaacatttggaaatacggacgtactggcggagaatacgccggaaaagtgttggacgatatgcttgtatccgttccttacacagatcagccgccacttgaaggattccgtgctgatggcgaaccgctaacgattgctgatcagatgtttgatcctaaattgaatcaatggattgttttagcgaacgcactagatcacaacgatttaaacaatctcaaagcgatatacgaggctctggaacatgaaaacgacaacctaaaacagctaaatgccaaactcatgctaaacgatgtagcaattaaacaggaaaacactgcattgaaagaaaaagcggatagtttagcacaaatcaattcaaaaatgatgcttgcttcgttacaaaatagcaaagacatttcagaaattaaagagcaactaaatccagcttcaaagggaggtgagtagtatgtttagttttagcgatgtgaaaatgatgtatgattggggctgttttactgacgatcaagttcgactattcgttccactatgcattacagacgaagaagcagataaaatcattagcaaagaagagagcgcatcttaattgatgtgctttttattttgattcaaggagttgtcacatgattaatttaggggaatggggagcgatagcaggatcaataaccgctatcgtttctttgattttattagtaattagaccgattgttgcatcatttacaaaaattacgaaaacactatcacaagtgagttacaacttggaactattaacaaaagatttagaatcgagcaaatcagatcgattgatgattcatgaagaactcaagaaacacgatgaaagattagatacacatgcagaaaaattggtagaacacacacaacaaattaaaactttatttagggaaacatctcgataaaaatagaaagaagatgaataaagatgatcttacctgataaatattatcaaatcattaagtgggcggtacttacggtacttccggctacatctgtattagttgcaacactaggcaaagcatatggatggaatggaacagatatgacagtactcactattaatgcagtagcaacatttttaggtgttatcactggtgtgtcggcttataatttgaaaaaataggaggaaacaaatgaaaaagaaaatgactattactgtgatgagcctgttaacggctctttttttattgccaattaatgggtttgcctatacgatcaacaatgaatttaatttgggcgcaaatgaaggtagctcacaagtagcaaataatcagtacattttgctgcatgaaacggctaatgaaacagcaacaggacgcaatgaagcgcagtatatgcaacgttcatggactagcgcttatactgcttatattgtgggagacggtggaattgtctatcaagtcggacaacctggttatgtgcagtatggggctggttcatatgctaatgccaatagtcctgtgcagattgagttacaacacacacatgataaagcaacttttgaaaaaaactataaagcatacgttgaattggctagagattcagcaaagaaatatggtattccattaacattggacactccttataaccaaccaggaattaaatcacatttatgggtaacacaaaatatttggggtgatcatacagatccttacggttatctttctgaaatgggcgtaagtaaagaaaaattagcatatgatttagctcatggatttaccgatgaaaatccaactacttcagatgataaaccagtaattgatccaactagagcaggtgcagcaaatcctacacttacagatggaacaaattacgcccacattgatcagttcggagaaatcgaaaacgcaaacttgcatgtagctggatggcatattgctaactaccaatatgagtatatcttcatcatggattacaatactgggaaagaattagctcgagtaagagctgatggaatttatagatcggatgtaaatcaagcgtatgggacatctgggaatgttggctatcatgtatcttttaacatgcacaacttccctaataagaaagtatacgttatgatgcgtgctacaaatgatccaacaggaaacactaaaggtggagcacaagattttcatgacaagcgttggtatttaaatattccacaacgataaaaaattccccccctctttgaggggcggtacataataaataaggatattaattacactagtatttttgttataatgaatgagaaaaaatagagagtgtaggtaatgtaatgaaaatgaaatggtttaaaaaagatttagttatcgccctagtagtaatatttatatgttcgtttataattatctctccacaaatatataagcgttcgataattttaggaacagatgtcatgtttcatcttaatcgcttttttgaaacagctaaacaacttgaaacaggtaaattcaattatttcttatctttatttagttttaattcaagtgggagaatagttaatgctttttatggatgggacttttcctatctaatgggatttttactcatgattgttaaatcatggactaaatttcaaattgttagctcgtttatttgtactttcattgcgggtacaagtatgtattttttaagcagatatttaaagttaactaatattcttagtattataactgcaatattatatatgtcttcctacgtagtcatgcaataccctattgctcaagcttttaatgggtggggggctgcattcttacctttaatatttatatcggctatgaaatctataaaaaatatagaaaatcccataaattatgttggtctttcggtaatagtcagtcttctactgtctattcacatgatgactctagtgattgcgttgctagctatacttcctttctatatgtatagctttataagaaataataaaaaagtctattgggttcgtgatatgttgtttgcggtaggacttacaattttattatctgccaattctattctagggtttttagatccttacttatcaaataatattttgaaacctttctatttggaacaaatgtctggtgacatcgttaaattcttagtgaatagaaatgatttgcatgatgtaggattaatctacacatttatttttatttttggaatatcatttactttgtttaattggaaacaaacaaaaatcgaagaaaagtttgctgcaattgttggtggagtatttcttctattggcatcaggtctacttccttgggacgaactaccacgttatattccctttgtgaaagtggttcaatttccacaccgatttgtgattgtatcttatgttctattaattttgaacttcgctatggtcataaaccggataattagtaacaaaaatgatgaggtgaaaaaagttgtctattcattaactgtggtattaagcttttttagtattttgaatgggaatgcttttataaattctcaatcatggctttggcaaggtgatgacccaactgctacaggaaataataaagctagtgtacgggttaatggagcagatcagttaagatcagattttaaaagtccggatttagaaaaaggattagatgcaataataaaaggaacaccggattatttaccaataccaaaggactctgataacgaaaaaatataccaaactgatccttataagctttatctcagacaatttgttgataatcctttgcagggagaaaaaactattacaaataaaggtgaaataaaaatatcatgggaaaataattcctctaaaaatcagaaaacacaattgcctgttgctgcctacagccattcatacgtaagattgaatggggaaaaaatggataaaaaagaagtaactgacctaggggcattgattgttaatgctaagcctggattaaatgaggttgttgtaggctaccgtccaataattagcattaagctagcactagttttaaaatttataggtttgatgataataattttattaacaataaaaaggataaagaaaattttagccacgatataatttagtttttcatttatgattgtgtaataataaatatgccatcacaacaaagaatgaaacccattattatctaatctatgtccattctttttgtttgcagtagttgtgatggctttccgtactcttagctcagttggtcagagcagacggctcataaccgtccggtcgtaggttcgagtcctacagggtacattaatgtagccaattgaatcgttctgtgttagaattttttgaagagtattatacaagctaaagcttttcttcattgccactcaaatgagtggcttttttatgtatccttttatggattaatgaaaggatgtttcacatagttatacttctgtatatttgaaaagttttactttgatttttaaatggaaagacatttgggttatattgtgagataataataaagaagagtttaaagcgttccccaaaaaccacttccccataagtgtgttacgctttaaactcttttatatttgaagccattaaaaagcataccatataactgtaaaaaataatgggaaaaagacttataattggagtggtagttaattagtgacttatttttgattttatagcactgatactataaaatatagatatcatcatattacacaatcttaatactaacttaaaaaatatcccttttataagtatggtgataaaatccgttccgggctaccttttttaggtagcctactttaatctttatacctttctggatcaacgaaagtatacttcaaatagtcataacgccgatgatcgctccgtgcgtctggcacatcagtcacgatatcaaacaaaaaatacacatctttcttcattctggtttttgttgccggaattttaaagtagttcttattagagtaatagagattgattaataagctatcttcgattgctaaaaagaaaacttctgaatcccacaccttataaaaatctttgacaaatctattcgaaggatcaaatttaaaccataattgtgtttttccttctattaaaatatcttggttatacgcatcttctttgaaatttaaggtaattgatatgtatcccgaccaaatattagggttgttagaaattaaagaccctagtcctagtgataataaaataccagataattatacagcacaacagtatattgaagatatttacaatgttagatctgaaatacaaagagttctagatagaattgaaaatgaaattggtaagataatgatggaaatggaaagatcgtgataaagtttttgttactatttttaataatgcagcaaaaaaatattgccaccattttgccaccgatggctgaggttttctcaggtgttttgaaatgacctaaagatagaagagattatttagttcctttataacctttaatactagaagcttagagactatcttagattaatagagaatagtacagttagattattgcgaaaagaagccttcatggccgttctgaaaatggatgaggaagaaagtaagaagtagcaaggaatttaggagtttcttagctttcaaaatttgtgaaattcaaaaatattcgccctatgttcgcccaagtttttacttgggcgaattttttgcattttaaatcaaagatcttttcagacgttgggcgaaaatatcaacagcttcatttttcatttttttggttacatgtgcgtaagcatccatagtagtaactaatctagaattaccaactcgagcctggatttcttttgggtttgccaccggattgttaccggtggctttttttggtaaaattcaagaattttttcttaaattctccatgatatctatcgtttcagtttttatcttatttgtcacatgagaataggtgtacatcaaataatgccttggataccttggaatcagtggatgagttggaaacaactttggattaatcaaaagaatccatgtataaactgagttatgccgtttaagttagcgcagaatccctagctatttaaaaaatggtttggctaagatctctcaaaaagagtatttattcaaataactttttagaaaaataattgggctagaaacaaaagaagccagctacaagagctggaaaagttaattttttgtattcagataaattaatatacaaataaaaaatactatcgaaaacactaacccaactaaataattggataaaaaaaggggatcagaatctgaatcatcccaaatcttgatcatgaaatagataaatgggaggaatgagacgaccaataaacaatcttttttacgccatattttcaaacaacttagaacaataattttatatgcacaagtaacccagaataagattttactaataaataacaaagttatatcccctttattttttctctttcccaatatatttattttatcactatttatttattatgagaaagaaatgagaataaggggagaagtcacaacaaagtttctgaagaagaagtatataaaatggcaaatcgacgtattgttaatgcgagtgaggctattcgtaagtttggatttctatattagataatgatcgtcaatgggagggaacggaataaaaataaaagacggattttacgatagtagtcatggtattgatggttaaatactagatatgccgataaagtaccctaattaattcggattgaaaggatgatgaaatgcgatagacagcaacggttgaaaaatagtaagaacaattaggaagagttgaaattcacatccttgtttttactatttccgttgctgtctatcaatttataaacatcaaagttatgtttacttaaaatatatcaattgcttattgtcaaagataaatataatacgcatcagcttccgaagtaacagaatttaccttatggagtccttctaatttgatgtggagttcattggcaacttcttcaatatatttgttaaatatcctattttctaattttaaataattagcaatctctatagaaataacttttttacgttcttttcctataaactgaatattaaaattccttataacgttgtttctatcactttcattaggaaagctacttctcattgatacatattcttttatagatgcaagagtgctttttatcatttgaaattcatccataacttcaccttctctaattattttaattttaatttaattatacatgatacttctgtttctagctatttttttgctgaagagaagattgaggtcattatgcaggagaagaatgaagaggcagctaattagtcaaatgaaaaatttgataaaacaaatcaaacacagattacaataaatgtcgtttttgcagtgtgatcgtgtaagatttgtaaaataataaagctaagatcagcacagcagtttctaacaaggtgtattatgaattgatccacaacaagataaatcagaattttatttaaatgagtaaaaaaagagaaaataaggcacttaaagtctagcgactaccgttaggggaaaagataaacagattcttttcttattttttagttacatagacattcagaaaaaaagacaatcaactagtgatcgtcttttagaaaatttccaattatttttgtgatattactagaaaatgagacaagagcaagacctaaaatatttatgaaaaaattgaaatctaaaaaaatagcattaagtataacaagaatcattccggtgtataaaaatatattagcattaagtttgttgataagcgtcatttttcttcctcctatcacttttagataagagtatctcttatttattttatagtcaataccttaataataagtcgacagaaacaagaattaaggagaaacagttggatgtcaattgatagtactagtataaagacaaaaacaacaagtgagaaaatttatagttataaaagcagaaaaattaataattcttataaagatatcgcaaaacaacgataaaaagaataagagataaaaacaaccctactacgtaaaaatttaatgctgaaagcgattgataaaatgtatgttttattatttttattataaaaaacgcagatggtaaaaaagaaagcactaatataatcgcttttctagaacgtttagtgaagtaaaagaaagagatgacaccaatacagactggaatccaaaataaaagcatactaaatgtgaccacagtatcatctcccatatagtcttatatcaattaggataatagcattttatcaactaatagccaactaataaccaaataataagaagaatagtttcgaatgaatcacagatacctcaaattaacaaaattaagaaaacacgaactaactgcagcgaaagaaaaattaaaaaaagaatacggagtttctgaagaagaaacatataaagttgcgaaaaattgtattgctaatataaccacactgcaaacattttgtttaaaaacggaagtagttaacgaagaacaaaaagaaactagatattactcgattaattgatagagagatcattcattgaaggtctttctcgttggttaatcaattattgtgattttctgaaatttcacatctttttatttatatttaagccgtatatcgagtgattatccttgtgttagcattacatccgtgttatagtaaataagtaatctaatttgaaacgtaatctgagcgatatattcacactataaaaactccttttaccaagtaatattaattgcaataaaacacgtattatatacgtatcaggaggaaatatatatgaataacggtacagtaaaatggtttaactcagataaaggttttggtttcatcactggtgaagatggaaatgacgtattcgctcatttctcagcaatccaaggagaaggctttaagtctttagatgaaggccaagcagttacttatgatattgaagaaggtcaacgtggtcttcaagcagtaaatatcgtaaaataatgttgaacgttaaccgcctcatatgaggtggtttttttgtttatgtcggtagaaaaaattcctcaccgtaatattaggtgagggatttttttcgttcattaattaattttaacattattttttgcttcagtttggctattttctgacagccagtttttacctgctttatctgaaattgtcgaatcgtaaagaagctacttttttgagcaaaggaatttacatattttattaaaaatggtttaatggtttaaactaataaacgaaagaggcagatcgcaatgaatggacacgatcgcttaaaaacagaactagaatcattaagtgattttttagcagctttaggtgacagaaaaagacaattgattttgattagattattaaatgaaaaaagctgtcatggtttgcaagtaggagaactaactgacgatacaggtttatcaagaccagcagtatcgcaccacttgaaaattttaaaagacgccgatttattagaggtcagagaagaaggaactaaaaatttttactatttaaaacacgaaaataaaaatatatataaactaagagattttttgtctgacgtaatagatgaaatagaggagctaaaaaacagtgaagaaaattctgatagttgaaacaaatgtcaatcaatacaaaggaacaaataaagctactgggatttggctaggagaaacagtagaatttttagcagaaatctataaatatcaatttgaagctgattttgtcagtccgttaggtggttatgtaccgattgaccctcgaagtatgagaaatctagattctgatgtaatagacctttattctaataaagcttttattgaaaaaggtttgaggaatacgttgtctcctgcaaacgtaaagagcaaagattatactgctatttactttactggtgggcatggtgtcatgtgggattttcccgagaatagtgcattacaaaaaatagctagtgatatttatgaatcaaatggatatgtgttatctgtgtgccatggtatagcaggtttatttaatatcagacttgctaataatgactatttaatagcaaataaaaaattgactggttttactaaaacggaggaattattggcgatgaaaagcaaagtagttccttttgataatgaagagatgactgtaaggagaaaaggatattttatcaagaagcgtttctttaagagtcatgtggtaaaggatggacatctgattactggacaaaatccgtattcaacaagagaactagcacgaacattcatcaaggaggttatctaaatgcaaacagttattggcagtaatggctaaattggatacgagttagcaaaagaacttaatcaaacttacgggaaacagcttcgcttagttagtcgaaatccgaaatcaatcaacgatacagacgaactaatctcagcggatattttagatcgtgaggcaactattcgcgctgtagcaggaagtgagattgtttattttgctgcaggattaccgatggactccgaacagtggaaaacaaaatttgaaatcatgttagaaaacgtcatacaggcttgtaaagaaacaaaggcgaaattagtttttttcgataatacttatatgtacgaaaaaaatgacacggaacaatttgaggatagcaaatttatttatgatggtatcaaatccactgttcgagctaaaatggcagaccggctagtgactgaaatggagaatcctgacatcgatgtgatgatttgtcgcgctcctgaattttatggacctaataagacgcaaagtattacaaacagtttattgtttaaccgagtgaaaaatgataagactgctttgttgccaatttctgatcaaacattaaggacattaatatggacacctgatgctagtaaagccatggcgcttttagcaaatcagcctgacacttataaccaaacctggcatctaccttgtgatgtaagtcgaacatatgaagagatgataaagttgatggaagaaaaattgcacaaaccggtaaaatataaagtgatcaaacaatggatgtttgatcttggctctatattcaataaaaatatgcaagagctaaaagagttattacctagatatcattatgacaacaagtttaattctgataaatttaaaaagaaatttccagattttgaaataacaacattctcaaatgcattagacgatttattcaagttagaaaagtaatattactcgagagaaaaaacgatagttgactttccatatttaatggatgtcaactatcgttttttacgttttatctcatgcttagaataacaattgccaagtaaagccaaacttgtcagtcacccagcaaacttccgtatacttctcatagtttttttcatgcatcattacagttccgctatcttttaatgtattaaacgcctgatcgaattctgcctgatcatctacttcaatcaaaatggtagatgcccaggtggaggcaggtgcagggaaatcttttgacatatccaaaaatccaattacttgattgcctaatttaagttcgccttcaagtataagatccggttcctctttactggtatctccataccgattcaacttagtgatttcggagttaggaaaagctttgtgataccaattgattgcttcttctgcttgaccattatacgtcaaaaacggcaatatttgcttcatctttttccctccagattcctttttgtgagatcgattgcaaagcgattgtaacatggaatgggtaaaaaaaactaaggaaaggaactaaatcgaaatggtgaattctcctgcataagtttcatgggattctttaagtgtttatgacaagtttttctttcattaataatcagtctagtatttatataaaaacgcggatagcaaatataatagggcaatatgtgccggataaaagatatagaagaaatatttcattccttttcctttttgtccgttatataacaatatcgggataactgaaaagatcattatccactgggtcgtacccaagaagaagtatatgccggcaacgattgagataataatacattgaatgctacggtgatttcttgctaaataaagtaaaggaatcaaaagaaccataaaattattttctgctaaaagcagtgcaggtaaaaatgacgtaatcagcataaaaacaattttgttttgaacgattactggactggaaaataacaagggaataaatagtgagagtaagattggtaaaatgaacaagaaaatacttgtaagaatctttttccaacttccagtattttttccatcagtgaaaagatcaattgcatacatcatgaccgtaccaataaacaaatctctaaaaatattatttatcaataccacttcatcataatgaacgatattaccaagaaaataagtgaagaaagccataagaaccattgagaaataaagtcgctgcatatatttctttttatcatgtgtatgtgagaagcctacaacgcttataaaaaagaacaaagtagcaactggcctaccaaaccaatccagccaatcgggagcaccaaacggataaaacatttgatgaatgtgatcgataaacatcaacgtaatccctaaaaatttttagatcaaaggtagaaaatccttttttcaagctaacagtattcaaatttttccctcctaattaaataaatgaaacaagtgacagttgtattattaataaagttgagcaagaatcacaatcgaaaaagctaacacttttgtcatatgattttctataataattaacgagatggagaaatcatctttgaaatattagtgaatgggagataaaatagagagtaactataattaaattatgtaaacctgcagacgtaatttctatgccaatgtatcacgaaactagaagtactccaatttgtctaaacgtttatctataataaaaaagtgcgaaatgccgcactctttatttagtttttatgcaaaaaatcaagttataagataaagtaggtgggattttgttactatgaataacataataagaaagtaaagtggattgatttgagatctttttatacttcaaaaaagataacacccaactttcaaaaatatgttttggaagttgggacaaacgagttaatacattttaatacattattttttattcaaaaaaaatagcacaatggcaaagatcgtaagagagatcataagccccaatgaatgactaaaaagaaaagcagaatcacatgccatatcatcccatatttcttcaagaaaataaataagcgggaaaaagggaaggaatagtagaacatcgatccagcaccatttttttcttcttttgaaataacataaaacaataaacatgaacgtgcagggaagtaaaaacaaagctttactcataactaacaaaataccagctccttttatttttttctcccccacattcaaagagtaacaatggtatgtacttaataatagaaaaatggatcaacttgtatgaataacagctgaaaagatctgcaccaaataaaaaacttccagccaaaactgactggaagtttatttttttctgaaatattctaacacaaatatgaaaaagatggccgaagctaataagccgatttcgtagcaaaacaatgagataccagagtcgtaataataaaatcctctaatcttatggataaaatagatcatcggacaagcagataagagtaagtatttgttaggccttttgaataagtaaaagaaagcactggtcattatgataaatggtatccaaaacaaaagtttacttaagacaatcaaatgatcaactcccatattttttaccaagagagatcataacatctttatcgtaaaaacaaaatatttttttgctcattttgaaaatttaaacatactcgttcttatccaaatatataaaaatcgcccctcattcatcgagaggcgataagttctaatttaactcaattttttttgtttcttttggctgatgagctgttttaggtaataccaatttcagcacaccgtttttaaaggttccagtgattttttcttcatcaacattaggaagatagaatgaacgtttgtaagagaccgaatgtctttctttccgtacatagttgccatcttctttatcttctgtatgggactcatgattggcggagatcgtcaaagtattatctgaatattcaactgtcgtgtcttctttgtcacagccaggcatatcagcagttagtttgtattctttttcattttcgactaaatctacttttggataacttgaaacacctaaaaaatcattgaatgctggactaaacacgtcattgaaatcagggaacatgtcgcgaatgctaggtacatttgccatttttgatcatcctttcaataagtattttttatttatccctatttacgtaataactctattttgaaaaaaatgcaagtataatggttagctttgtgaatatttcatctaatacgatacaaaggctatctttctaatttgaaaaagggatcattaaaataataagaagaaaatatgtcaaaaggtaaaaaagtaaattcttctatccaaatatagaaaaattgaatctagaaaaccgcccgacaataaatttcattaactcagttgaccgaaaatgaagtagataccaaaaatttatcaagagagcaagtagagaagtgagtatattcataagagaaatagctgtaacgaattattaggttaatgcaaatgcttatttatactccgtataactttctcagaaaaaatgataccaataatgacttgctagtactgtaaatccgtataatatcatctaatcaaaatggtgttccatttgcatctgtcatcgtaatcgatccttcgggtgacactcgataaaaaccaacgcttccagatcctccttgggaacggatttgtttgctggaagctgtgaacaaataatctcgatcaattttttgataaaagctaataacaatatcgtcactttgtaattcggaacggtgggcaataagaaatagaagtgctttgtcagagttttctaatggaagagaaggtacagtgctttcttgcatttcagatgttgaagaaatgctagacgactgaatacttgattggctatgttgcgaatctacattaccagtagaagtattagtaatggaagtagtagaagtacttttagttgaaccaacctcagttgttgaaatggctgctgaagattctttaacagaattctttgttttatatccacaggcagaaaaaagtattacagttcccaacaagcctgcgtaaatccctttatgcatgatagctcctcctaaaatagattatctttattcagtatatcacttaaacaaagaaaagcagatggtttaaaatgaaaaaaccttcccaataaagggaaggttcatgaagataataacttttttaataattatagctttctaatatctttcatcaacttttctagtaatcattgggaaaaatttcaagcagtagatcgcacaaatacctacgacgatataaatgatcttcgcaaaaatagttgttgaaccaccagcaatcatagctactaaatcaagttcgaacaagcctaccaacagccagttcaaccctcccacaatcaataaagttaatgcaatagcatctaaagttttcattagaattctcctttcttaaatgataaaacaattatatatcaaaaagagaaacattgcttatataacgctcaggaattttagcaatctatgcaaaaagatgaaaattttttttgctcttccattagtacacattttttagctgaagctgtaaatttcatgtcttaattttttttagtgagcttttatactggatttgtaagaaaaaagaaggagaggatcacatatgtcggattggttggatattgcaggacaagtagtaattgtaactggaggttcctcaggaattggaagaagtatcgtcgaaaatttgttgaagcagaatgcacaagtagcgaattttgatgtaactgaatgccgtatacagcatgaaaacctactatctttaaaagtcgatgtgtcttctaaaacggacatagaagaagggatatataaagtaatgaaacatttcaagacgatcgatggtctagtcaataatgcaggaataaatattccttctcttctaatagatagaaatcatccaaaaagcaagtatgaattatcagaacaagtttttgataagatgatcgctgtcaatcaaaaaagtgtatatttgatgagccaagcagttggaagaatcttggtgcaaaagggatcaggagtgatcgtgaatctttcttctgaatcaggattggaaggatcagaaggacagagctgttatgctgctacaaaagcagcgatgaacagttttactcgttcttgggcaaaagagttaggaaagaggaatgttcgtgtggtaggtgttgcaccagggatactggaagaaaccggtttgagaacacaagaatatgaagaagctctttcttatacgagaggtataagcgtcgaacagctgagaaacggttacagtcgaacaagtacgatccctctaggaaggagtggtaagctgcaagaagtggcggatctagtctgctattatctttcagaaagatcaagttatatcactggagtcacgactaatatttcaggaggtaaaacaagaggataaaggataggggggacgcacgtgacgctagtaaacagatggtaccaattattgaaattactagtcactcacaagaaagtttcaatccaggaagtgcaaaaagaaatcaaaaccagtaatcaaaccataaaaaaagatattggggagttgaatgaagaaattgccggtattgcaaaaatcatccaaaaaaacaaacattttgaacttgaaatttatgattttgatttttttgatgagatcatgcaaggaaaattgaaaacagccagtgatttcaattcggcatccaaaagaatcgcttatttactaaataggctgatcgaaacagaggatttcttacgtatggatgatttgtctgaagaagtcggtgtcagcagaggaacagtggtcaaggatctaaagacattaaaagagatgatcaatgattttgatgtaaagattacaggcacaccaaataaaggactaagaataataggagatgagctagaattacgactacttttattttattttgtttctccctacttttcagagacgaaaacagaacagtttctagaagaaaaacaagcaatcaaacattttcagaagaagacgaatgctagtaaacaagaaatcacccttttaacgaaagttatcggtatttctttgaatagaatctctagtaactatctgttgaagaagcccatcaatcgttacagtgggtgttttgaatatatccaagaattcaatgaactgatcaatcagttggaagaaatctatgaactaactttgagccaatatgaaaaagattttatcagttttcctttgaacatcatcaacacaagtataacgatgataaggaaagctaactctgatttgcgcttatatttcgaccccatgatgatgcgtattcgacgattagatctcattgatctggatgagtccttcttatatcaagagatgaaacagcacctctctttattgataaatcgggtaatttttcgttatcgattgactgatttattttatggtgagatagaaaaaaagtatcctttttcttaccaaatcgctagcgaatgcatacaagcattagaagctatcttgcaacataagatctctaaagtagagatcagctacctaacgttgtatttggagttagcatttcgatatcaaaaagagcatttttcctctaaaaaagtagccattgttcatacgacaggaaaaggaacagcattaatgatccaaagacaaatcaaaaggatattggggagggatatacaaataacacatgtttcagaagaacaatatgaaaaagtagatctaaacaaatatttcgctgtttttacaacgattccgttaaaaaatgtaaatgaagagacaccggtgatccatttgactaatctttttgatgactcttggttaagggcacaatggcaaaaagcaaaaaaaaagcgattagccgggtttcattctactgtttttttctatcaaatatggaaagaaaaaaagacgtatcaagaatatttaaacaaattagtcgctcctttgatcagaggctattatgtggatgaagaatttgaaaaaaggatcttgaaaagagaatctcagcaaagcacatttgttaacaaagaatttgcttttcctcacacaaccaaccagctatctcaacacattgttttatcagtagggctaataactgatcaaggtttagcagaaacaggaggaaatggagttatttttttatttgccatacctgaagaaatgacggctgaagttgagaatgaattatttgagctatacgatatcctatttgaactcataaaaatgggaatagatgagtttattgaattagcaccgacacaagaatcatttttaaaactaatcaaaagtaaaggagagagacttcatgaatgatatgtattattcatagttttcgcagcttcagcttatgtgctgcaagcagttatcagttggaagcaactaaagcatttcaatcaaacatatagcgaactgcgaagaaaaggaaaagtagcgattggtaaacgacctgggaaaatccgttcaggcacgattgttatgctagctatagacgatcatgatcaagttttagaagtcagaaaaatgcaaggggttacatctttggcaaaatttcattcattacctgtctatgcgggtgaagatatccattacatcgatcgttaccatccctcagttcgagcggaagatcgtttgacacaagcagctttagaaaatgccagagaagtatacttacgaatagaggcaggaaatgaaaaaagtgaacaaccttcattgccttttattgctatgctcaataattttcggatatggaaaagtacgatcaaagaaaaaaggagtgacaaacgatggatatcataacaaaatttgctgagggatttatgaggctgttccaaacaggtgcagaaacattcataagctggatgacaggaatcgtaccagttgtcttgatgctgatggttgcaatgaatacgctgattgcttttttaggtgaagaccgagtaacgaaagtagccaaattatcagcgaaaaatccgcttactcgttaccttgtgttaccgttcttatctgcttttatgttgggaaatcctatgtcatttacaatggctcgtttccttccagaatactacaaaccaagctattatgctgctcaagctcaattttgtcatacgagcaatggtgtattcccccatattaatcctggagaattgtttgtatggatggggattgctcaagggatcgaaaccttagggctaaattcgatggagctggctatccgatacttgcttgtgggactgctgatgaactttattggtggttggataactgattttactactggatttgtatgcagacagcaaggaatcgttcttagcaaaaaagtagagctttcagttgattagagaaaggagagttttaaatgtatggtgatatcaagatcgtaagaggaaacggcgggtatggaggtcctttgattattaggccgacaaaagataaacacaagttcatctatgtcacaggtggaggtgagaggccaatgatcgtagataaaatagaagaactgacaggtatggagtctatcaatgggttcaaaacatcaatacctgatagtgaaatcgcgcttgcaatcgttgactgtggagggactcttagatgtggaatttatcctaaaaaagggataccaaccatcaatatcgttcccacaggaaaaagtggcccattagcacaatatatcactgaagatatttatgtttcagcagtagggttagaacaaatacagccactaatggaaactgatgataacaaagaaacagtaaatactgcatctccagataaaaagtacaaatatgatacttctaaaaagataaccgagcaaaaagcagagcagcaaaactggatagcaaaaattggaatgggcgcgggaaaagtagttgctacattcaatcaatcagcaagagaagcagtagatacgatgatccggacagtgatcccttttatggctttcgtttcccttttgattggtgtgatacaaggttctgggatcggtaatgtatttgctaacattatggcacctttagcaggaaatgcagttggattaacaatcattggctttatttgttcactgccatttttatctcctttgcttggtccaggggcagttattagccaagtgattggaacattgatcggtgtagagattgggaaaggaaatattcctccccaattagcattaccggcactatttgctatcaatactcaaaatgcatgtgattttattccagtcggtctaggtttggaagaagcaaaagctgagacagtagaagtaggtgtaccatcagttctttattcaagatttcttaacggcatcccacgagttatcattgcttgggtagcaagttttggattatatagctgagtttaggaggaacagagatgacgatctttgaaacggttgtaacagatgttggtatagaagcagaagtattcaggaaagaaaaaataatgattttatttggagatgaagcaccggaaacattaacagattattgttataagattgaattgaatcaggtaagaaaagaaataacttgtgatatgaagctctgttttgataaacaaatgtatgtaatcacagcagtaggagatgttgtccaaactaatttgaatgaattaggacatatcacgataaaatttgatggatctcatgagccggaacttccaggaacaatgtatgtagaagataaggaaatgccgcatttaagaaaggggacaatcattaaaatcgatcaagaggatcagaatgggggaaagctatatggaaatcatgcttgatacagcaaatacaaaaagtatttattcttgtcaacagtttttgaatttaacaggcgtaacaacaaatcctacaattctgaaaaaagaaggagcgtcaaacttcttctcgcatatgaaagaaatcaaaaaaataatcggacagattcctatccatattcagacaataggaagaacggaagaagaaatgatagaggatgctcgagttatcatagaagaactgggaaaagatacgtttatcaaggtgccggtgaatcaagcaggccttcaagcgatcaaaaagttgaaaaaagaaggttatttgattaccggtacagctatttacacagaattacaagggtatttagctattaataatggagcagattatattgcaccttattataacaggatgcaaaatcaaggcattgatgctatgaaagtgattgattcgttgcggactgagatcgaacgtacgcaaagaccaacaaaaatattagcagctagtttcaaaaattgtgaacaagtcactacagccattcgatctggagctcatgcgataacgttaggtaaagagctactagatcaagtattagagatgccctcgattgataaagcagtgaggggcttccaagaagattgggtgcaaactttccaagcagaaacgattggtgaactaaaaaaggtcgctgattacttctgaatcaatttctccataaaataaacgatagccttctcgaaaactcgagaaggctatctgacgattcaatattcattaatttaaagtttgggtgactattactaactattacttatttctcatttaaacgatgtattccctaacctctaatacatccttgtaactctgaagttacgccagttttgaataaatttcataaaaacaaatgaaaagtgtcgcataaaaatatctttcgtgtttctctagtataacagaataagaagaacaagtccagaagggatatttttagtcttttttaaaataacttttcagtcgagtttgagtttatgatagttgtttttgaagcgatacggcaagtgaaaaaatagggaagcatgaaagaatctacttaatggcgcattgattcatgtgatagaaataaaaaacttttttaaattatatcctcatgattgtaacaaatccagtgatttgttttggtacaaataaaaaaagaccccgatgaagttgtggcaaaagtggtttgcctcaaaaataagaaggaatttccaaaaatcacttctcaaattttgccacatccccaattgggtcaaatttgtttatttgaatatattttttacataaggatctttaatagttacattgtcttttttcatcactttacggattgttttatccatgaattccgtatcaagagtttttgcttcggtagcaattttttctagctcagatttgtatttgtctttattagaacctttatcctgtttttttaccatttttactagataatagctttgctgataagtcgttggatctgttacaggaatgatatcagaaacttccccgttttttagtttaaatgctgctttttttacttcagtaggaatctctggattggttgaatcaaaattcatttttccatcagtttcctttaatgttttattttttccataagcttgaacaagcttggagaaattttccccttcatttgcttctttttttgctttatctgcttcttctttagtcgaaaatagaatgatctgtgtactaacttctggatagaattctttccaagcagtgtctagatctttatctgttaattttacattggctttcaaaccgtattggaaagccagcatctgtttaaagagtttcttatatgtctcttctgtttggccaactgcttttaattgttccttgtagtttggaccgagttttttgatttgttcattatattcttttgttacttcctttgaagaaatctcttttccgtatacatcatcaaatgctttgaagacaatcattttttttaatagtgtttgattatttgatttaacttttgggttatcataaaaatcctgaactgtaagtgttccacctttaaacgttgcaatcgtttcattggacttgctacaacctgagaatagtaaaattgcacatgctgaaaggcacataattagtagttgttttttcaaaaaatttcccatcctttccttattaaaaacagtctaacagaagaattagggagacagtctttcattttcgtaaggttgctgtagatattcttagttcgtaaaaatctattctctctatgatggagaacatttacatagttttcacgagacaagaaagaaaagggttgttaaacttaatataaaggagggatgaaagatgatcaggattattcggttgattggatctgttttaatagtcttagttggttttgttttaggaattcttgtcaataatgcacttgcggatatgtttattggaaatagtgaatggattggagcaattgccggtacggtcggacatttagctgtttttttactagctttatttcttgctagtaaggtcgaaggaaaaagaatagaagattatggtgtttctgttcgaggaaaagactgggggtatttagcgggaggtctcgttgttggaattggagtgtttctgcttattactagtccattatatttgacgggggcgtatcggttagattcaggaaacgcaaacattgtgccgctgataacgagttttattttatttattgcagtgggggcatcagaagagcttttattccgtggcttttttcagcatcagatgcttagatttggtccgttaatagcaatgattggatctgctgcattatttgctcttttgcacggattgaatcctaacatgacatttctggcagttttcaatatctttttagcaggttgctttttcagcgcacttatctacagtacaggaagtttatttacggctattggtgctcatattacttggaattggacacaaggagctattttgggtataccagtcagcggaacgcaagaacaaggttttttctccactctgatccaatcgcaaaatacaataattactgggggaaactttggggctgaagcatctatatcaactacattattcttgttagtcttgattgttggtttgttactctatgcatataaaacaaagcggatgaagaaatacactgctgtttatcaataaaagatgaagaaagcaaggctgatatcggtcttgcttttttaagtctgtcattgattaaacgaaaaagtaaacaaattcaagcgaatacacgacatcttttgttagattttcacaactgactgtcgtgttctcatcattttcattttatataattcctttatcaaatagaaggtaattatatggagagtgatagaaatgaagaaaacagcgaccgtattatttgttattcttgggctgagtataattgcagcaatgattggaatcagtacttctgcaaatgaacgggcaaatgagaatctttcatttactgtgaaaactgatcggattgtttatgacatgacacaacaagtcattactattccagtcaaaccaaacaaaagcgtgaatgctagtgatgtacatgctgttctaacatatggttgggatggtaatggaagttcagaaaaagttattggggaagtttatttaaaagacgtacaatggaccgctggtattgagtatacaataatgatttctgcagaactatcgattgatgagatcaagagtaaagataaagttgatttgattgttttttatgatggacagatgacgattacggagaatttgaaaccaagcagttggacagttgttggaccgccaagcagtacggatagcacaagtagtgaaagcagtacagaaaacacgagcggtgaaagcagtacagagagtacgagcagtgaaagtagcacagaaaacacgagcagcgaaagcagtacggagagtacgagtagtgaaagtagcacaggaagcacgagcagcgaaagcagtacggagagtacgagtagtgaaagtagcacagaaaacacgagtagtgagagtagcacaggaagcacgagcagcgaaagcagtacagaaagtacgagcagtgaaagtagcacagaaaacacgagtagtgaaagtagcacaggaagcatgagtagtgagagtagcacaggaagcacgagcagcgaaagcagtacggatagcacaagcagtgaaagcagcacaggaaaagtaaataatgaacttgatttggtacctatcataccaactaaggaacaaaagagaaatgcagggagcaacctaaaaagtgtgctaaaacagcctgattttgtttctcgtggaattgatcatcaagaaaaagcgaaagaaacagataatagaaaaagcgatttaccagaaactggtagtagaaccttgaacaagctaattacatggatgggtgtgttactcattttgattgtaggagcaagctattttcgttctctcttccatcgagtgaaataaagaataaaagcaacagatctaaaattgaataaaacgatagatttttgagtgaatatttcattcgagagtgctgtattgcctggcgaagttgtagctttgccaggtctatttttgtttactaacatatttgagaaacaggaaataacaggaacacaaatggaaaataagagcaagaataattgacaatgcacactgcgcatggtagtatctctgaaaaatcagtaacgaatctatttgtacgttattcatgtagctgtcggaataagtctaaataatagataaaaaggagtatgtactttgtttgaagaatttattgatatcaatgaaaggcaagtatatcaatttttgaactattgttatgaaagagacgagaaattatatgtggtgaaggatatcgctttagatctaaactacaccctggctaagatgaattcggtgattcaacaagcagaatcgttttgcgaaaggtatccagaatataaattatcttttctttcagaaaacaagatgataaaagtcgagttttcttctcagtttttactgagtaaagtttattctatacttttagagggaacgattggttatattttactggattcactttacaaaggtacttatcaatccttagaaaatcttagtcaaaaaattatataagtttgcgtacgattcaaagaaaattaagagaacttaatactattttgaaaaactatcatttatcttgcagcttgaaaaaaggtaatccgatagaaggagaagaataccgtatccgatacttttttcacttgatgtattggcagtcattcgacgaaaatcattctgatatattatcaagtataaaaaataaacgtcaactattagaaaaatttgcgaaacatgcgccatatacgcgtagtatagatagaaagaaatggatcagcctactaagaatttcgttgcaacgaatgaaacaaggccactcgattacgtatgtcccagaagagatgaacaaatttgtgcatccattgataacaaaagaagagtttacgcattacatactagagcctttttttgaagcaaacttctggtcgatgaatcacatcactccaacagagcaagcttacctttattttatgtttggtgtaatgaacacctatttggaagaagatttgttggatactccagataaagtacaagaaagttggggctggattgaatcgtctattgtagaaaattttgaaaaaaacttcaagatttgttttacaacttcagaaaaaaattatctatatgtcaatttggcaatgatccatttgtattcaagggtttttgggacaaaaaagaaggtggatgcttttggaaaatcagcagaagacagagattttcagcatatatttccagtgatgtatccaatcatgcaacagttttttagtggggtagctcgcagaattccagagcttaatacttattatgaaaagaacagacggttgatttttcaatactgtatgttagtcagggatatttttataaaacacgaacaacctgtcatattctatattcaatcaaagtatggtaaaacacaggaattatgggcaaagaaaaggatattatctatgactgaacgcccaataaaatatagtgcatccgctgatcagttacctgatattgtcattagcgattatcctatcgacaaaaaggcatatgatcaaacgaatacacagatattttactggaatggacaacctacaaaaaatgattgggcgcgtctgaaagctgaaatcataaaaatcaggaatgagaaaaatagatccatattggaaaaattggatttcgttaattaagaaaagcagattgtttatgccaaaattaagacattgcaaaaagattattttctttaaaatcgacaagatgaccagaaagcaagagttcgttgagctcttgctttcttttagttttaggaaggaacatcctgattttatcttcgctaaatccagtcaaaagttttgcagattggtcgtagataatcggttttttcaataaagaaggggatgtacgaatctcaatatatagttcactcaaactgagttcatctattctgtgaacaagatttttataactaatagaatgagtagagagcatttcggtcacgccgttgtttgtcaattttagtaagtggataaattcatttttggttagtggttgacgaattaagttctgttcgataaacggtatatcatggacgataagccaacgttttgcgcgtcttgaagacgagcagccagaacctgtatacaatttaatcatcatacattcctccaatagctaagtatttatgaaataataacatgaagaaatagtcgaaaagtgccatttagaggtgtaaaataagaaaatgttgtcacgtataatggaactagctagataagaaatactattaaatcaagaaaaaagaaagaaggcacaagtatgtcaaacacagccgacgcaatagtagtgatcgatttacaaaaaggggtatgttttgattcttcgccgatacacgaattagaaacagtgacagcattagtgaataaaagaatcaaaacatacgaaacgattgggaaaccagttattttcgttcaacacgaagatgctcaattagtgccacaaacaaaaccatgggagctattgtcggaattatctattcctgagcacagttattttgtgagaaaaacccatgcgaattcattttataagactaatttgagtgttttattaactgaattggactgtcattcgatcgaattatgtggggcacaagcagagtattgtatagatacgactgtgaagtttgctcatggattaggataccagcttatgatgtgtagaggagcaacgacaacttatgataatccttttatgaaagcaaaggaaacaatcgctttttacgagaaaatttgggataaacgatttctgacatttttggagcaataagttgtttcttcgtttaaaaaaagcagaatggatactggtttatccattctgctttattacgtaaaatgagaaaataatcctgttctatttttatgggataaaccatttattttttgtataaaaaatgtttgcgtttacatataattctcctagaaacataaaaaggagtgaatagcttgagaacaaaacaagtattaaagggagcgttggtcatcttatttgctgtaagtacaagcgtcccgcaatggacagtatatggagagagcatttcttccgaatcggaatctcgggaggtagaaaccacagaaactactgatgctggaaatgaaacgaaatcgagtacttcacaaacagaaacaaatactgaaacaacggctgtgacatctgttactagcacagatcaagaaacgaccgctaccacagataaccaacaaacagaagaagcaacagctacaaaaatgtcaaacgacgaatcctcttctgctaaagtaagtgacaaagagaatgggacagaaaatgatgatatcggtaaaggtgaaaatttcaatggtaaagaatatttgaattacttcggtaaacagatgacagaaatacttaatggaccaacagaagacatcaagtcaaaattaatagagttattagtcactgagcttgctgttaatgattatggtgtagataaagagattatcaaacatctgattgctacttatctattgtacgatatcgcttttgcaaaaaacagtgtgttgatgtcgatgcttggaggtacagatgatgggacaacgcctacagaaaacacaggcttctatccaaatacaaaacaacttcatcaaactgtactaaacaaacaagatggcaaaatgatggatgtatatgcatattatgtcgatcaaggttcagataaaacagtcatgatccatggcggatttcgagggaattggaataacgggatcgttacagaagaatacaatgatttttataaggccgggtataatttattatttgttgattccagagcgactggtaatagcggaggcgattatgtgacctatggacaatatgagtcagatgacgtcctttactggataaatcaagaagttcgagagcggccatctcaaaagattttactttatggtggttcgatgggagcagctacgatgatgtctgtattagcgaaagatattcctgtcaatgtcaaaggaattattgaaaattgcggatttgcatcaattgatgaacaactacgttttacgtacagccagacagtagcccccgcactaccggatgccataaaaaatcagttagacatcattggggatcaagagcatgaagatttatttatgggccttttgaaacaatactattttgatcaggagatgcatttggatacaaaagctgctctacctacgattggaatgtcagattcattgcctaaattgattatccatggaacagcagatgatgtagtacctgtgtctaacgcgcaaaaattatatgagttatcaggagggtataaagatcttttattagtagaaggagcagggcatggaaaggcacaggaagttgaccatgctgcctacacgaaacatgtaacggactttttgaaagtagtgttccatgatcagataaacgtaaagtatgtggatgaaaacaataaaagtctactcaaagaccaggacgaaatccagctttacggagcttatggagaaaattatatgacagagcaaaagacattcgaaggatacgaattagcaaatgttgaaggaccgactgaagggatttttaatgagacgataccaactattattttctattacaaaaaaatcccagtagctccaccaaaaaagcaagatccgacagagaatgcagacaataagggaaagaatgaacctcgagaggatcaatcaagtgatgatacgcaaccgattcagatgacagtgaaagtacaaaaaaagacagatgcaaaaaaaagaatgttgccgaaaactggagaaaagaaacattcgcttctcatttattcaggtggatttttatctgttagcacgattatcacatggatttggcgaagaaagagagggtaaatgaatgaaatggttcaagcgaatagtgattgcagtaccagttatcatcgtagctattttagtcactgtatttttgattaatcaaatcacaccaaagccgattagcttgcttgttagaaaacaatttgacacaagtgaaaaagaacaagtatatgcccgaccagatgatttccagcaaaaaatcgaacaaatcgatataaaaaaagaaatatcctatccttcaaagtacaaaaataataatatggatatctacacaccgaaagtggaaaagaaaaaattaccgattcttttctggatgcatggaggcgcatatgtaggaggggataaaaatgattgtcgtgattatttggaatatctatgttcagacacgcagcaaatcatcgtaaatatagattatgaacgatcaccggaagcaaaacatcctacaccagttatccaattgaacgaagccattcaagcagctaaaaaagagataaaagatcaagcagattggtcgaatatttcgattggtggagattcggcaggtgcacaaattagtggagaatatttgttagcacttcaaaatgaagaaattaaaaaagctgatcatcttgatccgactttggagaacaagcagattacgaagtttatttctttgtctggtctgttggatccttctgcatttactcaagtaagtgataaaatctctagctttctttatgaaaaatgtggatgggcttactttgataataaggactttgaacaatcagagaaggtcaaaagtttagccttggtcagacatgcggatcgttggacgcaaaacacattcttaacggatggaaatacaaatacgtttacgaaacaaatggaagaagtaacttctgtatttgagaaagcgggggtgaaagtcacaaaagtagattatgcggagaaaaatgctgttttgaaccatgaatatcagtttgatttcagcaataaacaagcgcaagaaacatatcaaaagttagtaatgtttttcaaggagtaaagtcttatgatgcaaaagaggttgtaatctgtcacttagctccaagtcacaaggagcaatttcaataaacaagcttttcgtggtttatgaatattgtaacttgtgactgaggagttagagatggcaaggggcaccttttattcgaaatttgggaatatcacacgattattgtcacgatctcttttacgtaaattttataagtcagatttgttgttttgatcgtttaaaaaaagcaacaaatccgaagcctgcggaggcaagaagggacaaaaagccgagtggtaagcaaaagaatgctggttccactaatattccgttgttattgatataaggctgggaacaaagatgaatagcaaataaaatcaatgcactagcgaaaaaaagcaaagaaatatggatagctttcataagcagcacctccttttttataattgtatgataaatagattaagaatctataaatgtgacaagtttgttaggatgtgaataaaatgatcatctagcgaacttgaaacaaagatggctaatgataagcaattaatgattcagcaatcagataggtacaaagtttaccatcatacgtctagaccaataatagaaaatatgggaatataatagaaaagatttaggatacccccaaaagaatttccccaaaaattcgatgtatcctaaacttttttattttacataacaatcatatcaactgtgaaataaaattacaaatgataacctaaaatgaggccaaaagccagtgttatcaaggaaatacttaatttaccaaaattttttttaattttttagaaaataagaaacaaaaataataaaaaaaagaaaagataaattttttactactgtatactaactttgttatcgcatctaacaagtaactcgaataataccaatacaaccttctccaaagatgcgatgacatacgttctaacccaccgactattgatgttctgtaccacccttgcagaaccaaaaaagccactaccaaatatttggtagtggctttttttgttttatggatttttcgctttttctgttatggtgctattctttgatttcagaaatagtatgtcgaactttagcgatagaacgacgtgattctttttcgttgtaaaacatcaaaatcacatatagagagtccaaaatgcttagttgagaaatacgggaagctaaagcttcagatcggaattctgtttcttcagaaatagaaataaaaacgacatcgccaagtttagcaagggaagaattagcttggctagtaataacgattgtttttgctccagtttttcttacggtttcagcaatatggattgtttcttttgattgccctgtgtgagaaatcaaaacagcacagtctttttccgtcaataaagaagcttccatcaattgaatatggtaatccgtgctgtgagaagttgcgataggggaacgcaaaaatttatgataagcgtcagttgctacaatctctgaaccgccaacaccgaaaaaatagacacgtttagattcattgataatagtagccgctttttttagatccttttgttgtaacaacttttttgtgtcatttaaagttgaaatactagactcgaacaccttttgcgccatagtgagctcagtatctgttttctgaatattttcgtggatagaaatagcagatagatcattttcttggatcaacatggccattttaaaatctttaaatccattataaccaagtttttttgtaaattgaaaaaaagtagagtcagcaatgcccagttcacttgctaaattgctaataggactatgacttactttgcttggattttctaaaatataatcggcgatagcctgttcttttgggctgaagtcgttgtacattgttttgatttgtagtcttatggagacgctcatgagaattcctccttttcataataagattatcattttttccgttctcattaatgttaaagatacaaggagagtaggaaaaaatcaaacaaaaaatatttttgtaaaatctatttacaaaaaaatattttttgtataatgagggtataagaaatggaggcgctatcatggaaattggtgtaattggtttgggaaaaatgggattgaatttagctttaaacttaaaagagcaccatcacaaagtacaaggactcgacatttcaagtacagctgttagtcaggcaagagaaaatgacattcctgcttatcaagagatctctgaatttctagctacttttgagcagaaaaaaatcatctggttaatgcttcctgctggagagataaccgaaaacatgttaagaaaactttttccaaaactcggaccaggagacattattattgaaggcggaaactcttattataaagattcaatccgtcgagcagaagagtttcagaaaaatgaaatcggttacttggattgtgggacttctggaggaatcgaaggagcacgacatcaagcctgcttaatgattggaggagataaagaaacttttctatccgtggaacaattattcaaagatgtagcaattgaaagaggatatctgtatgctggtgcatccggaagcggacacttcttgaaaatgatccataatggaatcgaatatggaatgatgcaagcaatcggtgaaggattccaacttgtacaaaaaagtgagtatgcttttgacttggaacaagtcgcacgtgtttggaatcatggttcggtgattcgcggctggctgatggaaatcatggaagatcagttaaacgaacatcccaatttaagtaattatcggggaatcgtttctgcatcaggtgaagcaaaatggacggttgaaacagcgctagaaatggctgttccagttccagtaattgcaactagtttgttcatgaggaatctttcacaggaagaagatagtttttcagcaaaagtagtttcagcactaagaaatgggtttggcggacatgaaatagttgaaaagggtgagtaaaatgccagattatcatatagcaatcgttaattccagcagtttcggaagagtctttccacaccacttggaaagattaaagtcagttggagacgttcatttctttactgttgatcaagagattccaggaaaagaactagcggagttacttaaaggattcaatatcattattacaagtgttacgccattttttcgacgagatttttttgaaaacaaagatgaactgctattgatttcccgacatggtattggttacaacaatattgatttaaaagcagcaaaagaacaccagacaatcgtatctatcatacctgctttagttgaacgaaatgctgtagcagaaaataatataactaatttgttgtccatgcttcgacgcacgacacaagcacaagcaagagtcaaggacgatcgatgggaagatcgggcggagttcgtcggtaggacgctgtttaacaaaacagttggtgtgattggtgcaggaaataccggaagcggagtaatcgaaattttgcgtaacggttttcgctgtgatgttctagcttatgatccttacaaatcagatttatacatcgaaagctttggtgcaaaaaaagtagaacttcaagaattactggaacaatcagatatcatttgtttatgtgcgaatttgacagaagagaactatcacatgatttctgataaagaagtcgatcagatgaaagaaaatgtttatctatctaatagtgcaagaggcgctctagttgatgaagaagcgatgattaatggtctgaaaagcggaaagatcgcaggatatgccacagatgttttagaagaagaaccgggacgtcaagatcatccgtatttagcgtttgaacaagtagtgattacgccacatatatcggcctacacaagggaatgtttagaagcaatgggtgaaaaatgtgtcagagatgtcgaacagatcagtcagcaccttcttcctgaacgttctgtccagacaaagagcaactatataaaaggatgatgaagaaaatggtgaacggtttaaaagtgaaaacaggccctcaattttatttatatgaagaaggtggtatttcaaaagtttctgatctcttgaaatcatacggcgcgaaaagagtactggtcacccacggaacggtatcatgggaaaaggcgctacctaaattagtatttttgaatgacgaaacgattcaatttttttatcatcgttattctggagaatgtagttatgctgaagccagacgaatagctacaatcatcaaaaaaaatgaaatcgatttcgtagttggcgttggcggaggaaaactgaccgatctagtgggttatagtgccaatcttgcaagaatcgatttcggcgtcatccctactttagctagtaattgtgctccatggacacctcttgctgtcatgtataaggagaatggacaagcagaagggaaaacagaacacttttacagacaagctgctttttttataacagatccccaattagtgattgattcccctgttccatatttcattgccgggttagcagatacactagcaaaatggtatgaatctgagctcatcttagaacaagattttttgcaagatgaatcatttttgaagctagcacaagatactgcgaagatctgcaaagaagagattttgaatcattctgctaaagcaatccaagatatggcacaaagaaaactgacatcggagttcaaacagctttcagagattatctttgctgttgctggtttagttggaggattaggagataaatacgcaagaaatgcggcagcacatgctatgcatgacgctatcagtaaatatattccggaaagccatcgttttctacatggagaaaaagtagcgtatgggattttctatcaactggcactagaaggtcgctgggaaaaaatagacgagttatatcctttgtatcgggaattagaactgccggtttctctagaacaaatgggattatttccgaaagataaacagataatagataaaatggctgaatttattgattcgaaagagaaagtgcatttgattcctatagaggtaacacagaaatcactgatacagtcaatgatggaactggaaggttatatcagaaagatctgaaggaggaggacacatggaaacattaagtgtagtacaaagtttgttgattgctttatgggtagccgcggttatgtcccgctggttaggtggaggagccacgttgaccttacgtttttctcctttgatgactggattagtcgtcgggttgatcatgggggaagttgcacaagcgatgattgttacagccgctttgcaaatgatttatatgggggttttttctccaggaggatcaatgccagctgaaccatctattgcagcagctatcgcagtaccagtcgcattattaggggatctgtcgccagaagcagcgattgccgttgcggtgccagtcggattgctcggaagttacttgtatcagtttcgttttttcatcaatacttttttaggtaaatatacagacaaagctgtagaagatttgaatacaaaagctatggcccgatcaattattctttatccaacggttgcctcatttttattattcgttccgcttgttttcattgctttatatttaggggcgccattgatcgctgatgtaatcaaagctttagagggaacagtcgttatccacattcttgaagtagtaggtggagggttagcggcaatcggtatcgcgacaactgtatacgttatcggtcgaaaagattatctggtctttttcttccttgcttattttatgagtgttgttttgaaatctttagatattacgatggttacttatgccatttttgggattattatcgctttgatctttgtccagtcgcaaaaagggaaacaagtacagcctgccacaagcaataacaattcagcatcttttgatgacgaagatgactatgatgacggattttaatttaggaggaatgggaaatggctgaaataatggataatcaaacaggtgctcctgaagaaatcacgaaaaaagatgtaacaaaagcctatctgagatggcattttgcaaacgaaattcctcactcttttgaacgttacttggcgccatcactactatacggaatgatgccaatcttgaaaaaactttataaagatgaagactctttaaaagcagcatataaacggcagttactgttcttcaacactcaattaagctggggtggcggtgtgattactggcctaatgtcttctatggaacagcaaagagcagaagaagagtatgaagaaaaagagatcttgatgcaggatgacttgatgtataacacgaaagcgggattgatgggggcactagcaggaatcggagatgcaatcgattcaggaaccgtccaatatatttttatcgcaatcgcggtaccttgggcacaacagggaagtcctttaggcgcactttttccttttatctgctttgggttgtatcaggttttactaggggtatttttcgcaagacaagctttcactatgggccgtaatgctacaggcctaatgcaaaacactggtgttcagacagcgattgaaatgctatcagttttagggttgtttatgatgggggtgcttgcgggaaactatgtaaaagtagaatcttcattgaaatttgcgatatccggacgtgagtttgttatccaggaaattcttgatcaaatcgtgcctgggatattacctttagctgtcgtaatgggtgtgtacttgttctatacgaaaaaaggattgaaagtcacacaagcattattatggctgactggaatattaattgtgctagcaggaatcggtattttataaaaagaagggaacgtgaataagatgggtgtagtcaatttagcgcgtgtggatgagcgtttgatccatgggcaagtaatggtaacgttatctcaaaaaagtggagtgaattccatttttgttgtagacgaagttgtagcaaaagataaatttatgagagatctttacaaaaatgcaggaagccgtacaggacaaaaaacaattgtcattacaccagagaaagctaaattctattgggatgaatatcaatttaaagaatacaattgtattttgatcgcaaaaacagtccaaacgatttacgacttagtaaaacacggaatccccatggaagaattgaatattggagggattgctcaaaaaaatcctgatacagatcttttagtgacgaaatctgtttatttaaataaatcagatgctgaaaaattgaaagaaatgaatgaacaatatggcgtaaagaatatttattttcaagccactccatctgcacctaaaacaggattaaaagatgtattgaacaagtttgatttgtcataaacaaatgcttagaaaaaagataaagagggcgaaaaaatgaagaagaacgagctgtttcgtgattgggaatttcgttatcgctatatttaccgtaagcgccgtacaaaaaagagtaaacagcgttttctttcagcattagtatcagatatttacagtatgagaacagatgtgacagtcattgcttacgatacgctagcctaccgatcaaaaaatatttatgttggagatatcgaaaaagcagagaaagttatctgtacttattacgatacacccgttcatgcattaggaagttatttcatgtttgattggaaagaccaaaggaaaaaaacaatctactctatattattgtccttcattttgttgttcagtttaggttggtggggaatgatgatatataacaaaaatcctcatcacgtattcgatctgctatccgtacaaacaggtatcactgtactagcatttgggagctactttttcttattgggaaaagcagctcgcggatggcctagcagacaaacttttattcgaaatacttcatccatattaacgatgctagaaatgatccgtacgattgatgatccgagtgtagcgtatgcgtttgttgatgaaggctgttatggagaaaagggcttagacagcgtgagatcgggtatgaaaaaagaggctattcttttttatctagactctgttggggcagatacaccgctacagttttcgggaaattatttttcaaataaagaacagtggctgaaacaagttgataagttgaaagaaaaaaacgtcaattatatttttagtgcaagaaaaaagcaagcgcagttcttctatttgaccaaaacagatttacgagggaaaacatttaattggcaaaatgccaatcagattattgctctttttcgataagtaaaaagtgcaaaacaaggagtgagaagactaatgttggaaatcatgatcgttacacatggtaagttgagcgaaggactgaaagatgcggcggaagtaattgtcgggacatcgagccatattgaaacaatgtgcttagagtctggggaggacatccaaacattcggagagaaggtcaaagaaaaattaactatgatcaacacagcagaacccatgctagtatttgttgatctaattagcgcaagtccgtacaatcaagcgctcttggcagtcaatgaactgactgaagaaaagaaagcagccacttatgtcatagggggcgtgaatctgccaatgttgttagaagcaatcaatcatcagatgcttcacacaccgatagaagaagcggtggaacaaattgtcaaacaaggaaaagataatttaactgtttggcatgcttcagcggaagaaaaaaaattagatgaggacgatttttagaaggaaggctgaaaagatgaagtggggatttagatggtatggtgaaaaaggggattcgatcccattaaaatatgttcgccaaataccgggaataaatgggataattggaactttgctgactaaaatgcctggagatgtttgggagatttcagaaattgaggagttgaaagcatctgttgagagccaaggactggaactgcttggaattgaaagtgtagcgatccacgatgcaatcaaggcagggacagatgaacgagattactatattgataactatatacgaacaatcaaaaacttgtctcgatgtggggttcgattgatttgttatagcttcaaaccaatttttggatgggcgaaaactgatttgtttaatgaaaacaacgatggaagctattctcttttatacgatcagaaaatcgtcgatcagatggagccaggagaaatgtatcaattgatacacagccagtcaaagggattcaaattgccgggttgggaagaagaacggttgaaaaaattcgctcagctggaaaaactgtatgaaggaatgaccgaagaagaattatttgaaaatctgacttattttttagaaaaagtgattccagtgtgcgaaaaagcagatgtaaaaatggctatccatccagatgatccgccatgggaactttttggttttcctagagtgacgaaaaatcttggcgacttgaagaaaattctaaatgcagtagattctccatataatggactaacgctgtgcacaggatctttaggggcaaatccggaaaacgatttagttgaaatcatccatgaggtaggttcgcgcatccattttgtccacttcagaaacgtggagtttttaggagaaagaaagttcaaagaaacggcacatccctctacagaaggctcccttgatatgtatcatattatgaaagcgttggtgcaagaagggttcgacggtcctatacgccctgatcatggtagaaccgtgtggggtgaagtggctatgcctggatatggcctgtatgatcgtgcaatgggactcacttacatgcaaggtctatatgaggcgataagtaaggaaaaaccactgggagagcattatgaataaaatcaagctcttcatctttgatatggatggccttttattagaaactggacgtttagcttatcgtgcttatgtaaaatcagcacaaaagtatgattatgaaatgcgtaaggaagtctattatttactaactggccaaacagaaatggcgataagagaacaaatgggcattttgtacggagaagatgttccatatatcaaatggcgagaagcaatcaatcaatataaagaaaaaatcgtgaaagaagataagagagtatatacgaaaaaaggagcagaagaaattttatcttttgcaaaagaaagaggaatccatacaatcgtggcttcgtctaatacacgggtaaaagtagaaatgtatttaaaaatggaaaatctatatgccttgtttgatcaaatcatctcaggggatgatgtaaaaaaaggaaagccggaaccagagatctttttgaaagcttgttcaaaaatgaatattcctccaagtgaagcacttgtatttgaagactcgattgcagggatcgaagcagcaaggcgagcgggcattttgtcttttctcatcaaagatcatttgatagggttgcccgatcataatgggaagcataagttgaaagtagatgtaagtttatatgaatccaataaagcagactatgaattttatgacctgcatcaagcaaaacgatttttagaaagtaaagggttgtatctctaataaagaggactattttctagtcctctttatttattgtcctgcacgactgagggaacagatgaaaaagaagtaattttttattttgaagtatctaccttatttgtagtgaacaatttagaacaaacacaaaacgcatctactgttatctaccagtagatgcgtttaaagagaagaacgagaatcgtccatatgagggtttccactccttatgcagatttttttaattcttgcactgcttgttcgatcgtaacacctgtcgctacatgattggtattttctttgtcaaaaacgacaaatagattcaaatctgtatccaaggttactcgatattgtatatctttgttatagaatgtcatagccattctcctttctttaaatacttgctgaaaggcaacgaacgcgttgataacgaaattccatttataagtataccaccaattgaaaggttttcatagttaagaaattttaaagtcaaaagttgcagataaaagcaaataaacaagaaaacaaaaagtgaatcaatcgcggttattcaactttttcttcgattcgaagacaatagaagacaatgaattttatatttcattgcattatccttgtgttattataaaaagcatgatatattaaatgagtaatctattttgaaacgtaatttgagcgatatatctacatagataaaactccttttgcctatcaaatatttattgcaacgaaaaaacgtacattgatacgtatcaggaggaatttatttatgaataacggtacagtaaaatggttcaacgcagacaaaggttttggctttatcactggtgaagatggaaatgatgtatttgcacatttttcagctatccaaggtgacggcttcaaaactttagaagaaggccaagcagtgtcttacgatgttgaagatggtcaacgtggccctcaagcaacaaacattgttaaagcttaataaaaattgacttttaaccgtcttttcgaaagaaaagacggtttttttgtacgaaaaaattcattggtcgttgaatgggctgaatagtagtgtataaaacaattttgtggagcgtgaagcttttatggtagaggaaaatacgaataaagtgatgttgataaaaagattcctatcttgaatatgaatcgagatgtcttgaaaatgaatgagtttgaccaatcattatcctatcgaaatttacagtttcgttcgattggtctgtcaattaatgaaaaagtaaaaaagaatatgttctaggaagagggcggcacatctaaatttttaagtaacggacagttcaaatatcaagcattgaaagaggctatcctactgtttgaaggaatacgaatatataaaaacgacaaagaggaaaaagtagttcattaaatcccttcaagtgatgaaagaatgagatctaataaaacctgatctttcatctgtttttttaataacgtaataatttttttattttttgtgctttcgccgttattgtagagtgatttagcattcttatttttaaaaataactgtgttatatattaaaaaaggcataatagttataagcttttttaaagaatatttagaaattattaattttcgtctgaaaacaaaaaaagaaagcgttattattttagtctattttcaggggggtaaccttatgataaaaaaactatttttactatcaatattaacgctagcaatggcaggttgttctgactctggcttagcaactgaactgatcacaaaatcaactgaagccacgacagaggagttaaaatgtggaaacgatcacagtgactacagaggcttaaatcgacgatgcatgggaatattaggcagaagcaattgtaagcatcgatgtagtaatcgaagaaggtgtagaagaagcaacagaaaaatcaaaagaaagatcaaaagaagcaatctgtgctgtgcatcgtatacagacgtcgaagatgcggtacttttaaaccacgtcaggagatgttcatttatgtctagggaagttggcgatgaaccaaaactagagtacgcttttagttttgcacgtgaggatgaagataaccctaaaacttacgacattttagcttgatctaagatggttaaagctttttaatgaagtaagaggagatagaaggcttttctagttatattaggtaagataaattcctttttgctccaaatttgctaaacattctgctagataaacttcatcgtgttccggataaatcggcacgttgcgctctacagtaggtaaatcaaaaaatgcttcgcatgatttgccacgatacataggatttttccactctggtgctgggctgtaaccacgtttttccatttcatccatgacaagctgatgatattggaataatctataaggagaatagtgaaaaacataatccacagtagcatgtttctttccccagccatttcctcttaatgcacagcattcccgatgttgtcctaaaagctgttgacgaggaagctttgaaatcaatttttcatgccataatcgcatagaaatgtctcctttatatatagattgttaaccttagacgttaaatgaaaaaaccagcaccaaggctggaaaaaatcacttcagtttgcttgctgtttctgagcgaccaattaggtaatcaacggaaatatcgtaaaagtcagcgatatagattaattcaatgatgcttggaatttcttctccttcttcgtacttacgatatttgaataaaggaatacttaacgcgctagaaacagctacttgagataaagatcggccagttcttaagaaattcagacgacaacgtaaagtatccagtaaaatagcttcttcgatactcatttaatcacctttcattatagtagaatagttataatgactatagaaagctacacatgcaatcaatagtactcaatgttttttatttaaacgtatcaaataaagaatgacgatcaataaagacaaaaccagtcctgataattcttctataaaaacactatcgggttcaaagtagttgtaattaaaaactttccacataaagtagatagccggaagagtcaaaatagctaaataaaaccgttctttgttccaattcataagataaacaatacttgcgaccagtgcgaccgcaggcacccaaaacaaaactctcaccaacgtaatcatgtaacggactcctcaatgattcatataataaaagataacatgttattgcatacatcacaaatgaaatgctaggaaaataaaagaagaatagatcaatgaaaaatgaaaaagcagaacagttttctgctgataagcaggaactgttccgctgaatgtgtcttatctatcgagaaaaaatcaatggattgatatctaagtaattcaatacatataaaaagaggacgatcgcattcactaaaaaggaaagaatgatgatcccatagcgaatggaaacatatttaacaaatacttttgtttgaatacgggcatatctttttcctttatagctgagcatcatgacaagaagcaaaagggtaatcacaccttgaaaaatcattccaataaacagaattcctgaggtttgataatttaattggagaaaataagctgctgccgcaactaaatcgaataaaatcgcaataaatggcaaaataatcactcctaacattgagaataaataaaagaataacattttttctaaaataagcaaataaaaattaaagtaacaaaatagttatgacacaagtaaaagaaataagaataacaatattattttacttatattttgaaacttgtgagagtttgtcattcgtgctatagttgaaaagtaacaaaaataaattttatttatgatgtacctttagctcagttggttagagcagacggctcataaccgtccggtcgtaggttcgagtcctacaaggtacataagaggttgtgaaaaagctgccctgcatcaagtaataagaacagccaagtaaaaacagcttcttatgtttttacttggctgttcttattactgcagatgcaagcttttgaacaccatttaagaaagaggtcgtgagcctgccgtttcactctgtgtcataaaaaagccaatctactttgatagaaaaagcacgtaggactaaaacagttctgcgtgctttttttattgtgtgttaaatatcgtaaatgaagatagatatttttatgattcgacgatagagacgttgaaatctttcaacagctctaaagcggattctccgtgttttctactggagactaacattggatcaacaaaaaagtctgcttcaggaaaagcactctgcaggcctatcagattagagagtacacacaagtttgtttcaatcccgactacttcgatctctttttgttcttctttgctttcaaataaagtttcctggatttcagctaaagtttcaggtggaatcgtaaagtaatactttttaatcactcgttcattttcttgtggagaaagaagagggatcaattgcaaatcttctcgttcttcttctttgtccttcagttcaactggtatatcccgtgtgaagagaatatattcattattttggcgtgctttagctaatctttgagcaatacgttctgccaattgatctgactctggaatataaaattcgctgtttggatcaagaatatgattttgcatatcaataataactaacattttctttcctcctacattcatatcgtcattttattctttttaatagaagttttttaaaatataagcaacaccagcttcttcattcgtcagtgttacttggtttgcaatttcttttacttgtcgctgtgcattccccatcgcaatactcaacccgctgtaattcaacatagcaatgtcgttttcttgatcgccaaaagccatgatgtcactcgattcgattccaaggtaatccgccagaaaaacaagtgaatgagctttagtgatacctgtaggcgtgatttctaagaaatgcggatcagagaatactgattggataccatctgcttgcagatctctttgtagcttctgtagtttttcttcactcttatctgttaatgctaatttaagatagctaagagaaggatcttccaacatatttaaaatttgatcaaaagaatggttctgtaaattgaaatgttcataataagggtcatctttgactagatttgattcatcgaatgtcagctgatcatcttgggtttctcggctagcaatgatggatattttcgcttcttgagcatagaagaaggcttttctcagtgtatcgctatctatttttgaacgtctgagaactttcgccatttttccatccttcatttcagcaatcagtgaaccattggaagaaatcaaatagccaccgattcctaattcggaaaaaatatctttagcagaaatgctgttccttccggtagcgacggttacgattccgccattttcatcaaatttccgaagtgcttggatattttcttctggtatctttccatttcgatcaagcaaggtaccgtctaaatcaatcgctgctagtttcattttatcttcctactttctttttacatatctattttcctgttaccttaagattaaatgagaatttaaaaaaatgaaactaacttgctttgtcattatgaattttttcaaaaaacattcttaagaaaaaggtggctatatatagtagtttttggtcaatacctttgaataaaaagccatgaaaaacgaatagttagcgcttaccaatgcgttttgtgataaaaaaattttaaaatattcaatgaaaacaaagcatatattttgctttaaaaccaaatgaggaatattctagatgtagaacaggttagaaaaagattagaaaaaggagtgattttgatggagaagagatacggcgtagttcctgtggtaactgcttcagacgaaaattatgctccttacttgagcgtgatgatcgcaactgcattagaaaattgcaataaaacaagacgcataaaattttatgtgattgacgatggtctatcagaatatagtaaagaaggattggaagaaacggtaaataaatattcaagtaatgcaagtatccaattcctgacagtggaaaaagatatctacgaagacttcctagtcagtgaccatatcacaactaccgcttacttaagaatttctttaccaaacttattagctaaagaggattataagaaagtcctttacttagattcagatgtgttagtactagacgatatcgtaaaactatatgatgagccgttaaatggaaaaacaatcggcgctattatcgatccaggccaagtgaaagctttggaaagattaggaatcgattccgatgacttgtacttcaattcaggagtgatggtgattgacattgatcaatggaataaaaaagaaattacagaaaaaactatccattacctcagtgaaaatggcgatcgaatcatctatcacgaccaagatgctttgaatgctgtactttatgaagattgggaacaacttcatccaaaatggaacatgcaaacttcgctgatttttgaacgtcatccagcaccaaatgaaaaatatgaacgtcagtataaagaaggaaatgtaaaaccttcgatcgttcactttacaggacatgataaaccttggaatacgttgaaagatcatccgtataccaatttatacttaaaaaaattagcacacagtactctaacgaaagtaggcgagatcaatgaataaaaaagaaatagcagtagtcgcaagttgtaacacaaaattcgtaccacatttagctgcattatttgtctcagtattagataattgcaacccgtctaaatttgttcggttctatgtgattgacgatgatatcgattttgaaagtaaacagcttttacgcttctcagtgaaaaacgcacgaatgaactcagatgtggaattcttgaaaatcaataaagaattctttacaaatgtggtaatcagcgatcgtattccagaaacagcttattatcgtattgcgattccggaattgttccgcggcacagaagttgaacgtatcttatatatggattgtgacatgatcgctttacaagacatctctaaattatggcgtcttgattttggggattcaatcgtagcagctgttgaagatgcagggttccatcaacgactggaaaaaatggaaatttcagctaaatcaatgcgttatttcaactcaggtttgatgctgatcaatgtgaaaaaatggttagatgaaaatattacgcaaaaagtattagatttcatcgaacataacccagaaaaattacgattccatgaccaagatgcattaaatgctatcttacatgaccgttggttaccacttcatccgcgttggaatgcgcaaggctatatcatggcaaaagcaaaaaaacatccaacagcagcaggtgaacgtgaatacgaagaaactcgtaacaatccttacattatccatttttcaggacatgtgaaaccgtggagcaaggattttgaagggccaacgaagaaatattacgaaaaatatgcagggatgacggctttccgttgtgtagctaaattccctaaatatccaaaatacgcaaaagttcaaccaaaaacagatgtagttgttaaataatagaagacaacaactgaacaggaggagtaggaatggaaattacaatgtctaaaaatgcagtagagacgttaattgaaaaggttggggaaaatacaaaaatcgcactcgcgctcatcaatgattccgatccatttttaagggacaaaggtgcttttgcaaaaggcagcttttttcaaatcattccttttgtttcggaatttggagaatatgcgactaaaatcgagcatccattattggacatctatacatctaaattagagcaaaattatttcggtaaacgattgaacatggacttcaacaaacagcttgacagcttttcattagaaaatgaaatcgcagtattagattataatatcaaattaaagaactgcttcttcagctaatagtttcgagaaagtccaaaaaggaggtatacattgagatactactttgtggatgaagaaaagaatgtaacagaaacagatgaaaacaaatacaactggcttattctcgataatacaaagccagaagagatccagcaggcaatcaaagaattcgagcttcctgatgatattttcgtaggaaccgaatatccggaagaagtttctcggatggagcgcctttatgagacaaaactagagcatccattttctttggtagtgattaatctggatcaatcagataatcgtatcgaaaaaaaattaacgccaatatcttttgtactttccgataatctcttgattacttgtatcgatagaaaaaccgaatttgtggatcggttgctgacaaagcatggaaatcatttaaactcgtttgaaaaaatcatcacgtatacattattagatatttacacccattacgtgaaagaactaagagagatgaaaaagcgaattgacgctttggataaagcagctcgtaaaacaacggagaatgaagaactgtataaacaggcagatcttgaaagagacatcgtatatatcgatcataccttaagagatcaacgggaaacaatggatcaattatggaattctgaaactttcatcaaacgtttagacgatgaacagttactctatgatgtccatttgagacagagacaaacagaaaaaatgatcgagatctatcgagatttattagagagtattggtgatctattcaacgggatgatggacaataatctaaatcatatcatgaaatatctagattcagctgcattaatcatttccgttccggcgttgttcgcagggatttggggaatgaatacaggaggattaccgggtaaaagttctgctctaggatttatactcgtagtctttggctctttaatagcagcagtagttttaggttaccatttataccggaaagattatacaaattaaagaatctatttaaaacaggtatcaaacaaagaaatttgttttggcaatacaatttaaaaactaggaggaatacagcaatgacagaaccaaaattaatcgacccacgaaacttgtaccatacggagaaatttcctaaacaagatcaggatacaccagctttacagcagaacatgattcctgttcctgattgcggagaagaatcctatgaaggcaataatcaactagaaaaccgccgtgtactaatcactggtggagattcagggatcggtcgtgcagcagcgattgcatttgctcgagaaggggcagatatcgctcttcaattcttcccaggagaagaaaaagatgcagaggaagtagcaaaatacgtgaaagatgcaggacgtaagattgtcttactaccttttgatcttcgtgacgaacaagcacctaaagaaatcatagataaagccgtgagtgaacttggcgggctagatacgatggtactaaacgcaggacagcaaatttcttgtcagtctattgctgagttaccacttgagcaagtcaaagacacatttatgataaacatcatcgctatgtttgctttagtgaaagaagctgttcggcatatcccagcaggaggagcaatcgtaacaacaacttctgttcaagcattcaatccaagcgaacatttattagattacgcagcaacaaaagcttcaatcgctaactttacgatcggtttagcaaaacagcttgcacctaaaggaatccgtgtaaatggtgtagcacctggtccaatctggacaccattacaactagacgaaggacaaccttctgattcgattcctgaatttggtcagcaaagtttactagaacgtgcaggtcagccaggagaattagcaccagtttatgttttcttagcatcgaataaagcaagttatgttacagctcaaatttacggagtaactggtggagaagcgatcaacttataagaagttgatcgtttcacccctatgaggaggtgcgaaaatgaataaaggtgtaaaaacgatcggagtgatcggaacgttacttttgctatctgtgcttttgtttgcgatactattaagtgcaacctatccattgccttttcagctagagaagtttcgattcttttccatcactaattcatatgtgcaacaatatgtattttggcttgccgttgcatttgctattttgacaattatcacgttacttgttttcctgttttatccaaaaacaatcggaaactttttactgaaacatggtgatggggagttgacgttggataaaaaagcaattgaaggaatggttcgttctcacttgcatgaagatgaatttatccattcaccaaaagtaaatgtcaaagcaacgaaaaacaagatcgccgtcaatgtaaaaggggagttgaaacgaacttcagcactcattggtaaaacaggaacattgatgaaagaaatcgaaaatgaagtacaacacatattgggaacaaaagagccagtgaaagtatcggtgaaatacacaggctttgaagaaccagctaaacgaagcaatgaccgcaaacgagtagaatagggggggaccaaaaatgaaagaactattttcgacatacaagctccctatcatctttggggtacttggattgatattagccgttttatggatcaccgtgggctttttcaagaccttattgatcttgatcatggcagcgatcggtgtcgctatcggtttttatctgaaacaaacgaaaatcttagatcactattttaaatcttaggaggaaacatccatgaataacaataacaaaaataataacaataaaatgaacaaccaaaaaccagtgtctgcacatccagacccaacgacaccaaaccaatcaaatggtgtgaacgatgaaaagaacaaaacagcaccagtatctgcacatccagatccagtagtccctaacgttcaacaaggagtagaagagaagaaacatgatgcagaaaagcatgcacctcatcatccaggaactccagaatctaaagttccagaacaacatgatgcaatcgatccttctaaacctgtggaagagcaaaaacatccttctgaccatgcgaaagcacaagaaaaacttagttctgaccacacaaacggacaaggaaaacttggttctgatcatacaaataaccaaggaaagcatgattctgaacaggaagattcaatgcgcggtgagctgaattatgaagataaagttgtgcaaaaaatcatcggaatcgcaattgaacaagtagacggtttattatctgcaaacggtggtttcttctctaatgtggcaggaaaacttgtgaatacagataatgtaacggctggtattgaaacagaagtcggtaaaaaacaagtagcagttgatatggatgtcattgtagagtatggcaaagacattgaaaaaatctttgaacaaatgcaagaagtaatcggaaaagaagtaaaaaatatgacacacttagatgttatcgaagtcaacgctaacgtagtggacatcaaaacaaaagaagaatttgaaaaagatcaagaaactgttcaagataaagtaactgacgcagcgaaaaaaaccggtgaatttgcttcgaatcaaacagataaagtaaaatcagcagctggaagcggcgctcaaaaagtaaaagaaaatacagaaccacgggttcagtaataaggaagtaaaacattaggaggaacgaaacatgggatttatttggtcacttatcgtcggaggaattatcggagcaattgcaggagcaatcacgaataaaggttcttcgatgggaattattgcaaatgtcgtagcaggtttagttggatcagcacttggtcaagcactattaggttcttggggaccaagtattgcaggaatggcaatcgtaccatcattgattggtgccatcattttagtactaatcgtatcattctttgctcgaaaattgtaaaaagacttttaaaaagagggcgtgaaaaagctgttcttcatcaagtaataagaacagccaaacaaaaatagcttctcatatttttcatttggttgggcttattatcgaagatgcaagcttttgaacaccgtttaagaaaaagaggtcgtgagcctgccgttcagctacgagtcacaaagaacaatttcaaaaaaagcttctcatgtttgatgaatattgtgacttgtgatcgagaagttggcaggagaacactgtttattcggaataagaggctgtgacaagacttttgtcacagcctcttatttatgtgggcaaattcccaattagatttttaaaagtttttccttaaatgtgtccttgttgattgctacaagacagctttttcacaaccttttaataaaacaatgcctccctaaattttcttgagataggaaaggtgaacatacaaaataatacgaccacttggaaaacccagatgatccacaaatggatctatgatactgatgaagtaaaaagcaatggatcaggaactcaaagagattgaaaaagacaaggaagaaataatatctcttttttactcttgtctgttttagccaataatagctcgtaaagtaatctagacaaacaaatagaagtaaacaaagtttcgtaagagcagtaatcgtatcatgttgctctgctagacgattgacgagcaggaaaaatgttggtaatggaatatagatcacgagtaatgaaagaaaaaagtaaacgataaatggcatactattcctcctaattgtgtgagttcgccctcattttaaaataacgatatttgtttgtgaagctttttcgagtcgtaacaaatgttatctaatttgtttttaaataaataattattattatcaaatcaatgttaaaaataaaaaagaacagaccatcactgttattcaaatcattttatcaaaactacatagtaaatggtaaaaagcaacatgacataatatatagaaggctttacagtatatatgggagtttactaaaaaagaatggagtaagagttaacacaatgggccattagctgaagttttaagcacttcaaggtatgaaacagaatggcctgtaatactacatgattatttagactgctcaaagtgctatagtctggtggaatgaataaagtattatactaaaagcaaatccaactacaacgtaacaggaaaccagttgtatcaggaaaagtgatagtacatggagaagaaaaggccccctttgtatgagtcagtacatatcttatttatagataaaacggtattcaatcgaaataaaaaatctgaataatagacgtaaataacttctaaaagtctcacacatctatcattcagattattttttatttactgtttattctactttattttattcttctggtatagtattcgagtcatttttataggtcaataaatcacccggttgacactccaaaacttggcagattttttcgagagtggaaaaacggatggcttttgcttttccattttttagaatagagatgtttgccatcgtaatgcccactttctcactcaattcagtcacactcatttttttttgagctaatactacatctaaattaacgataattgccatgtcgcacctcacactgtcaaatcatgatctgccttaagtaaaatcgcaatcgcatgttcaagcagtttttccagcacgcttgttaatgtgtatactgcaaaaggaatgaatacgacagcgattcctaccaacatcaaacctggagcatcgtctaaatccgctactttcataaatttaggaagtaagccaaaaaaagcgaaaccaataagcaaaatggttcgttcgattttttttagtatgtttaagctgtgagtggaaaaagcttggttatcttcgatttttttcaatagtttcaataagaaataagcaataacgatccctaggagaagggcaaagtaaatgacagaaacaaataatgtggtctgccaatcaaaattgaatcctttttcgcttgtagcgatctgagtgtaaaaaagtacgccgaacaaaataaatacggcacttatacctaaaacgacaaattttaatagcaatgttttaaatttcatttttatccctcttttatctttgatagctaaaatatagcagaataattattgtaaaacaactattttttatcgtaaaacaataaaaatatatcgtttataaaaaatgatagagtatgagggtgtggagtgcatttaacagcttttttgattgtaagaaacatttaaaaccagttattttagattctatgtgtgtctcttctataatgctagtttagatgcctgggattatattggacaatacagttggaggattttttattatctagcgaagagaagtgtaagttaacagaactgtatgagaaaaaagacaactacgtagtagctaaccgattcattaattttttcaagttcatgtttatttacgtatcagaatttttcttattcaatggtttggtgtaatcaccacttatttgtcctttattgcttatacaatgttatacaaaaggaaaatcaagcattgacgcatggggtggtactatctagctgaaatagcttaataagcgcaagtagatgcattggattagtttataaatcaaaagtgttagaggtattaagaagaagtagaaaaataaaatggattgccgaataaaaagtaccataaatcctaaaacatgtgccaacagatagatggcacatgtttatttttttcgataattttgtaacaaaaatacgaagatgaaaaagaatagagattcccataatgtagtagtccaactgaattctttactgataccaaataccatatttcctagatttgatacaatcaaatagccaatcgttatgatcaatgaatagtacaatcttttcatcataggacatatctcgtttttatttataagaatagtataaaccaaagaagtgaataagaaaaatgataatataaaaataaagtaagaacgcattaaagtaactaaagttatttattgtattttttaattctccgaaaaaatttaataaataaatagaatcttgtaataataactgagcataatctttgcaatttttaatattgaataatatcctttaagtatagccagcaatcaaaagtaaatagagaataagtaagcaattgttatttcagtatcagactggcaataaaacgccgttatgatccaacaatgtttggtagcgctttatttactggtgctatgctaactgttcactatctatactgtgattgtcggtagagttatttacagggtaaaaataagtttataggaggtggaaaatgaataaggggttaaaaataatcggtgttatcatgagtttactgctactttcagtatttctagcgattgcgttgatcaatgcgccgtatattatgcctgaacaattggaacgatttcgcttctttactttaacgaattactacatgcaacaatatattttctgggcagctgtagtatttgccgttcttgctattatcatcttgctagtcgttcttttctatccaaagtcaagaggaactttcgttatgaaacgggaagatggcaaactgacaatcgacaaaaaagcgatcgaagggttggtacgttcccatttacacgaagaagagttcattcattcacctaaagtacggatgcgttcaacgaaaaatcgaatccatatccatgtcaacggagacttgaaacgaacttcttcattagtagggaaaacaggtgtattgatgcaagatatcgaagaagaagtaactaaagtactcggaacaaaagaaacggtcaaagtggcagtcacatacagcggttatgaagaacaagaagatacaagagactacaagcactctcgagtggaataggagggccaaataatgaaagaactattttcagcatacaagctccctattatctttgggggtcttggactactgctagctgttttatggttaacgattggatttttcaagacattgttgatcataatcatgacagcaattggcgcaggaatcggtttttatttgaaacagacaggaatagttgatcaattttttaaatcataggaggaaacaaagatggaaaacaaaaacatgaatacaacaaatggatcagttttggcaaatgaaaaaggagaaaaccgcatgatgaatggtgaattgacttatgaagacaaagtcatccaaaaaatcatcggttatgcattgaaagatgtagatggtctattgacattagatggcggatttttctcaaatatggctgaaaaattagtcaacacagataacgtaacagcaggtatcaatacagaagtaggtaagaaacaagtagctgtggatttagatgtgatcgtagaatacggtaaagacatcgaagatatttacaaccaaatcaaagaattgatcagtactgaagtcaacaatatgacacatttagatgttatcgaagtgaatgtgaatgttgcagacatcaaaacacaagaagaataccaaaaagatcaagaaacagtacaagacaaagtaacagaagcagcaaaatcaactggacaatttgcttcacgccaaacagataaagcaaaatctgctgtaggcaaaggtgcacaaaaagtcaaagaaaataacgaaccacgtgtacaataagaagtaaaaagtcagttaggaggaatttaaaatgggatttatttgggcattaatcgtcggcggtatcattggagcaattgcaggagcaatcacgaataaaggatcatcaatggggatcatcgcaaacatcattgctggtttagtaggttcagcaattggacaagctttactaggaacttggggaccaacaattgcaggaatggctatcattccatcattgatcggtgcaatcattttagtattagtcgtttcattctttgcacgtaaattataagcaaattgaagaaaaacttatgttgaaatgaagaacaaatttgagaaccgtagcgaaattcgctgcggttcttttttatatattttatatgaagtattctttattccttatgaaaaaatatttttaaaaataaaaaaagacgaaaataaacggttttctataaaaagaagaccgtttattttttgtctttttttgtgtgaaaaacgaaaaagagcacaacacatcaagcttttattaattgtctgtcttttataaacgcaagtattaattcaaaaaaacagaagaaaaaaacaactacaccttcttttatactcgtaatcgtagaaaggaggcgaaaaaaatgaatacattacctatcaatacaggagatacagcattcatgattttatgtacagcaatggtttgcctgatgactcctggtctagcatttttttacggcggattagcacggaagaataatatactaacgatcatgtctcaatcttttctctccgttgggataacaacgattatgtgggtatttggtggattcggattggcctttggacgggatatcggcggtgttattggaaacccggcagatttctttttgatgagacatgttacaagcttccccaacatgtttcatggtgcaacgattccatttttaatgttctttctttaccaactgatgtttatcgtgattacggttcctttgatgacaggagcttttgcagggagattgaatttaaaaggatatattatacttgttattttttggaatctgctgatttatttccctgtttgccactggatatggggcggcggatttttggatcagatgggatttagagatttcgctggtggagcagtcatccacacgacagctggattcggctctctagcatgtatcctcacacttggtcaaagaaagattcctttaggagaaagaaatcagcatagcagtcttatggcagctgctatcggtacaggactgctttggtttggctggttcggttttaattccggtggtgcacttcgagcagatgaacaagcagtcaatgcatttggttcaacattcatcgctcttgcatttgcgatgattacttggctgatcattgcaaaagtaaaaggaaatggctttgattttgtcgacgtactaacaggatccgttgctggattggcagccattacgccttgtgccggttatatagaagcaaaaagtgccatgctgattgggatcattgcgggtatcgtctgtcatgctgctgttgattttcgtaaaaagaaacaatgggatgatgcacttgatgtgtggggtgttcatggcatgggcggattcacaggtacgattctgatagggatctttgcatctaacagccatctactaacgaatccaagcagctggtacttcttagggattcaagtgattggtgtcatcattactgccgtgtatgcctatgtactgacaacagtgattttaaaatcggcgatgcactttacaacgatcactactacaaaagaagaacaagaagaaggattggactttttcttctttggcaacaaactcaattgaaacaaattcaaatagaaaagaggaagattcatgcaacaaagcaaaacgaaaattcctgcaaaaaaattaacgttctttggctttttggctatgaccatctcaatggtcgtttcattatatgaatatcccacattcgcgacctcaggcttcagcttagtatttttcttgttattaggcggtttgctatggtttatccctgtggcattgtgtgcagcagagatggcaacggtgaaaggatgggaaaaaggcggtgtctatacttgggtcagtcgcacattgggaaaacgattcggttttgccgcaatctttttccaatggtttgagataacagttggctacttgaccatgctgtatttcttaactggtgcattatcctatgcaacgggtattggtgctatacaaaacaataaatatctgaaattggcaatcctattgattattttctgggctattttactctctcagttaaaaggaaccaaatacacttcattaattgctcggatcggttttgtagctggtatcttgttgccagcattagtcttgtttggcttagggatccattatgtcgcttcaggcgctccactacaaacgacactgtctatgaaaacattgattcctgatttttcgaaattgcctacgctggttgtttttgtttcctttattttagcatatatgggcgtagaaacatctgccagtcatgcaaatgaaatggaaaaccctaaaaaggattatccattagcaatgtttgtattggttgttctggcaatcattttagatacttttggcggattgaccgtcgctactacagtacctcaacatggtttatctcttaatacaggggtgatccaatcgttagaattcctattaagacacattgatccaaatcttgcatggattgcgaaaattcttgcgattcttgtttgtttaggtgtcatcggagaaattgcttcttgggtaacctctccttcaaaagcacttcacgtagcagcagaagaaggattacttcctgaatattttgcaaaagaaaacacacacggtgttcctgctcatttgatgatcgcaaatgggatcgttgcaacaatctgggcagccgtctttacattaagcggcggggggaataatctttcatttcttgcagcgatgtcattgactgttgtaatctacctgatgttgtactttatgtttttcgcgggctatttgaagctggtttttaaagatgacagtcttgaaagagcctatcaggttccaggcggaaaagttgtaaaagtaatcgttgcttgtttaggtcttttgacttcactttttgctttttgtatctcatttgttccacctgctagtatcgcagctggacagcacgggatttatgaaacgattctgattgtttcttatcttatcgtcttagttattccatttacgatctacgcatgccgtcataaattccagcatgcagaaaaataaaaaatgaaagctggttattcaaatggaagtaaaagaattagaacaattgattggaaaaaatttccactattatcaaacaggacaagtggcggattacattccagcattagctgaagtagatcccaaacaattaggtatggcgatttatgatttggatacaaaacaactgattgagggaggagacgccgatgtgcgctttgccatcgaaagcatgtcaaaagttcccgtattgttattagcaatcaaagacaacggaatagaaaaagtctttcaaacaatcaacacggaaccaaccggatttgctttcaattctatcatgaatatggaaatcaatcatcgcaaacatccaatgaatccttttgttaatgcaggagcgattgcaacaacctcattgattgccggtaaagatgcagatgaaaaatttgagcgaatcttgtcatttatgaaagagatctgtgatgatcctaatatcacattgaatgaagaaatctatcattctgaatcaagaacaggtgatatcaatcgctctcttgcttactatatgaaaggtaatcaaatgatcgaaggagacgtaccggagatactcgatgcttatttcagacaatgctccctcaatgtcaccgctacaggcatagcaaaattagctgctgtgctggcaaataaaggaatcgctccttggaatggcaaacaaatcattactgaagaaagtgctacaatcgtcaaatcaattatgacaactgctggtttgtatgatgaatcaggagagttttccgtccatgttggtgtacctgcaaaaagcggtgtaggcggcgggttgatggcagctgtgccaaatcgttacggcataggtgtcttcagcccggcactagatccatttggtaacagcgcagctggtatccaattgttgaaagatgtagtcaaagaactagacgctgacatctttgaataaccattcttaaaaaagactggggaaaaagtccaaacggctcaaagctacctacagtgaggctgagattgtgagcttgtttgacttttgtcccagtttctttttttattggtttttgaaagggcttttctaaataaaaaggaaacaaaaatacgatttacagatatgattaaataaaatcataagaaaaactggaggtgtgtatcaggaatgctggaaaattacatcgagcgaaatatatttagaaaagtgtatctgtgtgaacaattatttgaattccaagaaatagatatcgaacaaacagctattttactaagggtgactacaccaacgatccttcacgatctagaaagtctagccgagtgtctagaatattgcataaaagaacaagtaagagagaagcataagtataaactcgtattcaaacatggtattgctctttctgagctcacacagtttctgtatggtcaatcttattttttaaagtttttaagttattattttaatggtatattcacgagtacagaactggctgatcttgaatttatttctttgagcaaagtatatacaatcaaaaaaatcgtattggatttttttaaagaaaatgattatttgaaaaataaagaaatcattatcccagaatttgactcgcggaacatcttgctagctttagtacgttatgtcaattgggaaggctatgaaaataaaaatccgtatgtagaagaagcttgtaacgagttgattgattatgtagagactcatttttttaaaagaagatattcggaagatgaaaagtcccttatcatacgaggaatagagatcgcaatcggaagaaaggcatttccccttggactgaaagaagaagataagaaaagcgcaaaaacgaagccgttatttcaattagtctgtcaaggattggaagagcaaaaaggaattctagacttacaagaagaagatgtctattatattttttatttgttcaacagtagaaattataccaatgagaacatggagctgttaagaaaagatttcgaagttgtttataaaaattttgttctcaatgacctatcactgaatgaattgattttacagattattagtatcgctgaaatcgacgatgcagataattttattttcaagcaatcctttttacaatttgtccgtacgttgtgggcagatggacaagtatttttaccggaaaggatctatcttctatcagaaaaagaacaacttctgtacggaaaaattgtagaaatattggaagagtggaaaaagaaaaatcaaatccaactaagatggaatgaaaatttcattcgaaaattcgtcaaaagtctttctttgatcaacagtgaacaagcggggagacaggaaatagaaatttttgttgtttcagaaagttcagtcaaacaatttttttatcgaacccaatttcatttgtatgcggaagaaggcatcgccgaaataaatcctattttatttcgttcattagaagaattgcctgatgaatgtctatgtgcgaaaaaacgagtggttttgtgcgatgctgctagctatcaaaatggattagaaactgaaaagacaaagatctatccaatctcattaaaaggtgcaaacatccatttgtatcatattgctcaggaacttcacctattaaaaaaacatatttcttgatgagaccttaattaggagaccttctacagagctttttaaatgtctgtagaaggtttttatttgagtcctgattcgtgcgaagatctacttatataacaagctttctctgaaatttttttaaaatgctattgacttagagtcaactctaagtagtagaatagataaagtgtaacaaatctattttcattaaaagaagatagtacggaggagagaatgtattatgagtacagtattacatgtattggatgcaatcaatagccccgcagatgtcaaaaaattatctgttgaggaaatgaaacagttggcagaagagatgcgccaaaaaatcttgcaaaaggacagcgatgtaggtgggcacgttggtccgaatctaggtgtagtagaattaacgattgcgtttcattatgtatttgattcaccaaaggataaaatcgtttgggatgtttcccatcagtcttatggtcataagcttttaactggtcgaaaaaatggttttgaaaaaggacattaccgtgaagtgagcggatattccaaccaacatgaaagtaaacatgactattttacagtggggcacacatctacatctatcagcttagcaacaggtttagctaaagcgagaaatctgaagaaagaatcaggaaatgtggtagcatttatcggtgacggctccctaagtggtggcttagcttttgaaggattgaacaatggtggtgttttacaatccaatctaatcgtattagtaaacgataatgagatgtctattgatgagaatcatggcagtttatataaaaacttagctgagcttcgtcaaaccaacggtaaaagcagcaataacctatttaaagcaatgggatttgattatcgttacgtggataatggaaacgatctggaaacggtgatccgtttatttgaagaagtaaaagatattgatcatccgattgtacttcacgtacatacggaaaaaggtcgcggttatcagccggcaatcgataataaaatgaaatatcattggcatgtaccattcgatctgtccaccggggaggcaaagcaggtaacttctgaagaaacatttaatatgatcatcatggattatttggataagaaaatgcaaacaagtacagctcctattgctgcagtcaatgcagcgataccaggcgcctttggactgaaaacattccaagaaaaacatccagatcattattttgacgtgggaatcgctgaacagcactctatcactttcgcttctgctttggcttctcagggagtacgtccagtcgtcttccaatcaagtactttcttgcaacgggcatatgatcaattatcacatgatttagcgatcaacgagaatccagtgattattttagtcggtggcggaacgatctctgctagtgaccgaacacaccaagggacatttgacattccttacttatcaagtatcccgaacatcaaatatcttgctccagcaacaaaagaggatatgatctctatgctagattgggcgttcgaacaaacagcgcagcctgtagcaatccggattcctacacatggtgtagaacatggtacagctattgcaaatgattatagtattccagcctatcaaacagtaaataatggaggaaaagtagcaattttagctttaggcggttttcttgaattaggaaaagaaacagtaaaagcttttagaaaaaaaggaatcgaagcaacgttgatcaatccaggaacaattacagaaaatgatgtagaaacattagataaattaaaagaagctcatgaattagtcatcacattagaagatggtagcttgtcaggaggatttggcgaaaatatcagtcgttattatggtgattcttcaatgaacgtactaaattttggtgcagagaaagaattcacggatagcgttcctgtagagcagctttatgaacgttatcatttaacaccaaaacaaatcgttgaggatagtctacgtgtcttaaatattcaataatacatcgtattttccatccagataatcgtttatactagtatctggatggttttttattatacgaaacaaaggagtagatgctcttatgtatcaaaaagtagaagaatatttcaaaaagtttcaagaagaatatcctaggtatcaatcagaaaaactaagctttttttcatttgggaatacagaagaaatggcagatgaattgagtgagttagttgtaaaaaagataaaaaccggtacatcaagtggttacgatctgtataaacaagagaatgagcctttaccaaaagttggtcaattagacgtggtcctgaatggaaaaaatgaaccagtttgtatcatcaaaaatataaatgtgaccatcttgccttttagtgaagtcacgaaagagcatgcttggaaagaaggagaaggggatcggacattagcttattggcggaaagtccatgctgagttttttaaacatgcttataaagaagcgttgaacatagaatttacagaagagaagctagtcgtatacgaagaatttgaagtgattttcttttagtaagaaaggtctgctgaaagaaatagctcattattgactcctgaatggaaaagggttacatttttatatgaagctgtatttttatataacattactggaggagatattgtggatacactggaacaaatcaaaggcggagtcgtcgtttcttgtcaagctttggaaaacgagccgctacacagttcttttattatggggagaatggctttggctgcaaaagaaggcggagcagttggtattcgagcaaatacaacagaagatatcaatgaaatcaagcgaatcgttgatttaccggtaatagggattatcaaaagagattacgatgggtcagaagtgtttattactgcgacagaaaaagaagtggaagaacttttggagacgcaagcagaaatcattgcactggatgcaacttctcgtaaacgtccgacagaaaaaacaactgctgagcttgtccaaatgattcacgaacacggtcggttagctatggcagatatttcgacttttgaggaagcgcttcaagcgcaagaagatggttttgatcttttgtctacgactttagcaggctatacagaatattcacgaaagacgcagacacctgattttgatttattgaatcaaatcatagaacaagtcgatatcccagtaattatggaaggacatactgactctcctgaacaagtagagaaagcatatgaattaggtgctttttcagtcgtagttggatctattatcacccgtccgcaattgattactaaaagatatgtcgaagccgcaagtaaagcaaataattaaaaaacgcgcacggcacagattcttgacaaaaaagaaaaattgatagatagtttaaagcagattctaagaagatgaaaaaagtattacttttcattttgtcttcaagatctgctttttagcgaattttatagaaagaaggcgagaccatgtttgaacggagtccttcagaattgacagaacgtgaaaattacaagttgctgattggttcagtcatccctagaccagtagcagtagtaacgactaaatcagcaaaagatatagtgaatatcgcacccttcagttacttcaatatcgtcagttcgaatccacctatcttatccttggcgatccagagaaaacaagatgcagtaaaagacacagcgaaaaacattcttgagacaagagaagcggtcatccatatccttgatgaggacaacgtagaagaagcaaataaaacagcagctaatctgcctaatgaggaaagtgaactacatctgactgagttgactttaacggattcagcaatcatttcagtaccagcattgacagaagcaaaagttcgttttgagacaaccttatatgaacatgtcgagatacggaataaaaataaagtaacagctgatttatttttgctagaagtacaaaaatatcatttgaatgaaacagtctatgatgaaaagacgggaaggatcgacccaagaaagttgaatgctataagccgtttggcaggaaatgattatgcagcaataggagaaattttcacgatcgcacgtccccaataagaaggagtaatagttatgttaaaaataagttataaaccatcagcagattcaaaagaaatggaaaaagaatacgagacagtgaatgattttctgcaagggcagtatttagaagttccgccattgcaagatcattttgtcgtcaccaaagttactttagacggcaaagaaataggattaacagaccacacgattagcggattattcaattacttcaacaaataaacatttattccgaaaagtgaaaatcatataaaaaacaccaaaaataaaaagattctcaaggaatgctagcacaattgaacgaaactgcgctgggattcttttacgttatttgttattttttcctaaaaaatattaaagattgttaaatttcactatttcatttcaaattccattgcctattcattaggaaaagtctatcatggactcgtaaatagaatatagtaataaccttgttaggtgaggctcctatacaaacataggctattgcccagaaacgtcgaaagtcgccaatgggtaaaacagaaactgtcggattaaggctttttccaatagctaagaatgttttctttacgttgtatagtgctaaaactcggacgatgagatgatgctaggtcagaattcttgttcgaaaaggtttctgaccttttctttatattttcaagactgcctttatttgatgcgagctcgctcctcacctgacaagtggattgctgtgtgaggaggagatgcggtgaaaaaaagaaaaaagatcgattggtggattttgggtccttatttgactttgtccatgatcggtcttttagaagtatacagtgctagttcttatcgcttattgcaagcagatgaaaatacaaaaagtctattattgcgccaactgattttcatatttttgagttggggcgtaatcttctcagctcgttcaatcaaactacactatttacttcaccctaaaatagcaggatatggtttagctttatcgattttctttttaatcttagtacgagtaggaatattcggtgtcactgtcaatggcgcacaacgttggatttctctgtttggcattcaattccagccttcagaattagcaaatctttttctgattttttatctaagctggttttttcgtgacggaaataatccgccaaaaaatctaaaaaaaccattcctgattacagtaggtataacttttctgattttattccagccaaagattgctggagcattgatgattctttcgattgcgtgggtcattttttgggcagcagcggttccatttaaaaaaggaatctatctgattgttactttttctgccttattgattggagcagccggcggagtattatatttaggaaacaaaggctggcttccccagatgttcaatcatgcttatgaaagaattgcaactttaagagatcctttcatagatagtcatggtgcgggctatcaaatgactcattcgttttatgcactatacaatggtggcatatgggggagaggattaggaaacagtatcacaaaaaaaaggatatcttccagagacagaaacagattttattttttcgatcattacagaagagcttgggctaattggtgcattgtgtgtacttttcttattattctcattatgcatgagaatcttttgtttaagcagtcgttgtaaaaatcagcaagctggattgtttcttttaggattcggaactttgctattcgttcagacgataatgaatgtgggaagtatcgcagggctgatgccaatgaccggcgtgccattaccatttgttagttatggaggaacaagttatctgatcctttctttaggaatcggaatcacgttgaatatttcttcgaagatacaggccgaagagttgccgctctatcgacctgaaaaacaataaagagaaactgagaatctctcagtttgaattatcataaaggactatcttttatttttcaagcgagagattctttttagaaagaggaattcgcaatgaaagtatttcaaaaaatcatattatctgttttgttactgcttacattagtagtcggctttttttcgattgaatttgtccatggattttcgtctgcaaaacagaccttaactgtgaaaaaggtagcgccgaaaagtgtccctaccacactaaacgtggctttgattggttcggatgcccgttcgaaagacgaaaatggtcgctcagattcacttatggttgcacaatacgaccagaaaacacaacaagcaaaactaatctctatcatgagagactcatatgtcgatataccaggttacggaatgaataaaatcaatgcagcgtactcttacggaggagttgatttattaaaccaaacattaaaggaaaatttcaaatttgaagctccctattatgcaagtatcacatttcaagattttatcgattgcgtcaatgaactgtttccagatggagtagagattgatgcagaaaaatctttagatttagatggcgtatatataaaaaaagggaagcaagtaatggatggcaatacgttactgcagtatgctcgattccgtgaagacgaagaaggggactttgggaggattagaagacagcagcaagtgattaaagctatctctcaacagctgaaagacgtcacttcgatatttaaattaccgaaagcagtgggaaaactacttggcagtatccaaacgaatcttcctgagagtgtgctactggattgcggtatggatttcctcaaagacaataataaaaagatcgatacattatccgtaccagtagacggcagttgggacttcaacgacaatacgccttccggaagtgttctggaattagatttgaccaaaaaccaagaagcaatcaaaaaatttctgaataattaagtcaagaaaataaaagaagttagaaataacaatctatgttatgttctgacttcttttattatgttagaataaacaggtataaatagtgaaaataaaggaatgacaagcaagagaaggagaaaaaaatgaaaagaagtgacaagcacggcaaaaatcgaacaggcgcttatattgccggcgcagtgatcttaatagcagctgcgggtggcggttatttttactaccggcactatcaagaaacccaagcagtagaagctggagaaaagacggttgagcaatttgtccaagctttgaacaaaggagattataacaaagctgcaggaatggcatcgaaaaaggccgcaaataaaagtgcattatctgaaaaagagatcttagagaaataccaaaatatatacggtgctgccgatgtcaaaggacttcagatatcgaatctaaaagtagataaaaaagacgattctacttacagtttttcatataaagcaaagatgaatacctcattaggtgaattgaaagatctttcttataaaggaacattagacagaaatgatggtcaaaccacgatcaactggcagcccaacttggtttttccagaaatggaaggaaatgacaaagtaagcctgaccacgcaagaagcagcaagagggaacattttagatcgaaatggggaaccattagcaacaaccggcaaactaaaacaattaggagtcgttccaagtaaacttggagatggggacgaaaaaacggccaatatcaaagcaattgcttccgcattcgacttaacagaagatgctatcaatcaggctatttcacaaagctgggtacaaaccgattactttgtcccattaaaaatcattgatggagcaacgccagaacttccagctggagctaccattcaagaagtagatggcagatattatcctttgggtgaagcagctgctcaactgattggttacgtgggagatatcacagcagaagatattgataaaaatccagaattaagcagtaatggaaaaatcggacgatctggtttggagatggcttttgataaggatcttcgtgggactacaggtggaaaattaagcatcacggatacagacggtgtcgagaaaaaggttctgattgagcatgaagtccaaaacggcaaagatatcaaattgacaatcgatgcgaaggcacaaaaaacagcttttgacagtctaggaggaaaagctggatcaactgttgcgacaacgccaaaaaccggtgatcttcttgcgcttgctagctctccaagttatgatccaaacaaaatgacaaacgggatctcacaagaagattacaaagcttatgaagaaaatccagaacagcctttcatcagccggtttgcaacagggtatgctcctggatctacgtttaaaatgattacagcagcaatcggtcttgacaatgggactatcaatccaaatgaagtgttgacgatcaacggacttaaatggcaaaaagacagttcttggggatcttatcaagtaacgcgtgtcagtgatgtatcacaagtagacttaaaaactgctttgatctattccgataatatatatatggcacaagaaacgctgaaaatgggtgagaaaaaatttcgtacaggtttagataaattcatttttggtgaagactttgatttgccaattagtatgaatccagcacaaatttctaatgaagatagctttaactcagatatcttgctagctgatactggatatggacagggcgaacttctaattaatccaatccagcaagcagcaatgtattctgtttttgccaataatggcacacttgtctatcctaaattgattgcagataaagacacaaaagacaagaagaatgtcgtcagtgaaacagcagtacaaacgatcgtgccagatttaagagaagttgtgcaagatgtaaatggtacagcgcattctctttctgctttaggaattccattggcagcgaaaactggtacagcggaaatcaaagaaaaacaggatgaaaaagggaaagagaacagtttcttgtttgctttcaatcctgataaccaaggttatatgatggtcagcatgttggaaaataaagaagatgatgattcagcaaccaaacgagcaccggaactattgcaatacctcaaccaaaattatcaataaaaaattgctttttaagtacagtaaaaggactgtggcgttatcgtcacagtccttttttcaaataaacggttttcacgatgtctctttcacaacttctttgtgatttactcacacttcataaactttttttgtaaaatattttagaacaagtggagaaataagtgtacttaataaaatcacgataactaaaggtgaatagtactgtggttcgatcaattgactttgctgtccaatttgtaaaatgatcaaagccatttctccacgagagatcataccagcaccgaccatcaatgaactatgttgagaaaaaccggcaatctgagcaccaaaataccctccaagcaatttggtcaaaatcgctacaagcgtcaatatagaaataaagagtagttgttcactaaagtcagaaaaatcaacttctaatcctacactgacaaaaaatactggtataaatactgcatatcctaaagcctctacattgtggtatacttcttctttaacctttgtctgactgacagctatcccagcaaaaaaagcaccaatgacagagctaagcccaacaagatccgctacgtaagacattcctaaacaaataactagcgatacgatgataatagaagaatttgcgtacactttttctgcaaatgaaagtaggaaaggcgcaatccatttgactaataagaaaataaaaacaaaataaattagctgttcaatcaaaacaagcggtaaagaggcattgctagaagcttcccccgttagaaaagataggctgaaacttagaactaaaacgaccaaaatgtcatctaccacagaagcacccaaaattgttgatccttcttttgtattcactacgtttagttcttttaatacttctactgaaatactgacagaagttgccgcaagaataatcccaaagaaaatcgcttcatttcccgaaacttggaatgcttcgcctgtcaaccagccaaaaacaaccgggaagatgatcccaagcaaagcaacgaacataccaggtcggaaatattttttcaaaagagataaatcactttccagaccagctaaaaacattaataagatcacaccaatctccgaaaagtcatggactagaatatcaggtttgacccaattcaatccagcttggcctagcaaaacaccaacaagtaattgtccaatcactgctgggatacctaatctccgcgagatatgtgagccaatcgttgttgaaatcaatatcaggcataaaataccaataaattccattctcatcattcctttgtataaaatatagcccgaacttagcataacatacattattgaaaaaataggaaaatatactcacaaaaaaaccaacaatccaaaagatttttttggattgttggattttatacggtctattttaataactaaaaatgattaacgtatagtcatttttcttattctgatgaaattgataatctcctggatgcccatgaaaatcaaaataaagccgaatatttggaatagaagcatcaaacttttgaatggattgaacaataagacgaatccgccaatcaacaacagaatactataaacactccaacttttagcttttgtattcatgctgaagaacaactggaacaagctgttgatgataacagctaatccaagaagaatcggcaggatagaaacgattgcaggtgcaaaagcataaacgatcagagctaagatcaggaaaaaaagaccactgaacagaccgatactccaagaacctgttttccttttaaaacggtaagcctcaaaaagattcaacaacccaagcaaaacaagataggcggtgatcagataaccgataaaatgaaaaacagcagaagggtttagcacaatcgcaatcccagaaataatataaacagcagctcttaataaggcgtatttttgaatattttgtttaatcgtctcaaacatataagaaaacctcctttgacttattttaacgtgaactagtcattttaccaaattaaatgttacaaaatgagcgaaggagaagaatatttctggaaaaatcaacttctgaggatcttttccatttttttgccttttgctagctcatcgatcattttatctaaataacgaatttctttcatcaagttatcctcgatgtcttctactcgtacaccacaaacaaaacctgtaatcaaggaacgtgaagaattggggacaggggcttccgcaaaaaattgttcgaaagtcacttgtttttgtagttgatattctagttctgtttgggaataacccgtcagccaacaaatgatttcatctacttcctcttttatacgatcttttctctccgcttttgctacatacataggataaaagcttgcaaaacttgtcgtaaaaatacgattttgcgtcataatcagtcacctttcttttttttaaattatttactacttatagtatataagaaaaagagaagaaaaagcgattattcaaaaaaacaaaaaggattgtgacaaaatccttgtcacaatccttttttccgagtgaacggtgttgtcctgtcaactcctcggtcacaagtcacaatattcaacaaacatgagaaactgtttattaaattgttccttgtgactcggagcgaaacggcaggcttacaacctctatctgtcttttgtataatcttcatcgctcaagtgcgcatcaaataatcgaaggctcctaaagctgcagtagctcctgaacccattgaaacaatgatttgtttgtatggactatctgtacaatcaccagctgcgaaaacaccggggatattcgtcgcgccatttttctcagtcactatttcatttcttgggttcatttcgattgttccatctagccaatccgtgttaggaagtaaaccgactaaaatgaatacacctgaaacagctagagtatgcaactctttcgtatgttgatcgatataggagagagattcgacctgattcgacccgctgatttctttcgtcgctgcatttttgataacagtgacattcgcaagagaaactagtttatcctgtaaaacttgatctgcttttaattcgggtaagaattctagaacataaacatgttttgctaacccagctagatcaatcgctgcttcaacaccagaattaccaccaccgattacagcaatctctttttctttaaataaagggccgtcacagtgtgggcaataagcaattcctttatttttaaactctttttcgcctggtacattgatagaacgccagtgcgcccctgtcgcgatgattgcggtttttgctttaagtgatataccgttagctaagccaatattaataaaatgttgctctttatttaaggaaacggcttgttgattcatcataatgtcgatagggtaactacgcacatgactttctacttgctgcatcaattttggaccttctgtgtaaggggtaccaatcatattttcaatcccgagtgtttcaacgacttgtccgccgaaagaatcagcgacaagtcctgtacggattcctttacgtgctgcatagatagctgcactactagctgctggtccaccgccaatcactaatacatcataaggttctttttcaaacaactcttcttcaatcaaagggccagtgattttttcaacaatttgttcgatcgtcatgcgtccgctactaaattcttctccatttaaaaacacagttggcactgccatgatttttttatcatcgatttctttttggaacatcccgccttcaatcatcgtgtgagtaatatttggatttaatacagctaatatattcaatgcctgtacaacgtcggggcaattatgacaagtcaagctaacataactgtcaaaatgcaatgtttgtgttatttttttgattttaagactcaaagattcactgattttcggtgcccgtccactaatttgtaacatagccagtaaaaaagaggaaaattcatgaccgagggggataccagcaaaaacgattccactttctttgccaactggattgatagaaaaactaggtgttcgcatcgaatctcttttttcccaagagattttaggagacatttctgctatttccttcgtaaattcagctagtttttgactattttcactagtatccaaactaacagaaaaaacaataggagattcaatcagtgctaaatattgttcgagattttgtttagtttctttgtctaacatatccaccacctaaatctttccaacaagatcaaaacttggtttcaatgtttcgccactttctttccattttgccggacaaacttcacctgggtgggtacgtacatattgagcagcgcgaatcttatcaatcagtgcactagcgttacgaccgattccatctgcattgatttccatagcttgaacgattccgtctggatcaataataaatgttcctcgctgagctaatccttgctcttcatccaaaacatcaaaaatacgagaaatctgatgagacggatcaccgatcatcacgtattcgattttaccgatagcatctgatgtatcatgccatgctttgtgagtaaagtgggtatcggtagagcaagagaagacttcaacacctaaagatttcaatgtactgtattgttcttgtaagtcttctaattcagtaggacaaacaaaagtaaaatcagctggatagaagcaaagaatactccagttccccataagatctttttcactgacttctaaaaattctccttgatgataagcatgtgcattaaattcttcgatttttttcccaatcaatgacatagtaaaacctccaataataattatttatttataattattgtaatttagttggagttgaaaagtcaatggatattttgttatttaataaagattactcaaaaacgaaggttaattataaaaatagaagaggtcgcaagaaaatgctactgctggaaatactcgggataacgttgagtaacagtttcctgttctttcagcatcatgtgtaagtgcaatcccgtttgaaatcgagcttcttctggttttttatcaactaaagccttgagtaaatcataatgttgttccatgatcgtttcccatggaagcccctgaatggtcactcgtaaccagcggaaacgttctaaatgggtattatggtcatctaaccagttccaaacttcttttcttcctgcaatttcgaaacaagcttcatgaaataaattatctgcacggaaaaaagcgcgttcgtcatttattttgactgctttttcttgttcttctaaaatcgtttctagcactattcgtgtttgtgtgtccaatttggaacaacattcaatcatgatttgctcttccaactgttctcggacaaagcgagcattttctgcagaaacaagattaatttttgaaacatacgtaccactttgaggtatcgtatacacgagttcttgctgacgtagttgaatcaatgcttcgcgaatgggagtccggccgatagcaagatgttcctccagtgccttttcagatattttccttccaggttctaagtcagcatagataatttgtttacgaatcgcttgataagcttgagattgcaagctgcttttcatttttatacctccaaaatcatttctatgaacgtagtataacagaagaggtctgaaaaataatctgatatgtcacattaactaggaaatttgtataaatagtaaaattttggttgacatagcgatttttattgcataaaattcacttgaatacaaaaactaatatgttagtttaggaggggaaaaatgattgatttaaacaactggaggaactttattcctgaattatctcaaaaagaagtagaaatacctcattttgaccgtgcatcattaagagaaaatggacaaaaaaatcctgtctggatccatttcggtggcggaaatctttatcgaggatttcatgcagaaatcgctcaacgtttagcggatctaggcgaattgtccactggtgtcattgtttgtgaaacattcgatgaagaaataattgaaagggcttaccgaaattttgatgatttgattcttgaagtggtcatgccaagcagtggagagttcgtcaaacgtatattagctgcgacagctgacagtctgtattgtcatccagattgttctgaacactttgataagatgattcgacactttgaaaatcctagtttacaattagttacttttgctattactgaaaaaggttatcgattgaaagatacaaataataaatatataggaccgattgcagtcgatataaaaaatggtccaaagaagccatcacatacaatgagtattcttgctgcgctactttataaacgttttttatctggagcttggccgattgcacttgtctctacagataatttttcacaaaacggtagtcaattacgtacttctttgctaacgatcgcaaaagaatggcaaaaggaaggttatgtacaaaatacatttatccaatacttatcgaatgaagaaattgttgcgtttccatggacgatgattgatcgtatcaccccgaatccttccttgtcagttagcaaaatgttggcaaaagagggcttttcaaatatgtcgattttccaaaccgcaaaaggaaataatattgctccatttgtcaatacagaggacatccattatttaatcatggaagatcattttcccaatggacgtccgaaattcgaaaaagctggggtattcttgactgatcgtgcaacggtagataaagcagatacgatgaaggtgacgacttgccttaatcctttgcatacgtctttagctattatgggttgtttactggggtataggagcatagctgaggagatgaaagatccagatttatcgctgctagtttctgaaatcgggtacaatgaaggcctcccagttgtggagtctccaggtatcattgatccaaagatctttctggaagaagtaattactgtgcgcttttctaatccaaatattcctgatatgcctcagcgaatcgccacggatacctctcaaaaggtggcgattcgttatggtgagacgattaaaaaatatatggaaatagaagttaaagacccgcagacacttgtatttataccattgactctcgctgcttggcttcgataccttattggcattgatgatcaaggaaaaccattcatcccgagtccagacccactattgacagaccttcagcataagctttccgatattcaactgggtacgcaagatacatcacatattcatgagaaaatggctcctattttgtcaaataaagaaatttttggtgtagatctttaccaagcagagcttggcagaaaaatagaagaaatgttcatcaagatggtagcaggaccaaatgccgtacgaaaaacattacaggattacttacaagaacatggaggaaatttatcatggaaatgacttttagatggtacggatcacaggaagaaaagattaccttagatgaaatcagacagattcctgcggtcaaagggattgtaggcacattgatggatataccagtaggagaggtatggcctagggagaggatcaaagaactaaaagaagaaattgagtctcgtgggttaacactaaaagtaattgaaagcgtcaatgtgcatgatgccattaaaattggattaccttcccgtgagcagtatatcgaaaactataagcagacaatccgaaacttggcagaatatggaatagaagtcatctgctataattttatgcctgtatttgactgggtgaaatctgaccttgactaccgcttagaagacggctcatccacgttagcttttatatctgatgatattccagatgatccaagagaaatcgtcgcgcgcatcgaacattccagcaatgaatttgaattaccgggatgggaacctgagcgcttagctcatatcaaatccttgcttgaagcctatgcatcagtagacgaagaaaaacttcgagaaaattttgcctattttctccaatcaatcatcccaacatgtgaagaggtaggggtcaaaatggctgtacatccagatgatccgccatactcgatttttggattacctcgaatcgtaaagaatcgagaagatttagattggttgtgccgcatagtagacagcccttataacggaatcactctttgtacagggagtattgcagaagatccagaaaatgatgtatatgggattttagcagaattttgtcaaagagatcgaatcccatttgcacatgttcgaaatattaaatttttagataatcgagatttctatgaggcaccgcataaatccgaatacggttcattagacatgtaccgcatactaaaaacaatgtatgacaacggatttaacggatacatccgtcctgatcatggaagaatgatctggaatgagacaggaagaccaggatacggcttatatgatcgagcattaggtgctgtttatctaaatggattatgggaagcaatcgaaaaaggaaacaaaagtaaagataattagtgaaaaaaactgtaattttattatgtaaataagaaggatgttcaaattcttgatacataaatccggaggttgttaataagcattcggatttatgtatcttatttggtctaggaagtaacttgattttcttttttcgattgatccatgagtgcttcttcttttaattcaaagatatattctgagatcctcataatcacttttttccagtcttctggtgtgatgattccttttaaaatatagatttttttgatatgagaaggcaattgtttcaaagggcagtcgctgataacgatgttgcagttctccataaaatcattttgtattttgatcgattcatttgaaaaaatttgttctatcttaacgatcagatctttactgatataaaaatcacgcgtatagttcacaccaataacaattcgcggctgttttttgtagcgatcatacaaatgtactaggtcttcaaccatccattgcacattttccttttctaaaataactggtaacaagtgttgattttgttctctgaaatccatataaaattgttcaatggcggtttggacttctttcaatacgctatgttcttgataaagcatgaaagtaggaaggggcgtatttggttgattgaagttaagaaatccattataaagtttatttcgtgcgaatgccaatgagtaaagaatcttttctttttcaggtataaacaaatcaaatacagtacaaaaggactccaccatttctcttgaataaagaacatgaggaacgtttgctttttttaaaagtttgtattgctccaagcttgtttcttccgattcgattttcgtgatagaaagtcgagctaaaatattcactaagatgcgttgttcgcgacaaattggcagattaggtcgcaaaatatctacagagggatcaataaaaaagtcaatatattcatactctgtgaattctttttgtacgtctttcacagaagttgcaggaaaattctctttacatatttttaatagaaaatataatttatctatcatactgctatttagtcggtcaagtacttcttttttaaaaaaagtattcatcataaaagccactacttgcggatcttcatcataaaattctgtagcagtacttgaaaagatgttccaataaatatctaatgctgcatattgaatttgtacctcttttccagaaaaagactttctgccattattagaaaaggagatagacaaaccgtacaatgctaaaaatgcattaatctttttcattttcgtatacaaataagaggcactatagtttgtttgctgacttaaactgataatcgaatttgtctgacagctgaacaaagaagtcaagatctgataactgactgattcgttgcagtatcttccaaatagacgataatagcagtaagccggatcaattccttcaaaattcaactttaaaaaaggtttttgcttatcaatatgcagttctgttagattgagacgctcaaagtcttgttctaattctttgatgtatagtaaaaaatttgattcagacatatggaaatgatctgctaaatattgtgtagtaataaagaaacgatgttcagataggaaaagaaaaatatctaattttgtattgctttttttcttcaagagaaacgttttaatcgcttcttgagtttgcatgaaagaggctcctttttacttaaattgttaaaacttgaaaatattactgtttttttcataaatttagacaaaaaaacagtaaacatataggtagaatctctactatcttatttcttgcatacaaaaaaatcaaggagtgagagagttatgagatattcaaccatcttaatatcaacatttgcagccttaagcttatcgcttactataaatcagacagtccacacagaggagacagaaacagccaaatggacagaaaccaagtgggccaacgtcaatcgaattacctttcaggatgaattttcatccttcaattcaggagtcgcaaaattaagaaaaggacaaacagcgaccatcaaagcaaaaattgactattcgggagacttagcacctatactacaatcagctgttacatttgagaatgttgatcccgctttgtcgattggctatgacgagaacactttgactatccaacacaagcaagcgatatttaccttcaccgttacattaaatcaggacttgttaaaaccagcgctttttactgtcaaggtatcagatggactaccgaacgatcatcatcatttaacgccgtatagtcagcggcagacaattgagcaagattcagccatcgactcaggaggagatcttgttgaagaaccaacagataaaccagaaaatgaaaataagccagaagtaccgcctacagaaaatccagacggagaacagaaaccggaaatagaacctggagaagaacccgatacagaaactcaaccagagccagacaatgaatcaaaacctgaaataacccctggagaaaaaccagaggtagacccagaagaaaaaccagatgtgactccagaaccagatacggattctggaaaccaaacagtaccggaaacaaatccagacacagataatgaaactgaaaatccagaaaaaccagaggtagatccagaagaaaaaccagatgtgactccagaaccagatacggacgcaagagaccaaggaataccagaaaaaataaacaaaaaaacaattcaagaggatggaaaaaaagagagtaaaaaatcaaatctagcaattctaaaaataaatgaagagcagctgaataaaaaatcacgaatatttgatagcgcccaatcagctgaaaccttaaaaagtagcaaggatacaacctttgctagtcctgaaacgaaaaataaacagctaccaaaatccggagagtcacaaaacaaagttatactgtggagcggaatcattctattaagtatagcaacaatgctttctgcaaaaatatttaaacaaaacagatctctctaacatttgaataatgtctgtgaacgcatttttcaaataaaaagaaatatccagaaaacgaccccaaaataccagattgaaatctgatatttggggtcgttcatactttatctttcttcatatttattttaagggatatctgtttcttttggaagatggttcgggatctttttcactttcaatacatctaaaaagaaggtaaagatcggaatgccgacaatcaagccccaaacgccaaagaaccgttcgctaacaagtaagaccacaaatgtataaaaaatcggcagttctgttttgctggacatcaacttcggattcagcacataagactcaattagatggacaatcaaaatcgtaatcaggatataaacaacatctcggatgcctccttgggaataagctatgaaagatagaggaatacaagaaatgataacacctgctactgggatcagacttaaaatgaaaatcatgatcgctaaactcagcagctgatgaaagccaaatacagccaaggcgattgtagtgagcaacgtgtttaaaagagcgataacaaattgagcttctaataccaaaccaaatgtattgacaaacttatcggcaaaatagtaaatatcttgaaagaaccaagaaaattcactttttaaaaacaatcttgagaatacaattgtttttttcttttcaatcataaaaaagaaacttaagatgaatgacatagcaaacgccactgccatttttcctatatcctgtaaatagccaagcgcaatcgaagcgccattttgaagctgttcaaaaaaatcgtttcgctcaatataagtatggatatattgtaaaacaggatctgcatcttttggctgatgctcgtaaaaatcaataacggactggatcatgtcaaatgtttgatgaataagcatagggatatactttgtgaatgccagatagataaggtaaacgatcagtgtataaatcatgatagctaaaacacctgtagggattcggacaaatcgctgaatgatttgaacaagatgaatcatcaaataagtaaagataaatgtgagcaagatggttgtaatcatacttctaactaagaaaagaacaaaaacgacaaataataaaacagtgagacggcgtattttttcattcgccaaaaaacgctgataaacggtcaaatcgacaacctccaaataacaaaaaataaacacgttattcattatatgatggaatatgaaaataagaaagagaaagagcaaaaagaaaaaccgctaaatgacgttatcttatgagttggttttcctcataaaatcgttcatctagcagtttcagccctttttctggtcttgatgaaaattatctagcatttttcgggtcagatgttgcagtgtatccaattcttcctgttcaagtggaagataagacttgatcttttgtggaataccttctgcttgtttttgcaacgcagcaccttgaggagtcagcgtaacatttacgattctttcatcacccgtttcacgctgacgattaatataatttttttctgctaacttttttagtaagggagtcagcgtaccagaatccagacacaaatcatttcctagctctttcactgaagtctttttcttttcccataaaactaacatcacaagatactgggtataggtaagattcagcggcttgaggaggggagtgtagtgtctaatgatttccttagaggcggcatataaaggaaaacatacttgattaactaaatatagatcttccatttttccacctccgctgttttactatagtgtatcatagcggatttacacaaagaagtctattcactaactgctttcagagtaacttctatatttccagctgtagcttttgaatacggacacactttatgcgctgcctctaataattcttgcgtttcttccagagaaagaccttcgatagatccttcaatctctacacctaagacaaagctcgtttcactttctgaataaagggaaacttgtgcactgacagtagaagccccagagatatttttttgctgtttgatcaattctaatgcactgttaaaacatgcactgaaaccagctgcaaacaattgttcagggttggttgcattttcgacgcgtttaccaggagctgcaatattcaattcgaatgtacgatcgggattatgcacttctccagagcgtccgcctgtgttgatcattttcgtagaatacatttttttcataaaattaccacctttaattatattttatacaattgaattttacacaatataattgtggaaagcaaagaaatggattggcataagataaataagagaaagcacatgaaacagacgcgctttctcgaatagcaaacatatacaaaaaatatcagagacaaaaactaatctcatcataaacactacatatatttctcaaaaagttgttttctttcttcaaaacttacttcacgatggacctgatgaagcatccataaataaccaaaaggatctctgaacattgagttagtcacaccaaagtccatcatttctgtcatttcttgaatctctacacagccatttcgtaatgctttattatgtgtgtcctcgatatcagagacgatgatattgaaccagatcgtatttggatgttcagcagtaggagcagtcaaaccaagagacgtgttttcatccagcatatggaatctcgtgccatacaaggtaaaaaagacttcattattgcctctagggtaatctgttgcctcaatcagttgtatttcatcaaagattgtttgatacagttctagtgctttcaaactatcatttaatacaaaatcgatttccgttcctttatgcataaagatctcctctccttttcagtcgaacagttactagattcttttattataccagttaaagaaaacgcattcaaaaaaatagcggatttacttaccaactcattcgattggatgataagtaaatccgcgtcccattacttctgctacgctgctgacaatgacaaaggcacttggatcgatttcttctatcaatggtttcattcgggaaaattcatgatcagtcacaacgatcaataaaacctcttttgactttcgattatacccgccttttgcctctagcagggtaaggccacgtccaatctcagcacttaagcgaaggcggatgtcttccaaataatgctcactcatgaccataacagatttctttcgattgatacctgtttcgatataagtcatgacgattgaagtgattgcaatagataaaatagcataaagaaactcttctattccaaaaacaaacagattaagagaaacaacgaatgcgtctgtaaaaaataagccaatcgaagtattcaagtggaaatattttttaaaaatgaggggagggatcgtcgtaccgccgctagaagagttgtttttatataaaatcgcaactcctaaagcaaaaatcgcacttccaaaaatgacagacaacaaccgatctgaagtaatcattgtttctggaactattgcaatgattaaaggaaaaaccaagcttccgaaaagtactttaaaaaagggttttttacctaaaaatagaagagctagtaccaacataacgatattcaacactaaaataactatagctcggtcaaagcctaaagcagcttccagtaatattcctagaccgctgacacctccagcagcaatatgatgaggccctaaaaacatattgatagcgactcctaatatgaagagggcaaaaataatcttaatgtatgtccatataaattgtctcgtttctttcatttatccacttccttaattcattaataatactcttatcttattataacttacttttcaccttaagttaactttaattaataaaaaaattaggctagtctaaattattatgtttcattcttctagaatatacttctacgttaaaaactgttaaaaaacttttactttagaaaattggagaaattgatcgcttaagataaattcaggacactaaatagtacaggaagtagattaaaacttttaaaagttttaagtctatctatttggcaagtttaaaaacgtctaaaaacatgtgtcaactcttttttggaatttacataaaatgtttcaatgaagcgcgacaacgttgtttaatatatcattaaaaaaaataaaggtcaagctaaaatattatttaagcttgaccttattataatttcaacgattgtcaaaagtattatttgcagctgtattgccagtttctatagataaatcacagcttttgaaacataagttttgtactgcttcgattcgcccgaattcttttgcagttatttggcaatgagaaaagcaaacatcttctataggcttttcaggaaatgctactaaatcaaaagctcgggaaggaagtgagtaacctggagaaaggcatgcctgtacgtttttgatgtgtatgtctttgactttcgtcatttgctttgattcaggtatttcttcagccactgcttgccaactttctggcatttgagcaaggtcattgctattttttctattgtattcattatgccagtccattatccaagaaaaaggaaattgtacatcaatcatattcagattttctaccctgatattttcgatcactccccctctttcttttgaagatttcattcgaataccacagtctgactgaaaaaaatcgatatcgtgaatatatacgtcactaactccagcactaacttcgctaccaatagttacaccgtatcctgaacggattttacatctagcaacctcgattcttgatgattttcgattgactcttgcaccattgccatctctgccagacttaatagcaatacaatcatcaccacaggccaaatcacattcatagacacgcacatttgttgaagaatcaatatcaatcccatctgtacttggtccatcattgttgcggatgattactttttctactaatacatcgttagaataagtgatttgcaagttccaaaaacctgatttctgaaaaatcaaatcacgaacaacaacatgttctgcatgatacagtaaacaagcgcgtggacgtttaatagcataatccgcaatccaacgaagtcccttttgatcgtattcagctcttgtcccgcttttttgatcttttccccaatacagctcccaccaatggtctccttgaccgtcgattattccttttccttctataagaatatctttcgccgagagaacattcaaaatcgctgctggccatttcatttctgcgccggctactcgtgtatcgatttctggaaatgcttcgatatctgttctccccttgaggactgcaccttcttcaaagataagatgactcttatcttttaaaaaaagggctccgactaaataaatgccttttggaataaatacaggtaagtgttctttcgcaccttgatcgattgctttttgcagtattattgtatcatcttgttgagtgtcgtttgttttaaagttcaaagcattgataatccctttttttgtccgcaatacgtttctccctatctttcattgatttttttcaattcttcaccaataaatacagtttttgaacgattcagtgggtaacctactagcaaaatgattgcggatacaaataagcagaatgctggtaacaagtttgccatcgtataaatcctttcttgtactaaaactgattggatggctccacctgttgtagacgattggtaaccaatgagtgccagcataaatccgcctaccgctcctgcacatgcttgtcctacttttctcgcaaaagaatttactccatatactgttccatcttctcttaagcctgtcttatattgatgataatcaatcacgtcagtaatgaatgcccagaccatcaaattgaataaaccagatcctaaagtagcgataaataaaagaatcagatatacccatgcatttgttatatgaaggaaatacatcagcaagtacatacatgaagaagcaagtaacgcaaatacgcttgcttcctttttaccaaataattttgtcagctttgtagcaaatggtgctaaaactactactgttccgtaagtaaataaaagagcaacagacattgcttgtttattatggaagtaatcattgaataaataagtcatattcgtcccagctaaaatctgattgatcacaatgaaaatgtcaacaatgactaaaataatcagtgctcgattagctaacaaaccttttaccaactgagaagcagatactttttcgtttttgacaactcttactctttcagtagtcaatttacaagttaacatatatgcgacaaatgcaattgcagcacatccgattgaaatccaaaagaaatgattccctgaaacgacttgttgtccactcttgttatgggtatacattaaaatcggaatgaagaatcctgtagttgatccgccaatcgcagaaccaatgcttcggaaagtggacaacgaggtgcggtcattaggatttgagctaattgctgctgccattgctccatacgggatattgattgttgagagaaaaatcccataaacaatgtatgaaacaaaaatataagcaatcttcaccgtcattggaagatgttggacgaatggcaaaaacaaaatgacagtcactaagcaaaatggatacttcatttttctgatccaaggaataaatcggccagcttctgttaactctgagacatcacataatcttccaaccatcacatcagcaaacgcatccaaaattctcgaaatcaagaataacgtacctacgattgcccctgaaacgccaagaacattcgtataataaatcatcaagaaactattgactaaacctaaaataaaacagttacctagatcaccgaacatgtagcctatcttatcggaaatcccaaattcctttttttctttttttactgtatttgctgtaacagcattttgtgaaagcatttgaattcctcctacctcttctagtaaacgttttcaaaattataactctttttttcttgtttttatattcacaatgttggctttttattgcattatcttgacagataaaaaacaaaaaataatctaaaaacattgatacataagattgataactttttttacataacaatatatacaaacaaaaaaattcactaactagtgaaaataagttagtgaacctcatttattaaagaattaaattacagatgatcttttccatcatacttaaaaaactcaaaatcagcataacttcctctttttttatttagatcatgcactgctatcccgataaaatttccagtaaaccctcctgagagtatacacatgtttttttgcggacctactttcttccattcttcagttgatacgtctttcaaatgaaactgtgctgtctctttctttacagtgactttcaaaaaagtcttcttttctgtgagtggaatcgtccaatcttctatttgtgctactccgttttctgattctatcatacgtaggcattttcccttgtcctcattccaagtaacataacaataaatataattggattcatttaagtacagtaccagtccagccatctgattaaaattattaggcatgtattcaaatgctgtctccgcatcaaaagtaaaatccgtttgccgaatagctaacaaatgatgttcgaaggtagattgaagagattcaccggaaatcagacgtaaaaaacctggtctacattttgtatcacaccaatcagcatttggcaaaatgcgtctggcattccagttcttctttagctctccttcaaatgtatccataaactgatgatctttttcttgttgtacctcttcatttgtcttaatcattatttcttccatcggagttgtctggctatctttaagtcttaaccaatcgtcggacgtccaatacacttcttgaatagcggtttctcttcccaaaatagccgcaccgtttaatggtctggtacaaagatatgtcatgtaccatcttcctgacggggtttgcactaagctcccatgtcctgtacattgcaatgtagaagcaggtttgtcactagctgtcagcataggaaaaccaggatcaagctcgtaaggaccagtaatattctttgctcggcaaactgtaactgaatgtcctcttcctgtaccgccttctgccgtcatcaaataataatacccgttacgaaaatacaaatgtggtgcctccgttttcgctaattctgtacctgcaaatattttatagatgggaccatcaagcttcttcttctctgcatcatattcttgtaatacgataccgctggatttattcggtgtgtccagacgataatcccatagttcattgacaagccatttttttcccgtttcaagatcatggaacaaagaaggatcaaagccgttactatttaaataaattggttcggaccaaggacctgtgatctcagatgcagtgatcaaataattgtggacatctttaaacggacggcctgcacttttgacatctgtgtaaacaagataaaacaatccatcagcataactgatctgtggcgcccatatacttccatttgtaggatttccttgcaaagatacttgagtggtcaaaatatccgttgtatgtgaccagttgactaaatttttcgactcatatactcggattcctggaagccattcaaaagaggagacaataatgtaataccgctctttcactcttaatatattaggatctggattgaatcctcttaaaataggatttttcactttgatagtctgcatgattcaggctccttttctcattcttactcgatataaactgaatgccccagctgcgaaataaaaaaatgcaaaaggaaacgcaataaactgagtgccaatcaacaatatgaatcctgttataaaatacaaaccagtggcagttgttaagtattttcctttagcagtcaaaaacaatgctactgctaaaaaagcaagtgaaataaacaacacaacggcaaacagaccagtcatgtcctgtaataatccaaatgtattttctaaagacaaagttggatgatctacagcaagcgactgataactttttttaaactctgacgcagacatattacttaaagtaactgctaacccgccaaagaaaatcaaagatagactgccaccgaccattcctagcaatagttcccattttcttttcatttctgaaccccctgcttttctaaatgtatccattcaggtcttttgatcgatgtttcataattgttattacgttcagagaatttgacagtctgttcatttttcttgtcatcccaattatcccaaccagttgggtgaacatgcccacctatcttacacgcttcaaataagacatttgcatacggacgccacggtcttcctaaatagacgtttctagtatcaggttctgcagtcaaggtacagctttcaaaacgataccctgttttttgatttttcggcgtagatgctgctgtgatgtatccaggatttttactggctaagctatggatatgacactgatgaaaaacggcatctgccccaccaaatatgaaatccaccgttccttcaatccagcaatattcataggtctgacgacaatactcaggattggtagaagccggtgtacaaaaaggagtaccatctttttgcaaatcaggcaacggacccgtgcataaggtatcctgataaccagatagtcgacagttttttaaagatacgcgatctcctgaattgaataaagcaacagcctgtcctaccttttctcctggacctgctgtattttcgatgtgaagattttctaatacgacattcgatccttctaagaaaaaagtagcacttcggaaagtccctaactggctaccgtcaagatactcctgttttgcaaaacgattaccggagatcactactgttcctgctcccacaagtttaaaattggataatctgctttctatatattcatcatatcttccttcttttactatcaagacctttggatggctatccggcaggcctgccaaataatcgattccttctcggatagtttcaaaatccgtcggggtatctatagcattctttccaattatcagtttgtctttcatcctcataaatgctcccttatgaattgtttccaaatatttctcatttcttgtgtttccatatgaccgcctgttaaagaaaaagaagaaaagttttctggactacccattgattgatactttttgtccagcccttttctcagcttcagtacgccttcgtccaagcacatcgtatcgttttttccaactaagctaagacgagggcgcggagcgattttttcttggattgctaacgttgtataagctgtcaatagatttggcacatagtaataaaacccatgatgatctaggcggcgatgtagcaaaagtgtttcgatgtccacctgtgccgctagatcaatacaaactttgacacgagaatccaatgctgccacccaccagcttaataagcctcccatagaaagaccaatcgttgcgagccgttgagtatctgtgtcttcccttgtctccaaataatcgatcaagctgatcacatcataaatacgcattccccataacgtttttcctgttaataaaaattgtttgaacaactcgctttcagaaatacctccgcgttcttcaaatccccaagcatcaatcgaccaaacagcatatcccattcctgtcagtacttctgcaaaagatggagaagctaagtaaggagcaccatggatcaattcacttttcccgactgaaaaatctccgccgtgagaatgcaggtaaaggaccgtcggaaacggtccttctttttctggataagcatagagggctggtactgtttccaattcatttaagtacaattgatagtattcaagcataaaaccgttttgtttttctcggtataatcgttttccactaggggtacgtctgctagatggagcacctaaaaaatcattcaactgcataagcaaagtttttacgaacaaccagttcatccatattttctgattgatttgattggaatttctcaatactgatttctttagtattttctaatagaaatgctggtccctcgtgattttcaatcgacatctggttaaaggaaaccttacccgcaaagccaatataaaatccttgtctgctcatttcctctattcctgtcatcatagcaggaacaccgggaactgcatcttgggccatcgagacatcgatattgtcaaatgtgatttcttgtatgaattgttccgctaatccataaataaaacctgcagaagcatggacattccttgccgtgatattcgaaaaatggatccttctgaatgctggtgtccgttcatctatcggataagcctttttttcccatacatacggttctttccctcgcggaccacagaaataataaagattcagtataaatggacacatcacattatccatgactatattggatactcgaatatcttcaacgatcccgcctcgacctcgtctagatttcaatcgtattcctcgatcagtttcttggaagatacaatttgaaatggtaatattacgaatactaccactcatttcacttcctaatacgacaccgccatgtccatggaccatcgtgcaatttgtgatcgtgatattttcgcaagcgatcctttcgtacgtatcttcagtccctgccttgattgcaatacagtcatctcccacgtcaatatggcaattactaatacgcacatttttgcatgattctggatcaattccgtctgtatttggtgaatccgctgggttcaagatcgtcaagttatcaaacgttgcattactgcaaagaatcgggttgatcgtccaacttggtgactggatcaatttaatatctttcacagtaattcgatgacagttatggaaactcatcaatttaggacgaggataagcgagattatctggttcatttctaaaagtatgccaccatttttttccatttccatctaatgtaccgaaaccagtgacagagatgttctctacattttgagcatagatacaggaagcataaacttttcgatggactccttcccaacgtgaatgaacaacaggataatcttttggatcgtcagagaatttcagaaccgctcctgcgcttaaatgaagttcgacattgctttttaaaaataaagctcctgttagaaattcacctgctggaacaactacggtcccgcctccgtcacttgctgcagcatcaatggcttgttgtattgcttcagtattcaattcatcaattgatgcgccaaatgtcaaaatatcatacatatttataatgcctccacttcaatcaatgcttgcaagaatgcaccaacgcctttttgatcattacaaataattggttcactgatgtagtaagcatatgaaccatctcgctgatctgctccgcctaaccctgctacttgacagtttttattcaagttcagccagccttcttttgtttccagaacaaattcatcaagtaatccttgatgtgatttcttcacttgtggaagccattcttctttgttcagcaggcccaaacttattcctttagccattgcgtaaacaaacatactactgccggaagcttccagataatttcctttccgttttgtttctgttgttacttgataccatgtcccgctgttttcttcttgatatggaagtaatgcagccagtgtcttttctagaatttctttcagcaaagaacaatctgtttcttcatgaagtaattcataggtatctgctgcagccatcaaataccagccaatcgatcggctccaaaaatgatgggatagacctgtttttggatcagcccatggttggaccttcttttcatcccatgcatgaatcagcaaatttgtttttggatcgaatagatgtttataactgatttcaaactgtctcaaaacatcttggtaatctttttcttcactaaaattctggataaattcagcataaaaaggagaacccatatataagccatccaaccaaatttgataaggataaatttctttatgccaaaaagctccttcggatgtgcgtggatggtttgccaactgctgggaaaggagttctgctgcttttttatatttttcttcgcctgtttctttgtacaataaaaagaaaagctttcctgtatttacatggtcgatattgtattcttcaacgctgtagccacggatcgttccatcttcttgcacgaaatagtcgatattgtcttttatgaaatcaaaataaattttttcttgggttcgttcccaaagtaattggaaccctttaagtacgacgccatagtcataagaccattttcctttataccacttttcttcatataagcgaggtgttctttccatgatactttttgctaatttctttgaccagttttccattatttgctctcctttaaaaattaaaataggatttgggacaaataccaagaagtatttgtcccaatcgtctatattactgtgccgctgctttgtatgcttcctcgtactcttgtgtgattcgatcgcctccttgtgctttccagtcttctacagcttttttgaatccatcttcgtcaagctgtcccatgatgtattgcaccgtagcatcaatgacgattttttcaatttctgatcctacttcattgttcgtcggtgaatccaatggcacagaaggatccattacagcaaattcttcattttctttgatcaattgattagagaattctttttcagggtctgtatctttgaaagagaacgtcacttcactaggacgagagcttgataacggttgcacctcttgttgccaaagatccatatcgataaattcgatagaaccatcatcattcaattcataatgcgttccttcgataccgccagtcatcaatttatacacatcttcttctaaaagatcatcaacaaattgaagtaatttcttcaattgtgcttcgtcttttacttgagatttgggaaatgctagcaagccgccaataccatttccttctgaccaaacatgataaccgccgccttcaccatctgagatcttgtttacaggcactaattccatatcatcttgaataccttgacccatcatcttcagattcttgatatccaccattccagtgtagattccagttcttccttgtgcaaattgttcttgctgatcagtcttttgggtaactgcaaagtcttgtgccaaatagccattctcaaatagatctcttgaaaaattcaaagctttcatatactcttctgtatcaaattctggagtgaatttgccattatcgtctacagcccagccatttggtgctccaaaataagaagtgaaaagtttaaagctggtataacgaatatcactaggcgcacgatcgccaaaaccaactgtgtcgtccacaccatttccatcaggatcgttttctgtaaattgtttagctacttcataaagctcatccatggtagttggaacatctagtcctagattatccaaccagtcttttcgaatgactaagccagcacgagcgtagtctttttgtatcggtacgccgtacaaggcaccgtcgatactcgcagcttcgattctatcttcagaaatttgacttaaatttttatagtcttttaaatattctgatacatcccagaatacgcctgattttaacgcattgcggacagaagagtttttcaacatcgcaatttgaagtgtaacgatatctcctagttcatcagaagccaatgcagttgttaatctttcttcttttgaagcatcaggaatccagttgaatgtcagttccgtatcggttttttcttcgatcaagttcacaatcgtgtctgtaggcggtgaagcatgatgcaaaatatttaaccaagtgattttagcttttccatcttctgtctctgaagaactgttacttgaactgctgccgcatgcggcaagtgctagaattcctgcaaaactaagacctaattttacgagcgttgcttttttcataaattttctccttcactgttttaataatatttttgttttcttctgttttttctgtatatgagttcttccattccaaatggcaaaatatagaatttgctgtccacgtgactgcggaaaagaagagactgccaccgataaaggttaaaacacctggcattgtttggatgatcatcagataaatccctaccatacttaatatcaacactaatgagtaatgaagatgtgagaatccgaataaaaatgccattttcattttgaaaaaatatcctttccaatcataatgagccatgattgggaaaatatagagtgctgagagcacatatatgaacgcagcaatatacaaagcgatcctaagataccaattgtatatgaaagaaagatccacaagtaaaacaatcccgatggcgccatatatccagctcatcagcaaggtttcacgatagttttctttaaaatatgtgaagtacgttttcgtcaaaggaaacgtttcttttgagcgcagccattttctaatcactgcaaccatcgcatacgatgcaggaccgaaagtaaaaactcccaaacctgcgatgactaaaccgccccacagaaaattcaaataaaccaactgtaaaatacgatttagccttccgtttattttatctaatgactgcagcatatctttccctctctttctatcttagtaaacgccgtcttctcctagctttttggcaatcttattagctaaaattaccataaacaatcctacgacccctttaaacaatcccattgctgtactgaaacttaactgtccattcttcaatccagctgtataaatataggtgtcgaaaatttctgcaacgcttcgattcaatgaattcaataacaagtacatatgctcgaaccctaagtctaatgtctgaccgatttttagaatcagcaaggtaatgattactggac

SEQ ID NO: 25 - DNA, 2819516 bp, Enterococcus faecium (residues 1,409,759-2,819,516 of 2,819,516)
  source 1..2819516: mol_type = genomic DNA
gaattgccggcaatgtaacatgccatgttttgcgtaagcgtcctgctccatccatttctgcagcttcatacaactgtgtatcgactgcagttatcgctgaaaggtagatgatcgtagaccagcccaactctttccagatcacttgtccgatatatactgtgcgtgtccattcaggggatgttagaaaactgattttttcaaatcccattgttgcaaggaattcattcaatacccctccgtcaacattcaaaaatacataagtaatcgaaacaatgattacccaagacatgaagtgagggatgtaaatgatcgtttgaatcccgtttttcaatcgtttgttcgttacttcatttaatagtaaagacaaaatgattggcatcggaaaaaacacgaagatatttaatccgaacaagatcaacgtatttcttaataatgtaaagaatgtcggttctgtaaacaaacgaatgaaatgtttgaaaccgacccaaggacttcccattattcctaaaaatggttgataatcttgaaaagcaataacgagtccccccataggaagatacctaaaaatcaagaaataaaggactcccggcagaatcatcacatataaaaatttattcgttttgattcctgcaattattttttttcgtcttctgagcttttcttcttttttcgatagcgtcagttgaaatggttcttgtttctttacactttccataagcccctccttagttttgtgaatgtttgctgcttatgacttcatgatagataactatctgaattacgtatataatcatttttatcgtaagtaaaaacgcttacatagaaatgatttttgtgctatacaaaacgataaagtgtattttttcacaaataaactacgcatagcaaaccttctatttttttctatctgacacttagcataggaaatgattatatacgtaatctttcaccgatgataaattgaacatatagaaacagaaacatttaatttattttgaggaggagcctatctatatgaaaaagaaagtctctataggagaaagaagttttacacttttcaacaatacgtttctaattttgctagctttgatctgtatcgttccttttttaaatatcatcgctacatcttttgcttctacacaagaagtcgtcgcgaaaaagtttatcctttttcctactaccttttctttagacgcgtatcgctacattctttctacgccgaccatttttagagcacttgctgtttcgattggtgttacaggtgtcggaacgatcgtcagtatgtgtgcaacttcactgatggcctacggtctttccagaaagtatttgtttggtcgaggtttcgtcaactttcttgttgtattttctatgttgttcagcggggggatgattccaacgttcttagttgttcgttctctagggctggtcaattcttactgggccatgatcctgcctgtggctgttaatgcaatgaatatgatcattatgagaaactttttccaagccttgccggatagtttggaagaatcagcaaaaatggatggttgcacagattttggtgtatttttcaaaattatgctgccattagcgttaccgtctattgctactatctcgcttttttatgctgttacttactggaacacttatatgactgctattttgtatatcaacgattcatctaaatggccgatacagattcttttacgccaaatcgtcattgtatcaagtgggatgcaagcagaaagtagtgccgttgatgtgattccaccagcacaaacagttaaaatggctgttatcgttattgcaacagtgcctatgctgattgcttatccttttgttcagaaatattttgtcaaaggagcactcgtaggttctgtcaaagggtgattatgtactgaacgcaaaatggtagttgtgtcagaagtggtcagcttcaagaaataagaaggcatttacgaaaattgcttcttaaatttttgtgaaatttcggcttatttttcgaagaatctactcctggaacaccgtgtatcagaggttgtgaaagagacgttcagccttgagcgatgataaaaactctcacaaacattgcgacgagtaacccacaggagcaataagaagcgattttgaaaaatagcttcccatatttcacaaaattatgccttattgtcgataggctgtctcttgaacgccatttattcgtaaaaaagaactgtgacaagacttttgacacagttctttttgcgtgcttagccttgaaatttaactatccataaatacaaatactagggttattctaacttcttttattgcttgaatcagtccacaagaaaaacagcctcttgattcacaaatatttttttcgatattctcccggcgtaatcgactccttctttttaaagaaacgaataaaattttgcggatttcgatattgcaatctttctgcaatctcttttacggagaggttagtctctttcaaccatttttttgctacctctaaacgatgattttgaacaaaatcaccaaatttttctcctgtttcctttttaaatacattacttaaatagttagggttataatgcaacctatcagcgatcacatctaaagacagatcacgatcatattctgtgtagacgatatgcataatattctccgacaaatttttaaattcatgatcagtgattgcttgagagcattctgtgattggcagaactaattgttctaaaacaagtttttctagttctttgggatgataattgttcagtgcttttacataaatttgtttcatgttatcaaagttttttgaatctactcccaataactgtcctaattgaacgagttcattgatcaagcggaccgaaactacttcccgactcaaaggatttttattttgtgcaaacaatgcatcaatcaattcatgtactaaattcttcacttcctgatttccagaacgaatggcttcaaacaatcgattttgttcttctatcggatatctaataagtgttttttcatgagcagcaggaacgatttcctgataaaaaataattgaacttggaccagtatttacacgataatacagggcttcttttgcccgatcaaccgattgcttgctttcattcagcgtttcgaaccggttactgatgcctatactgatagttaaattcaagtattcttttacacgtttttgaatgagtcggcaatactccatgacttttttgcttgcttctgcatcatctttatccattcgataaatagtggcttgcatttcttcattcaaaacgatcggcagcattcgattttcctttggcacaatttccgtgatcatgttgttgatcgctaaaagtagcaaatcacgctccccaccgtgactatcttctaacagatcgatttgaaccaaagctgtataatagcagtcattttgagaactataaccaaattgctgcaaccgctgatctagttctcgcctttctactcgatttctaaataaactaagtacaaatagcgtttccagctgtggcttttgggtaactaagtgtgcacttaacgcttctttttctcctatgatccgactgactgattgagcgaccaaatctagttctttcccactgaatccttttgatttaagattcagacgttcctgtatttgagaaatcggacgggcaaatctgtccgaaaataagtaggacagaagaccaatgagtcctaccagtgttaaagacactgcaactagcccgattctcagattgcggatcattgcgccaattgcactagagtcaacttctaatctgtaaatccaattattataatctgatttcagtactatatacgttttatctttttctcttatcactttcagctgattgtaatctagatccacgtccgttaatacagttggttgctctttattttttactgtctgagtagtaaaaaggttgccaacttcgttttcaatagaaagtatgtcttctccactttcaccaacaacttgttctattgtatgtttctctatcgtagcaattcccaatgcatatttttctttttcaaacattggcaaaggaatcaccatttcgattcctttgtttttcttttgccaaaataaattatttttgttatttatgtacttctgttgatacttttcaacttcctcttcggtcagttgactcaacgatccattgattactccccatttaccagccaaactgactaaatcataattattatcatccataacaatcgtttctataaaatttagttctttcctgatttcagaataagtggagtaatctgtatatgtcagcggatgcttgaatatgtccgagaaatttttggtcgaaccatacgtagaaaacgaatattcaatcgttctaattttccattcaacgttagttttaacttgcctgagcaaattctttttgtctgttaaataactcgattcgatcgattcataggtattctggtaaatgaataaactaaatcctatgacaagtacggctcctaataaaaacatcggtaacaatattttataaaatactgtacttttcttcattttcttcctctcctccttttaaaataaaaggctttcatttttctgtaaaattgatactcatctaattaaatgagcattccccgctttcaagaatagcataattaaaaataaaaatccaagtaatttttaacgtgtgcaatcttttcatatcaaagatctattgacttatcgtagttatcgtaatatgatgaatgcgttaacaaaaagtgaaaaagtaaggaaaatgatggaatggtaacgatcaaagatatcgctaaagcagctggcgtttctcatacgacagtttctcgtgctttgaataacagcagtttaataaaaaatgaaacaaaacaaaaaatacgacaactagctaaggaaatgaattattcgccaaactatagtgcaaaaggtttagtgactcaaaaaaaatatctaatcggactatttttctcaagtttgcataaaggaacttcatcaaatttcctagcagattccattgcaggcatccattcagtattagacacaaattacagtttatctgttgaaagtatcgatgttgttgatttaacagaaatcaacctgcaacgctacgatggactgatcgttatgagtcaaagtgatgatgatcagcctttcatcgactatctcaaagaaaaagaatttcctttcgttgttgtcaatcgtcacatcaatgatccagcggttgtcaacgtcactgccgatgatacggccggtgttatgcaggcagtagattacggtattggatgcggacatacgaagatcgcttatattggcggaaagaaaaattttcgttcgacaaaagaacgggaaaaaggggtattgaaaagtctaaaaaaagcgagcatccctgtcaatccagcctattttttaacaggagattacagcttagaaagcggcctccaaaacatggaatacctattatcactttctgacctgcctactctggttttttgcggcaacgacgacatagcgattggtgcattgagagctgtacatttagctggcctccgtgttccccagaacatttctctgatcgggttcgatgattctccagtcgtctcctatctcaatccgccgcttaccaccgtacgtaagcctttgaaagaaatgtgtcaagaaggaacaaagcttttactagatttgatcgaaggcaggacgatcgaacaatctaaaattgagctctccaccttgttgatgcttcgtgagtcgatcaattacttgtaaactacaagtaattttatataaaaatgttaacgtgtgcataacacagaaaggaagtttatatgaaaaaactgacaaaagaattagtgaaaaaaaacgaagcacccgtaaaagttcttcagtttggcgaaggcaattttatgcgtggatttattgattggcagattcagcagctgaataaccaacaattgtttaaaggtaatgttgcaatcattcaacctttagaacaaggtcttgggaatatgatgaaccagcaagataatttatatacggtcattttacaaggactcagcaatggcgaaatcgttgatacttccgagattatcaccgtagtagaacaaatgatcaatccttatgatgaatgggatgcttatctatctctagcagaaaatgacgacttggcctatatcgtctccaatacaacagaggcaggaatccaattcgtggagacggataatttaacagatactcccccacagagcttcccgggcaaactgacagcctttttataccgacgtttcaaattaaacaaagctggctttaccatcattccttgcgaactgattgacagaaacggcgaacgtctaaaagaaatcattttacgctacgcagaaaaatgggatttagaacctgcttttgttgagtggttagaaaaagaaaatgttttctgttgtagtttagttgatcgcatcgtcccaggttatcctcgcgaagatgcaggtgttttcaatcaacggcataactatgaagatcaattgatggtcaaagcagaaccattcatgctttgggtgatcgaagggcctaaagaattggagaatcaactaccattcaaacaggctggcttgaatgtcatcatcacagatgatatgactccttatcgtgaacgtaaggtgcatttgcttaatggaccgcatacagcgatggtccctcttgctttgttggcggaattggaaactgtagaagaagtaatgaaagatcctttattctccgcatatgttgatcagttattcaatctagaattgattcctatgctttctttacctaaagatgaattagccatttatgctgatcaaatcaaagaacgtttcttgaatccttttgcccatcacaaattagaagcgatttcattaaatagtgtttcaaagttcagcacccgtctgcttccagtgttcaagaagtatatcgaagaacaaaatcaggtaccaccgttaatcactgtttcactagctgcgctacttcttatgtatcgaggcgatcaagtaaagccacatgatgatgaaaagacgataagcgaatttactgatgcttggtctgataatggaacagctattcctcgattattgcaaaacgctgcgctttggggagaagatttgtctcaaataccgaatgtgacagatacagttcaagaaatagctgcaaagatcgatcaaaaaggtgtccggtcagtattacaagaaatgaaaggaacgatggtccatgcttgaaacccttcaaccaacaatgaaattaaatcgacgagacagtgtggtcgtcgcattaacacctattccaaaacaaacacaactgacgattgatcagcaaacgatcaccactcttgaagatatcccgcaaggtcataagattgcattgggtgatttgaaagctggagacaacgtaatcaaatatggctatccaatcggtcatgtgacgacagacgtaactgccggtcaatggctgcacactcataatgtaaaaaccaatctttctggtgaattggattatcgatatgaaaaagatgtccatccaagtcattacccttttgagaaccgaacatttcaaggttacttgcgaaaaaatggaaaagtagggattcgtaatgatttgtttttagtacctaccgttgggtgtgtaaatggcattgctgaactgatcgtcaaacatttcaaggaaaaacatccagatctgggacagtttgaccatattacgattttaaagcatccttatggctgttcgcagcttggaaaagatcatcaaaatactcgagaaattttagcggacgcagtaaatcatcccaatgccggaggagttttagtatttggattaggttgtgagaacaatacagttcctgaattcaaaaaaattttaggcgaatatgatgaaaaccgagtgaaatttctagtggctcaagatgtttacgatgagatcgaacaaggtgtggctctattagaagagcttttaacagcggcggaaaatgaccagcgcatatcagtcccgctctctaagttgaatgtcggtttgaaatgcggcggttctgatggtctatcgggaataactgctaatcctttacttggtgcattttctgactacttgattgctcaaggaggcagcacgatcttaacagaagtgccagaaatgtttggtgcagaacaagtattgatggcacgagcggaaaatgaagaagtttttgactcaatcgttgacttgatcaatgacttcaaacagtatttcttgtcttatggggaaccagtttacgaaaacccatctcctggcaataaaacaggtggaatcactacattagaagacaaatcattaggctgcacacaaaaatcaggaagctctcctgtcgttgatgtgctgcaatatggcgagaaaatcagaaaaccagggcttagcttgttgcaagctcccggaaatgatcttgtagctgcttctgctcttgcttcatcagattgccagttggtcttgtttaccacaggaagaggaactccgtttggctcatatgtcccaacggtcaaggtatctacaaatacgactctttttgaacgtaaaggtcattggatggattttaatgcaggcgtcttattagaacaaccaatggaagtaatcttagaatcgtttgttcaaaaaatcatcgctgtagctagtggagaagaaacgaaaaatgaacaaaatgacgttcgagaaattgccatttttaaaaatggagtaacactttgattttcataaaatagtataaaaagaaagaaggaagatttatgtttttatctgatgattttttattaaaagacgattgggcgaaaaagctttaccattcctacgcaaaaaacatgcccattattgattatcactgtcacttagatccaaaagaaatttacgaaaacaacaatttcagcaatctgacagaagcttggttaggaggcgatcattacaaatggcgcttgatgcgagcttgcggcgtgcctgaagaaaaaatcacaggaaatgcttctgattttgaaaaatttttagcttggtgtcaaaccgtaccaaaaattatcggaaatccgctttacagttggtcacatcttgaattaaagcgtttcttcggtattgacttgttgataaatgaagaaaatgcagagaaaatttggacacaagcaaatgaaattttggcagctcctgattttcgccgtcgggaaatcgcaaaaaaatcgaatgtagaagtgatttgtacaacagatgatcccgcagacgacttgcactatcatcagttgcttgctcatgaagaaccagatttgaaggttctcccttcattccgtccagataaagcactcaatattgaaaaagaaggatttaatgcatgggtcacactactggaagaagcagctgaccaaacgatcaccacctatcaagaactgatagaagtcttagggcagcggatagaatacttccatcaacatggatgtcgtgtttccgaccacgctttagacatcttacgctataaagaagcggatgaaacagtattagaagagatttttcaaaaagcacgagctaacaaactattatcttcagatgaaatcgatgcttatcgtacagaaacactgatacatttgacccacttctatcattctcataattggacgatgcagctgcacatccatgcttatcgtaactgtaatacacaaatgttggaaaaattaggacccgataccggctatgatggaatgaatgatctttctttgactattcctctgcaaaaattattgaatcgtgcagaagaaacggatcagttgccaaagacgatcctttattcattgaatccgaatgactatcctgcgattttagctttgatgggctgtttccaaaaagaacagaatggaaaactgaagttaggttctggatggtggtacaacgatactcgagctggtatgcgcgatcaattgacacaatttgctgatggtagtgctttggggaattttgtcggcatgctgacagattcaagaagtttcctgtcctacactagacatgaatatttccgtcgtgttctttgtgaatttttaggcgaaatggtcatgcgaggagaagcacctgaagatgaacaacttttaggaagtctagttcaagcgattagttatacaaatgctaaaaattactttggcttttttgcctaattgattaatagtaacagtaacgaatcaaaaacaggatagcgaaataacggaatccgtttatccgcgttttagagaagaagacggaccaaatttgctccgtcttcttctcttgctgttctgcttcattgcctataaacctttatgaaagaagagataacatgcctactatccatattgccggtgattctactgcggcagaaaaagatgaaaacaagcgtcccgagacaggttggggagaaaaaatctctgcttatttttcacccgagatccagatcaataaccaagcaaagaatggacgcagcaccaaatcatttatccaggaaggaaggttagcccgtctagcttcacagtttcagccgaatgatttcttatttgtacaatttggacataacgaccagaaaatccaagaagaaagaggtacgcttcccttcggtagctatttaaaaaatctgcagatattttttgaatgcgcaaaaaaagcgaacgtccaaatggtcttactgacatctgtgacgcgacgagattacttagaaagcggaacattgaatccagatatacttggagactatccaaaagcgatgcgtgcatttgctgagaaacaccatattcctcttttagatgtgttctcaagatcacaagaattgttccagaccttctcaaaagaagagacaaaaaaattctacctgcatcttatgcctgatacttgtaaaaattacccagaaggactaaaggacaatacccactttagtccagaaggcgctgataaagttgcccgaataattgttgaattgataaaagaatcccgtctgcctcttgctaattatttacaaaaaggagtttgagatgtttccattaaatttaggcatccgtgcccacgatttagatgttcgaaatcgtgaagaaatcgttcaaaaagtatcacagcttcacttgtcccatatccaatttgcaccacaaaaagcatttcctgaacaacttaaattaactgacatgacacttgggagtgctgcctattttggtgaatacttccaaaaaaacaatatcgaactttccattttaggatgctatatcaacctatccagcaaaaatcaagaagttcgtgcacaagcattggcaactttcaaacagcaaattgctctgtgctctgcctatcaagccaagatgattgctacggaaaccggtagtgtctctgtcggttacacaaaagaaaattttactgaagaagcttatcagatcgccagaaattctatcattgaattagtcgctcatgcagaaaattttggcgtaactgttgctgttgaagcagggatcaatcatccaatctataactatcagttagctaaacgtttaatcgatgaagtagcttcaccaaatttaaaaatcattttagattgtgcgaatttgatgcataaagaaaatcatgctgatcaggaaaaagtgatccgaggtgccttggacaatttacatggttatattacagcgcttcatctcaaagactatatcatggaaaatggaaagatccgcatggtacctgttggcaagggctgtttagatttccgcccggtactgcattatatcaaatatgagcgtcctctaatgtacgccactcttgaagctactcctgagatttatgttcctgaagcaatagaacacttgcagtttatttaccaagattgttaaggagaagattatggaggaacgaatacagaaaagttatcaaaaatatcatgcaaatgcttttcagacattgctgcatctttatcagggaaattattggcgttttgccatgtcaggactcttttttattatcaaacatcttccatcttggttaatgccgatcgctattgccaatgtaatcaatgcagcttcatcgaaagattcttctcagttgcaggccatttatttcaacgcttttttgatggcttgtctgattggtcaaaatatattgacgaattattttcatgtaaaataccatagcacttcgatccgtcaagtagaagctggactaagagcgacccttatcaagaaaatccaagaactttctattccttatcaaaaagaattgcaatctggccggatccagtcaaagatcatccgtgatgtagaagctatccaaacgttgtcctctcaagtatttgtcagcggattaaatatcgctgtcaatttattcgtagctttaggtatcacgctttataaaagtcctgttgttttcatgtttttcttattgactgttcctctcgccgcattcgttactctctttttccgtaaaaggatcagacagtccaactcagacttccgacaagaaatggaagagacttctgcaaaagtgatcgaagtgatcgaattagcaccgattgctcgagctcatgggttagaaaaacacgaaacaactcgcttaaataagcattttactcaaatctatgaaaaaggattccacttagatatcctgcaatctgttttcggatcagtcagctgggctagttttcagatatttcagctgatttgtttgattttcactgggatattagctttacaagggcgcatccaacccggcgatgtcgtgatgtatcagacgtatttcacgacgatcgtcaattccgtttctggaatgatcacgctgattcctacgatttcaaaaggcatggaatctatcacttctattggcgaactgttgattgctggcgatgtagaaacttatcacggtaagaaaaaaatccaacatttggatggaaattttcgttttgaggatgtttcttttcattacccggactcactcaagccgattatcgatcatttttctctagaggtgaaagctggagaaacaattgcttttgttgggccatctggttctggaaaatctacactccttaacttattgattggatttatccagccgtcttcagggaggattttcctagataatcagcctttggatgaattggatatgcgaagtgtgcgtaattatttagccgttgttcctcaaaccactttgttgttctccgcttcgatcaaagagaacatcacttatggcttgaaaaacgtatcaaaagaacgtttagatgaagtcatcgaagctgcgcaactttcttcactgattgaccagctccctgatggtctggataccttagtaggcgaacatggcaacaagctgtctggtggccaaaagcaacgtatctccattgcacgagcgttgatacgtcagccaaaaatcattttgctagatgaagcaacctcagctttagataaccagtcagagaaaaaaatccagcaggccctgaattacctgacagaaacacccactacttttattgtggctcatcggctttcaacgatcaaagaggcagataaaatcgttgtgatcgatgaaggaaaaatcgttgaaataggtacttacgaagaactgttagctcaaaaaggctatttctaccgcttgaaaaatgaatgacaaaaaaataggagctatgacaagacttttgtcgtagctcctatttttgaataaaaggtgttctcctgccaactcctcggtcacaagtcacaatagtcatcaaacatgagaagctgttttttgaaattattccttgtaactcagagttaaacggtaggctcacgacctcttggtaaacggtgttcaagagatagcctatcggcaataagaagcaattttgtcatcgctcaaggccgaacgtctctttcacaccctctgttgtttcataaaatagttttattcgctgtaaaggtcgcgaactggtgtcatgatgatacggttcaagtcattgatgattgtactgaagccttgctctttttgcatcaagtcattgattacttcttctgattggattttcacagccatttcttgtgctttcattgcatcttcgtcgctgaattcttgtccactcatttgtttttcttgtaattcgatttgcatcgcttggaagtctttgaacagtttgtgtgcttcttcgtttgcttgtactttctcgtacgcttctttcaacgctttgaattctggtaattcacggatctcacgttcgatttgattcgcgctatcgtagatgtttgacatgttatgccctcttttcttttagtagttactctctattgtaacatggggttattcgttttcaaagggtctactctccttgatatttccgccagaggtctttagccgcttcaccaattccctgaacgccttctttcaccatatcgccgaagtttttcagcccttcttttgcttgttcaccatattgattcaagttatcttgccaatttccagactctccattagaatttcctgtgtttccaacttgatctgcagctaccacttgtcctcctgtggcataggcatctgctacactaaatcctgtttttgaagtatacggaaggatgccttctgccgctgatttgaagactttcccgacaacatttccacttgtcccttccaaatagtgcagcttgctggattcttcgtaacccatccatgtcgaaatcactacgtctggcgtgtaaccgatcatccattggtcatttgcttttgtggcatcgaaattagtttctgtggttcctgttttccctgctatcgtataacctgcaggattcgcagcagccgctgttccatttgaaaatgtaccaagaagcatgctggtcatttcatcggctgtttcctttgatatgacctgttttggttttttgtttgtgttatcgacgatcaccgctccagtcgaatcaacgattttcgtgataagatgcggcgtatacatctgaccatcattggcaaatgcactgtaagcacccgccatgatcaatggagatactcctttttccagtccaccaagggctaagccataatacttatcagattttgctaaaggcaggccgaattcttctgctttatcatatcctttttgtaaaccgatctcatgcaaaagccatacagcaggcaaattcaaactttgtgcaacagcttgatacatcggtacttctccttggtatgtcccgtcaaaattatgcgcatcgtaataactttgcggttcgtctttcaagatactggaaggcttgtatccagcttccagtgctggtgtatatacgcttaatggtttgatcgttgatccaggtgaacgacgcatctgtgtagcaaagctgaatcctctaaagacatgatctcctcttcgtcctactagtgcttgtacaccacctgtattcggatctaaagctactgaagcagattggaccatggcaccatctgaagcatttgctgggaataatgcactgttttgataagtagcttctaattgcttttgataatcctgatctaaagctgtatagattttatagcctttattcatgacatcttcttcatcaagaccatactcgttaactgcttcatcgatcactgcatcaaaataataaggataacgataaccagaatctgaattatcgtatgtgtcattaagatacgcgctgatatctgtctggctttctgcttgttcttgttcttttgtgatttttccgttttcttccattacacttagtactgtgtttttccgatcattcgcattttctgggtgatcgatcggattataaataccaggacctttcagcattcctgccaaagtagcagcctcagacagcgtaacattcgttgcatctactccaaaatactttctggaagcgtcttggacaccccataccccgttgccaaaataggcattgttaagatacatggtcaagatttcttctttgctgtacttcttttcgatctcgattgccaaaaataattccttcgcttttcgatcaaacgtttggtctaatgtcagatacgcatttttggcaagctgctgagtgatcgtacttcctccgccccctgatgttccgccagacaagaccattcggactgctgcacgggcaatccctttgatatcaaacccgtgatgctcgtaaaaattcctatcttctgtcgagattactgcatcttggatatagggagaaatcgcgtttaattctacatatgttcctttttgggcgtacagtgtgccagcttcttcgtttttcttatcataaatgactgtcgattggcttaatcctgattttaacgtttcgacatttgcttgttttgctaaaataaagaggtagatacttgtcactaagacacagatcaaaccaatcagcaaaatcaatttgttcacatgatattttttccagatgcgctttcgccatcgatggaattgtccgagatatggtctgatccaacgccaaaaactgatcaaagcagcttttatcttttctaaaatgctttgaaaatccatttgcttcttctcctgtctattcgattcaatcgtcttattttaccatagtgaaagagtgttttcttcctgcttaagttgtagttcaatatgtttttttacgttagtgcaagtagagtaacataagaatgaacagaaaaatgtaagttttttcttaaatatgttttaaaaatggtacaattagtctgcaattgcactgaaaggagtacacttgtgaaaatcacgatcactttacctatgaaccatcctgaaacaacgattcgcgacttgcttgaaaaggaatggttagtccctagaaaggttcgacactttttgcgtatacgtaaaaacgtttggatcaatcaacaacctgctttgttccatcatgaagtaaagggcaatgaccagatcacattgttattcgaagaaacagattataattatcaagaagtccagcttggagatgcggcgcacatccgcgttttacatgaagatgagcatttgattatagttgataagcctgcaggaatgaagactcatccaaatgaaccgacagaaaacagtaccttactcaatcatttagctgcttatctcgacactaaacagcaacgaccttacgttgtccatcgcttggacaaagaaacaagcggtgccgttttatttgcaaaaaatccatttgtcttgccgatacttggaagaatgttggaacaaaaaatgatctatcggagatatcaagccatcgtatggggagaaattgccaaagatatgaccatcaccaataaaattggacgagatcgccatgatcggagaaaaagggtcgtagatgataaaaatggtcagagcgccttgacacatgtcactgtcaacaaagtactttctgaacaaacacaagtctattgtgttttggaaaccggacgtacacaccagatcagagttcatttagctcataagggacatccgatcgttggagaccctctctaccaaaatagaactgctgaacgactgatgctccatgcattagaactgcacatgatccatccatttactcaagaaaaaatagtcggtaaagctttacctggattatgggaatagaaagaaaaaagaacagagtcttatcagcagataatgataagactctgttctttttgtgtaatttgtctgcttacttttgatgttcgtgttctgctaacagcaaactaccgataatcccactttcattcggcagtccccaacgaacgatatattcacttacttgaggtgtttccatataaccacccatcaattcaacaaattgctgacggattttttgaaggagatgatcctgattcattaccccaccgcctaaaataatcttttcaggtgctaacgtcaacgtatagttgatcagtgcttgagcaatataataagcctgaatagcccaaacaggatgatcttgcggcagatcttgccctttgatccctgtgcgtgcctcaatagacggtcctgctgctaatccttctaaacaatctttatgataaggacaagtaccttcataatggtcatctggatggcgtttcacccaaatatgtcccatttcaggatgtgcgatccctgaaaaaatttcttcattgatcacgacacctgcaccgattcctgttcccacggtaaggtaaatacaactattttttccttgtgctgctccttgcttcaattccccatatgcagcagcattgacatccgttgtccaagcagcaggaatattgtagcgttccttgattgtgccaagaaaatcgaattgtgcccacccttttttgggagttgccaaaacgtatccgtaattatcttttgttttgtcgataccaatcgggccgaatgagccaatcccgattcccttcaattcataacgatcaaaaaattcaaatacctgatccaatgtttcttctggtgttgtggtagggatacttaatttttctaaaatttctccaccgtctgaaaccgcacacacaaattttgttccgcctgcttctattccgccatacattcgttttcctcctcgaatccgattgtccgaatctcataaggttggattattgggacaaccgcttgcttcgttggttcttcaagcagattcaatatgacagtttttccattgtctttagttatttccaatttttctaaatgaatagacatattgaaacctcttactactactttatcactaaacttgctgcgtttcaaagctgtaattgcaaacgtttcactttttatcgttaaatattgttgttttgaaatcaatgttccttcatgatgtttgatttgttgagtggaaaaaggaatctgtgctgcgtatgcatgcaaataagtagagaatttttcttctggtccatgtagttcaatgctgtaattgaaccgatgctcacctaaacactgtgcttctggtgttggaaaatatccccaatcgcctagttctcccacactgcgaagtagcgtcactgcgatttgtccgtcttctgttacttcatattcattcaaaccaaagtttccgactgttacaccgtactcttcatcatgaatattgacaaatgcttgctgatgttgcggattcgtggggttttcccaacttttagacacatggtttgggcgcttcaccacttcaaaaatactatctgcttcgtgatgttccacatgtaactttgtaggaaacaagacacgtaagcgatgatctttcatctgattgtcgagagtcgtttcaaagtcgatttttttactatcttttctgattgtcatgattgtttttatttgaaggattcgtttttctttggatcgttctgcttttcgataacgaaattccacaaccatctgctgttctttttctaaacgctcgtctgcagaaacagggatttccatttcctgtagaatacttatttttgctatttccggtgtatctactaatacttttacttcagagttttctttgttactggataggattggctgatcacagaaaggttgtttaaagatatactcatttcctatatcgccgatatcttcaaaaatatgcagattattcaactttcgtttgtttttgcgatcttccattgtaatggtaccatttttttcaatcgtcaaatgtagagggccgttttcgatgattcgtccactctgatgaatcattgtttccttttcttctgctttcgcttccccttctacaagcgcgaatgtttcccaagaaaatgctggcatgttttctaatggtaaagtcactttgatcattcttgccatatatggcacacggaaacggtctttcggcaaatcataaccaaattggacagtttcttcagataaaatagctggtatagtggccccactttttgtttctacatgatacttacgtttaggcaaattttctaactcttgatatagttgttcaggtattccttcagcgaatctttttctttctaattcgatggttatttctgcttcaccagttttatccattcctgcagtatttacaatgacaaatggaaagctgtcttttgggaatccggtcgtatcgattgctgcggtcagctgttctaaggaatcttgtgcaagatactttccaacttcatctgctttttcaaaacgaggtatcatttcccgatggacagaatcgactgaacaaccgcaaatactgtcgtgaggatgattttgtattaatgtcttccaagcataatctaattgatcatggggatagtttccactaacttcataagccatcgtcgcaagtggttctgtaatattttctagctgtcgctggaccttggtattccattgttttaagtaaacccgagcagatgctgtattggctaaagtataccagccatccgtttcttgacttgtcaattctccttctactgagcctaagtcttctggcacatctttttgaactgcttccagatagtcagtaaaattagaatgaataaactcgtaatctggaaacagttcatttgcgagatggattgcttttgatatatctttttgtaccggttgatgatcaacaccattcatcatcaataagtggttcgtagaggcatattgttctgcatccgctaatttttgcttccaaaaggcaagagctgcttctttttctactggaatctcattcccgttgctataccaattggcaaatagcagaccaaagattgctgtttgatcaggtcctttccaccacatctctgagtattgggaagaatagttttctgcttctaaaacttgattatcaaagccaattggttttacaccacggccaaacgctgctgctgaaataccagcttgtttcattaattgaggcgtctgtcccatatttccaaatgtatcgggaaaatagcctaacatgacaggggttccccatttacggctttcttccatgccaatcagcatatttctcacgttcgattccgagctgataagaaaatcatcttgcaagatataaaatggtccaattctcaattttccttcattgattgcttgttggattgcctgtcttttttctggccttacttgaagatagtcatctaaaataatcgtttgcccatccaaatgaaaactgttgaaggacggatcaacttcaaatagctctagtagatcgtctatcaattcaatcagtcgcatgtgatgctgttcgtaagccatgtaccattcacgatcccagtggctatgagaaatgatatatactttctttttcatttacgatacctcctacttttctactctaatatcaaagtaatccatgactaattcgcaaaacatcatatttgcccaagaaaaccattctctcgtataattttcaggattgttcacatcgaatccttcgtgcataaggtgtgttcctgcgtcagttgctacaagtaaattcaatatccgctctttttcagatttgtctgacgttgtcattccttccatagctaatgcaatcggccaaacgtatttttctggcgtatgggaggatccaattccttttgcgtactttccttcatagaaatatggattttctttactcaacaatgttcttcttgtttgcagataatcttcctcttgttcagaacaatatcccaagtaaggtgcggcgatcagattgggcacattactgtcatccatgactgtggcgtttcccattccatctacttcatatgcataaatcgtttgccctttttgattaaccgttcgtccgtgattctgaatcccatctcggatctctttcttcaatttctgtgtttgctgtacaatttctttatcatcgagtatcgtttgaaaaatttcttccacataacctaacacgaccaccgcaaacatattggatggtaccagatatccataacggcaagcatcatcgctaggacggaaaccagaccatgtcattcctgtaaaagctgtttttgcacctcgcccgtcattgatcagcgtatcttcttttcttgtcgtgtctcgtacaaatgtataaggagagtgttcatgatcttgctctgttttgaacacgtccaagatttttttgataccttcaataaaagattgattgaattgatcagtttttcctgtatttttgtaaagaagataggccaactgtattgggtagcataaagaatcaatttcatattttctttcccagatccaatcgttcatttttgtatgatctgtttggtggccagcaccgttagcttcttcgttgaaggcattcgcatatggatcgatattgatataaaaaaattgctttttgactaacccgctgatcatgtcagctaattcctcatcttcttttgcaatcactaaataaggacgaacttgtgcagtagagtctcttaaccacatcgctggaatgtctcccgtcaataaaaaggtggttccgtcattttgctttttgactgttgtcaacagagtattggcaaatgctgctgtaaaattctttgcccagtccgcatggatatccccacatttttgtgtgatatcttccataaatttctgcaccgattttggtatatctttataaaccactaataaaaccttctttctatttgatatatctttaaagattatacttcatacagccaattatgtctacgctttcaaaaaaatatctttttatttactttttcatccattatggtattatttaaatatgatatatcattaagaggtgtttatatgaatcaaccattgtaccagacaatatttaatgatttgcaaacggctattttaactggtgaattacctgtagacagccaactaccaactgaaaaagaactttcacgtacctataaagtaagcagaatcacttccaaacgtgcattgactgaattagagcaattaggacttatttatcgcgttcgcgggaaaggcagtttcgttaaatccgcttctccggaacagatgcttgcttctcctacaaaaacacgacggattctgtttcttcttccatatgtcgctgatttgtctgttggtgattttagcaagggattgaaccctgtgatgcaagataaacagattgatgtcatgatgacgacgcttgactttctacaaaataaaacagcaaaagagctaatcaatgaatttgacggattgatttattatgctcttgatacagaacaacatcttgacttactttttgagctttcattgaaagaattccctgtcgtcatattagataaaaaaatctatgagttaccttttcctaccgttctttccgataatttccaaggcggtgcgcttgctgcctcttatttgatcgaacagggtcattcaaaaatcgcttatttgtttggtacgcagactcatccacaatccgttcgacagcgttaccttggttaccttgaagcattggacaaagctggtttgactttccacacttcactggatgacaaaagcgcgacattagatgaattgctttcttatatcactaagtatgaagtaactgcttttgtttgtgaaaacgatgttgtcgctatccagaccatgaatctcttgagacagcatggttatcatatccctgaagatttttcaattatcggatttgatgatatccaagcagcagctcttgttgacccgccactgacaaccatcgcacaagattttgaacagttaggtaagcttgcgggagatgctttggtcacttggttagagacaaaagatcgaccatccgatagtaaatttccagtttcattcatcaaaagacaatcaacaaaggagaaataaaatgaatatcggtcaaatagatactagacatgcaacagcgaatcagccaaatttctctaatgggaactgccagccttatactggcgttccttttgggatgaattattttgcaccgcaaactacggatcaaaacggcagctggtggtttcatcctgatgaccgcgtttttcaaggctaccgtcttacccatcaaccaagtccttggatgggtgatttcagtcatatgctgtttacgccgatcaatggaaaactacaggagaacacccttttccatgctcaaagttcttaccgcccagaagaaagtatattttgcccgactcatctgtcgctctgtcaattacgttatggcatctgttctacattgatacctagcatgtatggcggaatcttatctattgattacagcaaaaatgacagcggtttacttttatcctttccgggacgccatcagctctttgttatagatccttacacagtggaaggaaaaatcacacattttgctggttcagaagatcctgatttttctttttattttatattgagatttgaatatcctttaacaattgatgagttagctgtttccaacaaaaatagcgactcgatcccgttgtattttgaacagacaaaaaaacaaactatccgatttgggacatcttttatcagctcggaacaagcagcttataacctggaactagaacaaaaccaaagcaaagagacttaccttgctcacagtcaagaacaatggcagtcctattttgatcgtatacagctcacacaccatgatcaacaacaattgcggacgttttatcataatttatatcgggtgtttttatttccacaaacattttatgaaattgatcctagtgggcaaaaaatccactatgatacgactagtcgatctataaaacctggtgttctctatacaaataatgggttttgggatacgtataaaacggtttatcctctttattctttgattgctgtagaaaaatacgaagaaatgctggaaggttttttgaacagctatagagaaagtggctatttgccaaaatggctgtctcctgatgaacgtggacttatgcctgggacattgatcgatgcggtcattgcagatgctgctgtaaaagatatccgacgagacttgatgcctgaatttctaacggcaatggaaaaaggtgctacggttcaaagcaaacatccaaattatggacgacaaggaacagaagattacttgacatatggctatgttcctaatcactaccacgaatcagtcaatcacacattagactatgcttatagcgatttttgtattagccaagttgccaaggtactagaagaggaggaaatggcgaagaaatatcagcagcaatcattgaactatcaaaatatctttgactatgagtcaggatttatgcgttcaaaagataaagatggcaagttcagagaaccattttcagctaatcgttggggacaagattatgcagaaggaagtgcttggcaaagcagctttgctgtttatcacgatttttcaggactgatcggaaaatatggtggcagtgagagatataaagaaaaactcattgagctgtgcaatcagcccccaacgtttgacccaggaggatatggttttgagatccacgaaatgagtgagatggccgcgatagaatttggacaattagctatttcaaaccagccaagttttcactatccttacttgttcagttatataggacaacctgaaatggcacagccactgcttaaacagttgatgactcagaccttcgacgattctccaatgggttaccctggagatgaggacaatggaagtatggctgcttggtatatcttcaatagtctgggattttatcctgtcacgcctggaaccggtgaatatgttatcggtatgccattaattgacaaggctgttttgcttttgtcaaatggaaaggaattgacgattgaagcaacgcctaatcggccgcagcaacaatttatccataaaatcaaacggatggacaaagaatatacgaaattatattttacccatcaagatttgctgaaaggcggcacgatctcttaccaattagggatcgtccctcaccctaagaaatatcaagcaaaagatttgcctttttccttatcaaactataattaacaagaggatgtgaaaaaactgtcctgcatcaagtaataagaacagccaagcaaaaatagctcctcatatttttcgtttggttggtcttattaccgcagatgcaagcttttgaacaccgtttatcgagaggtcgtgaaaaagctgccctgcatcaagtaataagaacagccaagcaaaaatagctcctcatatttttcgtttggttggtcttattaccgcagatgcaagcttttgaacactgtttattgagaggttgtgaaatcagcgttctgacctgagtattagagagacaaatggcaaaatagttcctcatattttgccattttttgggctaataccgagggtcagctgattgaacaccgtttagtggagaggtcgtgaaaaagctgtttagtttcgagtattaagaaaaattttgtgaaaatggctttccacatttttgcataaatttggcttaataccgagaaactggcttttgaactccgtttatcgagaggtcgtgaaaaagctgccttgcctcaagtaataagaacagccaaaaattagatttctagacaattttttataagttatttcattacattggctttttcttttatgattctccactgttttctcggtactctttaggggatctgccgacgattttcttgaataatttagagaaatacgtggtgttgttgtagccaatctcacttgctatctcattgatgttttgattactgtgcaaaagcagttgtttcgctttttccatacgtaaatggttcaaataagctgaaaaactttttttcgtttcttttttgaacagctgtcctagatacatgacatttaaatgcaggttttctgacacttctttgagtgtaagtggttcttgataatgctggtgcaggattacgattactttttccacattgtcactgtactttttctgtctctgatgctttttgatgaatgacagaagtagctgctgaagttcttgcaccgtttttgcctgatggattttttcgattccttgtaaatattcctcatcttccagatcaatcaattcccgttgaatctccataaacagtaaaaaactggaatatcgtatatcttccggcatcatggctgctaactgaaactgttcaaaaaaatcagtgatcattttttgagcgacttccaattgtttattttgcagcacgcgtctgaaacttgaaaaatcgatggtttgatcttttgtttctgcttgtactgcgtaaaaaacatgctcgtctttatctccataaaattgatgcaactgtagattgtctttcgcttgttggaatgtttcagggattttgtccaaagaatctgtctcttccccgatactgatcagccattcctgatcaggaaagttttcttgaacaaaacaacagaagccatcaacttcatctgtctccaacaacaacgtgattaatacacggtctccgtaatttcgttgatagtaaaagatttgttgccgttcttgcaaccatctattgataagagtatcatgagttcttgccagttgaatcaatactatcctatgctgcttctcacttatttgtcctattatttcttcttcacttatttcatccaattcttcattcaaccattgactgaataacagttcttgatagatttcttgttgatttttttgttcattttgctgatctaaccgtgttttgattttcttgaggctttcaaccaattcgaacttattcacgggtttcatcaaataattcacggcgcctaattgcatacctcctttcaaataatcgaattcttggtatcctgataaaatcataaattcaaaattatgacgttctttttgagccgcttcaataaattccagtccatttatttctggcattgtcacatccgttactactaaatcaatctgtcgctgttcaagtacagctagtccttctttggcattctctgctgttgctactatttgaaagcctaaactttgccaatcaattatcttttttaacccattcaaaatcatgtattcatcatctaccaataacacttgatacacgctcatccctccttgaatgtaatagaaacggtcagtccacctgtctcattattctcaagcgacatataataactgctgccgaagctggcacgtaaacgttcattcacgttttgcagaccgatagatccgtgaagttccactttaggatgagacagtttttcttcaatctgttttagccgtttttcagtcatcccttttccattatctttgatgatgatccttacccgtttgccttcctgcaagactttgacacttagcgcattatcgaatcgagtaaaatcaataccgtgtttaaaataattttcaactaatggctggatcacaaatttaggtacttcgatcttttccaaatcaggatcgatcataaaatgataggctactcgattaggataacgcatttgatacaaatagacatatttttcgcaaaagtccagttcttcttttaaagtgatcgttttctcttgattcgtattgtttcgaagcaaagcggaaaacgcatatacaacatctgctaattcttcacttccttcgctgattgcatacattcggatatattctaatgtattatataaaaaatgtggattgatctgtgcttgaagcgcccgcatatgtgcgtcttgctgtttgatttctaatttgtagatgtcttctacaaactgattgatgctatccaacatttcgttgataccgattgaaagttccttcagttcatattccgtgtttgttatgtcgatccgcgtctctaaattccctgctgctgtttgatccatggcctgcatgacgatagatacttgctgtgaatatcgcttgaatgttttataaagaaagataagcaatatattgtctaaaataatgataccaatgatcagcggggcaagattttttcccgtttcgatttttacactttttttatctagtacagctaatatacgataatcatcagacagttcttggtgttgaacaaaattgtttttttccagatcgtcaatcggcaattgtgaatttttctgcagactctctgtgatgatcatttcttgtctttcaaacgtttctttagctattttattgtcatggaatgtatatagtcgatttgtcgttccagaaatcatgtataaagagagtccattgaatgacgttagattttctaaaatcatatctagttctttcttttgaaaaccaataaaaatacttcctgactcagctcctccttgtgtgataggcaacttgatataaaaagcgtctagtaattttggtgtccccttttttatttccccacctttgttttctctagaagattcataatactccggtagttgattcaacacgatatatatcgcacttagttcttcataatttgcgtagagatctttgatttgatttgggaaagaaactaattcatcggtactgttttgctgttcgtatacatacatcagatactgatctatggggtttgttaagtaggtcgtcacattttcgatcttttcggaattccctacaagctggtttttgatgatcctactcaaggttgttttatcattcagcattctgcttgtgctttgaacggcatcacttgtcatgttttctgcctgtttttgattttgttcccaagtatggatactaaaaataacggtagcagtcatcgttacaccgatcatgataaccgcgtatttccgcaacagacgattgagtaaggttccttttgaaaatagaatccgaaacttattcataactttccaactgtttatctaattcttcacgccagtgtgttgtcatcgtaccattccaaaccgtcaaaagaccaatgacaccaaacaggatcaatcctttgaattgccaagtcacgcctaaaattataccgctaccaataattatttttagaaaagacgaaaagctggaaaaaaccgaaataaaacttagctttagcagattaggaacagagatcgtatattcactatctaaaatcatactgtattgataagtagcaaataggcagagcaaggcaaaaagtaaaataaaatcaatagctaaaaaaatgagccctttgatttgaacagataaatataaattgtaactcaataaagcagtaccagataaaaataaactaaatagcagattgcctcttaaaaaatttcttttatatatattccagcctctttttattgtgatttctttatactcgaatccgtacaaataaaatagttcattgactgttttccatgccgcacctaatccaaagatgatcccgccggcaaatgtatatatccagaaatacaaggttagttttataacgacccagatccggataaataactcttccaaaaccttccctaacatatcttctcctccaaacattaagtttatactttctcattatacaaaaaaaggttgggcaatcagcaccttgacctgattattagagaaacaaacggaaaaatagttcctcatattttgtcgttttgtgagcgaataccgagggtcagctgattgaacaccgtttaccaagaggttgtgaaatagccgcttagtttcgagtagtaagaaaaattttgtgaatatggctttccacatttttacatatatttagcttaataccgagaaactggcttttgaacaccgtttattcggaacaagaggttgtgacacgtcttttgtcacaacccctttgtctttattcattattattcttgtcggaactcatcatattgtttttgcatttctttcaataccttatcatagccagccttgtccaaagcgtctttcaatttcggtaatgtttcatctggatcaacagtccctgtattcaatccatctaaatattgattcatgacattagaaatattacttaattctgttttgacactgtcagtgttgaagctgaatcctaaaatcggtgaagtttctgcatcagcaatcgattgatcacgtttggcaatcatgtcatccgtaatagactcttgtgtatataaaatcttgttgtttcctgtattccaagcagacatatgtgtatttggctgataaccatctagcaatttgattttatcatctgaaccatcgactttttcccatgcttctccttcgatcccccaaacaagcccattcaataattctggatcactgttaagcagccctaaaagctctactgatttttctttattttttgaagtatttgatacgacaaaatttgccatttgtgcttgagctgtagattttagtggaacagtaattgcttttgaaacaagttcttgttttgctgcatttgtcaaaatcgtatcgccataatcatacggtccttgtgtttctccacgcattagccaagtatttccttctagtggataatccttattgctcgttgcagcgtcacttggaatgagtccttgtttgtaccagctatgcattgtacgtaacagtccgatatacgtttcattatcgtattggttgatgattttcgaatcatctccatccagatcaatagcaaacggtaacgtattccctaaaggataatcaaagttcccttggactttgaagccttgtccaatggcaaaagctgccgtgtttggttctttttcatggaattccttcaagactttttctgcatcagcgtaagattggattccatcaattgaaagatcgtatttatctagtaaagctttgttaaaagtaagtacttgttgagcaaagacatttccattgactgggaaagcatataattttccattgaccagatttcctttaatatatgcttcatctaaatcattataagctttttcagcgtacttaggcgctaattcagtcaaatcagcaaaggctcctttttgggcattggaaacatagttgttcgcaaaggcgatatcataattttccccggaagaaatgatgacgttcattttcttttcgtaatcgccccagccaatgtaattaatattgacttttacaccgatctctttttcgattcgtttgtttgctacttccatcaattgatcgaaattatctggtttatctccgatttgatacatctgcaaagtgtccgaattgctagcttctgcctggtctttagaaccagaacctccgcatgctgctaatgttcccaacaacaacgctgaaacacctgtaaaggctagtttcttccataacttcatttttcttcctcctaattttatgatttatatttttgtttctttattcttttactccgccgattgttagacctttgacaaaatgcttctggaaaaatggatagctgatcgcaataggtaacgtcgagatgactacgatcgccattctggcagattctcctggaactgaggctaatccgcctgtcaattggcttcctgctcctgaattttgtgtcagatattgaatattactttggattttcatcaaaagatactgtagtggaactagcttatcatcttggatgtatagtaaagcattgaaccagtcattccagtaacccaatgcggcaaataaactgattgtcgcaatacctggaacagctaacggtaaaacgatctgaacaaatattcgcagttcgctagctccatcgatccgtgccgattcaataatcgaatcagagaccgaacgtttaaagaatgtgcgcatcacaataatattgaagggactgacagccattggcaagatcaatgcccaaatcgtatcttttaactgaagaagatttgtcataacaagataattggccaccatccctggtgagaacaacatcgtaatcaaacaaaaaacggtaaaaaaacgacggaatggaaagtttgaccgtgaaatcgcataagcatataaagaagtagccgtgctattgatcagtgtacctaaaacagtaacaagtacagtgacgaaaagcgcttggaaaattttatcctgcatctggtcgaacaagtacgtataaccaaatatactgaacttttctggccaaaaactgtacccgtgagtcgacaatatggactcatcggtaaaagagatggcgataacaaatataaatggcaaaatacaggaaatagcaaagagtgcaatcattatattagagaaaaaattagccgtcttattgaaagagcggacttggactctctccactttcttttttttcatttttttcctccttagaataatgcagaatcgctatcaaaacgtcgggcgatcgtatttgtgatcatcaacaagacaaagccgacaactgattggtaaagtcctgcagcagccgtcataccaaaatctcctgtggatgtcaggccattgtagatatacgtatccaaaacttgagtcacatcatataatgcaccggaattcctaggaatgttataaaacaggccaaaatcagctcggaaaatgtttcctacggctaaaatcgttaaaatcgtcattagtggaataagttgtggtatcgtcacatgtttgatctgctgccatttgctagctccatcaaccatagcagcttcataataagtcggatcgattcccataacagatgcaaagtaaataatgctgttataaccaatccctttccatgtaccaatgaacaccaagataaacggccaatatttcggttcattataccaattgacagcttctcctccatgtccagtgatccactgattgaatattcctttgtcgggacttaaaaaagcgtaaacaaagtaactgataatgacccaagatagaaaataaggtagtaaggacatcgtttgataaactttaacgagtcgtttatttctcaactcgctcataatgattgcaaatacgactgagatcagcagattcaaaaggataaatgctacattatataaaattgtatttttagtgatgagaaatgcttgatccgaagaaaataaaaatttgaaattttcccaacccacccaaggactttccctcaagctagccaagaacccatctgctgaaatatgaaaatttttgaatgctacgacattcgccattacaggtatgtaaaagaaaaaaatcatccaaagcatacccggtacagccatcaggacaagtgctttataacgccatagattcataaaaaaatgattgaacccctttcgttttttcatctaaaaacccctttcgattcattcgcaacgtaattatagcgctttcaataatgagaataaataaacaaagtatagggaaaatgaaacaaagtataggagaggttgtgaattcagcgttttgtcctgagtattagagaaaaaaacgggaaaatagttcctcatattttgccgttttttgagctaataccgagggtcagctgattgaacaccgtttatcagaggttgtgaattcagcgttttggcctgagtattagggagatcgtgtccttactatctaactctgagtcacaaggaacaatggggactgtaacaaaagtcttgtcacagtcccttattccgaacaaacggtgttccagaagtagcttctacggaaataagccgaaatttcacaaaaaagccatccgaaagtcagacggacaagtctgcttttcagatggcgctacaactactctgcttattcttttagctatccattcaattatttttctctcacttgttctagctcttctttggtcatgggtcgatattgccctttattcaaatctttaggcagccaaaattttcccatacggattctttttaaatataagacttcttttcctactgctttgaccattcgcttaacttggtgaaactttccttcatgcaaaatcagacggataattgaagtttctgtctcttgatctacttgatcaatttggagttttgccggcaatgtctgctcatcgccatcaataatcagtccttctgcaaataaacggatatcttcttctgtcattataccgctaacctcagctagatattctttctccacatgttttttaggtgatagtaactgatgggcaaacaccccgtcattcgttaaaatcaagaggccctctgtgtctttatctaatcggccgactggaaaaagatcttcccgataatcctggtcttccaataaatcgattacggtttgatcatgattatcctgagtagcagaaatgactcctgcaggtttatgcaaaatgtagtaaaaatctttttgatacgtaatgatttctcctaaataagtaaccgcatcttcgaattcatttacttgcgctttatcgcttttcaccacttgtccattgacttcgatcgttccttttttgatcaatcctttgacttctttgcggctgccaagtcccatatctgctaaaaacttatctaaacgcatgcgtttcccccatttcaaaagagcatcaatctagctcttctgattcacttattttatttttaatttatgtcgtaaacgcgctattcctggtcctagtagtctttctgccaagcggattttcaaagctaaataaccatacactaaagcccctatacctgctactacaagaatcaacaatagagactggaatttgctatcttcatttaaaaaagcaccaaaaatcatctttgtgatccacgaagccaaaagcataatcaaggtaagaataaagatcagcaatgtcctgcgccagacaaaacttggtttaaagcgggctacttcatggattctctttaagatcaaggtacaagacacagcaaatccgatcattgtcgccaataaagggccgtatacttcaaataaacgaatggctgggtattgaagaaggagtttcactagaaacccaataaccaaataattaattgccgccttgttttcaaacattccttgcagcatgttggaaactagcatatatagtcctaggaagagacctacaaaacttgcttggatcagtacattacttcctagagaatccggtgtataaaataatgtatttagcggataggcaagtaacataacaccaaatgtcgccggaaacataaaaaatgaaaacaactgtaaatttccgcttgtcaattttgccagacctactcgatctttcaacgtaacagcttctgtaatcaacggtaacccagtagacgcgatcgatgttgccaatgcgataactaccatcgtcaacttatctggattggcactaaaaatcgaaaaaagatccagtaactgtgcattggaatactcggtggattcagacatgatcttcataaaagtgaactgatcgactaatttgaagatcgttacccctgaacccacaataataaacggaatcgcttctttaacggtatctaacaacaattccttcgttgcaatatttactttgttttcgctgtagtgaataaacgccgatgtatacgcttgatgtttcttcaaaaaatacaaaaggacaagaatacttgctagcataccgataaatgccgcgaaagttgattgcgtgaccgccgtcacatagtcaccatccatgactttcatgatgatgaatgtagccaatagcatataaaaaatacgtgccacctgttctacaatctgcgacagcgcataaggcatcatttcttgattgccttgaaaataccctcgtatcacactcatacaaggaaaaaccaatacagcgatactcaaagaacgcatcgttggaatcagttcttctccgccaccagaagcatgagctagccaaggagaggcgatgtacatgaacaaagcaaacaacaggcctaacccgcccatcatctgtaatgcacggataaataatcgtcgtgaagtgccatattcattcaatgaattatagcgtgcagtttgttttgcaatcgcagcaggtattcctgctgtagagatcagtagaaacaatgcatatatattgtatcccatattgaataatccattggcagccttagcattttcgcccatccaagcataccagggaatgatatagacagcgcctagcaatcttgaaatgatattactggcggtcatccaagcagagcctcgtgccattttttcttgcggtgttaattgatctattgctggttttctttgattatccatcggtcagattccaactttctacaaaacattactatcattttaattggtaaaacagaaactggcaatcgattttatataacttttataagaacaattgtttttttgaattcggtttcgtttttttggtaaagtaaagaaatatacagccttttatggctaacatttataggagatatcaatgacacaagaaataaaaaaactacccgttatatttttaggtcttttctttatcacagttggattgaattggttcttgctccctcacgatatagcttccgccggagtgggcgccatcggacatttagttgaaacggccttttctatccaacgctcagttactgtttggagcatcaatcttatgatgctgcttctagccgctgtcctattaggaaaatcagtattttttaagactgtagcgggaagtctgctttttcctgttgttttagagattgttccaaaagtggaaatgatctcctcacatttcttttcactgatttcaggaagtcttttgttcagtcttggggtttacacattgtacacagtcggggcctcaaatggcggtataacgataccaccgattattttccacaaattttttcggcttccaatgccgcaaggacttttacttaccaatagtcttatcgtctttttgaattattatgtttttggattgttggagacactattcgttctcctatctattacagtcagttcattgtttatgaaaatactcatccgcttgtcccctgtgtcaagaaaatttgaataaagctggattttgtcatagcggaaacaaacgatatattaaaaagagtgtgctataataaaccaagaaattgaatgaagcgagggatcaatcaatgagcttctctttagaagacatccgtcatttactattaaaagaaaatctattaaaagaatttgtttcaacaagaggctggcatcttgatgtaccagaaaaagctgaatttcttcagttaagttatgattcaagaaaagctgatgcttctactttgtttttctgtaaaggaatgaatttcaaagaagaatatttggattcagcaatcgaacagggtattcaatattatgtatcagaacagccatacgaaaattcagcagtaggaatcatcgtaacggatatccgtaaagcaatggcgcttcttgctatggctttttacgactatccgcaaaataaattgaaagtgatcggattcactggaacaaaaggtaaaacaactgctgcgtactttacaaaagcaatcttggatcacacaacaaataaaaaaacagcattgctttctactatgaatacaacgttagatggcaaaacatatttcaaatcccatttgacaacgcctgagtcattagatttatatcgtatgatgtcagaagcagttgaaaatggtatgactcatctagtgatggaagtttcttcacaagcttacaaaacacaacgcgtatacggcttgactttagatgtcggaatcttcttgaatatctcgcctgaccatatcagtccgatcgaacatccgacatttgatgactatttctattgcaagcgacaattgatcttgaattcaaaaacagttgttttaaatcatgaaagtgactattttgatttacttagggaaacagccgatctattccagattccaacgatcacttatggtcgttcggaagaaagcaattatcaagtgatccgttcagataaaggtactcacggttttactttatcttctcatgaagatcgcttagctatctgcgatactgcttatgatattttgctggctggaggattcaaccaagaaaatgcagccagtgcgatcattgccgcagcactaacaggtgcctccagtcaagatgcacaagacggattaaaagaagctcgtgtaccaggccgaatggatcaattgatccaatccaatggagcgcatgtctatgtggactacgcacataattatctaagcttgaaaacattgctggaatttgccaaaaatgaacatccagatggccgtgtaattgttgtattaggcagcccaggaaacaaagcaatctcccgtcgacatgattttggaaaagtgctatcagaaacagctgacatcgcctttttgacggcagatgacccagcatttgaagatccgaaaaaaatcgcggaagaaatcaatgaagcaattactaatccaaatttgatcgttcattatgaaatggatcgtcctgaagcgattcgacgcgctttagcagaaagcgctccgcaagattcagtcgttattgcgggaaaaggcgtggatccctatcaaaaaatcaatggtgtagatgaaccttatgaaggggattatgcaatcgtgaagcggttgattgaagaataatggtatttatatactagtggtttcccatttctaagaaaaaaagggactgtgattttttgtcacagttccttttttcttagaaatcattttaacttttcactagctaattctgctgccttttctctttcttcatttaataatttattatcatagaatttgataaatgggaaccagataatgaatgcgatgattgcacaaatgactgctaacacagccgctttccaatcaccaccactaccaacaaatgctccgatcccgactggtgaaggccacggcatctgtgcaagcatcggtttgacgatttccagccgaatggcaaaataagcgagtgtagcagaagccatcggagctaagaaaaacggaaccgctaaatagggattgtagacaattggcatcccgaaaatgattggttcattgatattgaataatcctggtacaagtgaggcttttcctaacactttcagctgatcagatttcgcgaggaatgcaataaagatgatcaatcctaaagtcgcacctgatccaccaacggttacataagaattgttgaattctcctgccaacggataatttgcgccttgtgcgttagctgccatattagctaatacgatcggggtcaagaaagaagtgatgatattcgctccatggatccctacgatccacaatgcatggatcaagaaataaatcaccatgacaccaagccatgtattcgtcaactgcgtaacaaacccaaatgggatagcaatcattttgaagatatccgttcctagtgcaactaataatccattgatgatcatcaccacaaacgcaatgacaaatgttgggatcagagcagtgaaagaacgagaaactcctggcggaacaacatctggcatttttatgacccaatttctcttgacacacatacaatacaattcgaccgcaataatcgacataataatagctgtaaagattcctgaagttcctaaacgttcgacaaaagagcccatcctaataccatttactacagtttctgtctcattgatagaagcaatcaagctgattttaccatcagtcatgatcaattcagggatacacataaagaatgcaaaaacagatagtaatgcccccgtgagcggattaacatttaatttttgttcatctcgttcaattgacgttaattcataagcaaacacaatggcaaagtaaatagataaaatccccatcgtcattgtattgacgatcatgtacaagtcactaactttgaaaaaagttgcattaaaaaatccttctaaaaatgggaacggtaatggcaaaatatttaaaaccaaaaacatcgagcctacaatcgtgaaaggaatagaagccatccccgctgccatgacagcccgaacgattttaagttgcgcaattttccccataggtcccatcaggtatttctgcaaaaaatcaaacattagttattctcctttcctaaatataacgctttttcatattgtttaatacggatatactgttggtcttggttgagtgaaattttctttaaacgatactgtataaatgcactggcaaaaataccgcttacaacaagaatgaaaacaaataactgtcctccattgttatttgccataaaaggatacaagaatgtaaatcctgaggtaaacaacactggaatcaataataaattaaagacactctggaacaaaaaataccactttgtccatggaacgttcgtttggtgttttcgataaagctttacttgttctcctactgcaggcaaaatagctaaaatcagaatcatcggtaaactacttcctaaacttttagctgatagaagcagaatcatccattgcatgttcatgaaaaagaaaaaggcagtcaggtaacgtacgattagataacgattgaaatacatgtttttcaaactaagttgctttttttctaattcgattttcctttttactgtatcctgcacaatgatccttccttcctttctatttatttttttgatacaaataattcatttcctgtgcaacttccaataatgtcatcgtcgtcatcagatgatcttgtgcatggaccatgataatttccatttctatttttgtcccgctggcatattctttcagaagttgagtttgtgactgatgcgcatgaagaatctcttcatttgcttgtcgcaacttctcttctacttcttcaaacatctctttacgcatcgagcgaaatgcttcatgtatcagtgtccgtgcatttccgctatggaaaatgatatcaaaagaagtcacttgtagtgtttcactgtttattttttcagccatctgttttcctccttattcgataagtttgataaatttactgctgaaattctcaaaaataggttcagctaagatttcctgctgtacttttagctggtcaactaacctaacgattgctttagtcacgaccgtaattccttcattttcgatataagaaggcgaaactaaaaaaacaaaatgaatttcttgatattgatcccactgcatcccagaaggaatcaatgcaacggctacctttgtttcgattccaactggaacagcgggatgtgggactgccactgtatcactgaatatgatttgtcccatattttcacgttgctggatctgctttcgcatttctcttatatatccttcttcttcatttatgctcagcttttgcagcaaatcatgaagaatttcttcctttttcggttcgtacgtataagtcttgaaaaatttttcagacaactgttcggtgtaaatctgctttttttgctgtagagaaaatgctggtatcggtctatctgaggaatgatagggtatagattctccaattacctttcgtattttacgaacatcatcttcattcaaaaaaatactgacatgtaaaactggaattttgaaaaacattgtcgaaagatcaatagaagaaataatcaggtcgattccttttaaagttgtttcattgatctcataatagccttttacacttaccactgtaatatttttaccgaattcactgactacgcgattctttaatagttgggcactgccgtaacccgttgcacagataatcaatgcatgtagtttatgcgcagctctttctttttccaatgccgccatgagatgcaaagccaaataggcccattcatcttcattgatggtatagtttttcaaagccagcatgttgctgaaatgcctttttactgcgtcaaagactttgggattttctttctttatctcctcagtcaatgggttctcaatgcgaatacctcggctcaatcgaatcatcatcggtgacaaatgatcaagtagtccattgaaaagctggagatcctctactaatgaaaaatgaaattcctgagacaatcttttcagaactttcgctaattcctttgatagttcctgatcattttgattttctttgtgattcgacttagccatgagatgtaatgtcaaataagcaatttcttcttcgggaaacgatacacctgcgattacctcaatacgttgaacgatccgctgcgccacttgatactctactcgcttagaaacttcttgttcgatgcctaattccttgatttcaaacccttctcggagccgtttgatccccaaagccaagtgtaaagtcagattctgtatgataaaatccgaaacttttaacttagcttctcttgtttcatcgagaatgataatgactagctcttcaaaactgatgtctgggaaaaaacggctttgtcctaaatattctttcaatgaatttccataatggtttccaaaaaaagtatccatgataaaatgccgtcgatttctttcttccccttcgatccatgtcccttgaccatgcttagaaacgatttttagtgaatatggaatcaatcgctccttgatttcttgcatgtcctttgtcaaactggaacgactgatataaagctcttctgccaaatcatccataaaaagaatggcatcttccaaaagcaattggttcaatatatacttttgtcgatcttcggactcataaaatccttgaggttctctagcatatccaggtactatttcttgccgactcaaaaacaagtcaaatgtcagtctttgtaaaatatgcagttggtagccataacctggtttagcaatgatcttacctccgtttttttctactaactctttgatccgctgcaagtaattacggattgtccgatcagataataacaattcagaagctaaacgttgactggtgacatactccttcttgtgatcaatcaaatatctcaacagcaatttttccttctgtttcattatcatccactcctattccatcatatgttctcttcgatcacctctgctaacttctggatgcctgtagggattgggacatacgcttggaaagggatactaacaacaggctttccaacagattctcctaattttttgaatttatccaaaaacatcgtcgtttgcgggctgatcagaaataaatcaaaatcactattcttaatcatattatcgccttctgtagctgaaactgcatctacgagtacctcttctcctttttgcttaaagaaatccgttgtctttgaggccatcatcgaggatgacattcctgccgcacaaataatcaatgcttttttcataaatcaatcactccttttatttttataaaccaagcatatcttgtaagcgttttctattcaaaatatatatttccgtagcattgcggaaaaaatgtgtatcatatcttgaataataatttctggcaccgtgatatactagtgatagaattttttcaggaggggatttagtgagtatcacagtgaatattttgtatacaagtacaaatggacaagccagaaaatttgcagaagaaatggtcgaaagaaacattgtcaaagcgattcgtgcagaagaaggaaacgagaaatatgactattactttccactagaagatccagaatctcttttactgatcgaccgttggaaagatgaagaagcaatcgaaaagcatcacaaatccgaaatgatggctcaaataaacgaactccgtaaaaagtataaattaaaaatgaaagtcgaacgtttcactgatttaccgtaaaaagatacacatggaatgatagcaatttatcatccatgtgtatcttcactttttccttattttttattcgatctcatctaatgattcaaaccgtgtttttctcttatttttcggataagtatttcagtcaccccaatatacatgattcctaaacataccccaaggatattctcaaaaatgcggatcgttactgctcctggaaccccgaataaactggcagtgattgccaaagcaccaaaacaattaaaaactgttttatatctataggtagaacaaatacctaaagctagaccacctaatataccgacccagttaaaaggaataaattggctgataccaataaataaaacacatccaatcaatgagccaatgattcggtctactgctcgttctttgaaaccaatcgacatcaatccatagctagatacaatagaagaaaatgcaaaccctgcccacatcaatcgctgaaaagggacatactctcctgcaacgatcaaaagactaatgccaaatgcatagatgagcatccaaatttttccctgcgaatacatgcctttcaaaaaaatctctttaaacaagcttttgtctttgttcttttctcgatgttttctgtaaaggagaactgaaaaccaacaaaaaaacaaaaataataagctacttgtttgtgtaaagaaattcttgttcaacgaatctttaggtaacgaataaacaataaagagatatgaaaagccgtacaaagaagcattccccattttgggatcactagcggttgccattaatatgctgcttagtaaaataaaatgaatcaacatgcccataactgaccatttgatcagctggacatacggtgctactaatagtgagaacatgacgattgctaaacctatgatcgaatgggaaatcttataaccaaagtcaacaaaacgaatactcatcaacatacagaataaaaccacagcgtatggtttatgcttcgattcaaataatgttgtaattataatgataaaacaaatggcaaacaatacgatgaataatgatcgtaaaaacaatgaacaaatatacatgcacttttcttttttagaagctgcttctcgtattttttgttttaaaataaacggatctagttgtagagactgataaaaatccacctgttgtcgtcctttctttttacttttattttttacagtcatctatgacaggttgtaaatactatggaacatcatatggcgttgccattttcttgtcaactatttttcctattcatgtttttataaaaaaacatatcgttttcttgtatgattaaatcaccacaaaataaacaactgagagaacgatatgctttatgaatggttctatcaaaaaaattctgagatcaatagacaaaaatttgatgattacagaggtctcttacgaaaccttacagaagaaaaaaacattgatcgttgctgcagttctcttccctgctccatgtgtctgtagaaattgtggttctgctgtggtagatggaaataggaaattaatggtggtgaaaaacaagaagaaggaaaccattgtccactttgaataatataatcatatgccaatggttatacgcctaaaaaagcagcgctatacctgtaaaaactgtcgaagccattggaccgctcaaagttattttatccgtccaaggcactcgatttcaaatcatgtcagacataaaatcacttctttactgactgaaaaagtgtcgttattttttatttcgaaaagttgttaggtatctttgacaaccgttattcgcacattgaaagagttgagaagctatttaccaaagtcttccaaaagaattctgtcttgagtgttgagggttgtgaatttcgttctcacgtttccgttgaggataaactgagttttatttccgcggatggcgagacagaaaaattaatcgagaaaatttacctacacaaaaaattcctcgattaacaaactatttccttagctgcactaatcctaaagaaatagaattcttagttacagacatgaacgccacctactttcagctcaccaaacatgttctaccaaatgcgaaattggtgattgatcgattacttggttttccacgcctttcaaggaggcgtaacctttattcacgagttggttgaagcttttcgagacaaaagacccgacttgtttttctccttattgacaaagagccattaaaactagagaaaaaattacaactgaccgctgattatttgtagaaagaaaatcaaagtattatccaataaacttgagtcattaggcaaaaaacactgcgaaactcaagaatgattttcgcagtgtttttgtatattttttattaactagtattactacaaaggtttatttttcacttctcaacgcagcacaaaattgtctttacttatttactggttgggttcaaccttctctactccgatactaatatttgtttgtataccccttctaaaatcggtagtttccattcaattgatgggtactagttgattttaaaaactatgcttattcaattttttattttagctcatatatttcgtttctttctaaattttatactgatgaaaacaagtagcacacccaatattgacaatataaactggctaatgatggtttctccagtttttggaagatgcttatttccactgcttgttggattgtttcctcttatatctgagctatcagcaacttttctattctcttttgttaaaaagatcgccacttcttgttctttttcgatcttgaaagttactggtgtcgcatccaattcataccccgttggcgcttgagtttctaccagctgatacactcctggtgctaaaccgtcaattgtcagttttccatctgctcctgtggttagacctgactgcagaacggttccattggcatcttgtaactcaaaaacagctccttgcaggacttccccgctttggtcatcgatctttgtcaacacgacaccgcctggtgtaagtcgattttctttcgtcaattctaccaccgctgtctgacttctttcgatctcaaactcgatcggtgtcgcatctaattcataccctattggcgcttgagtttctaccagctgatacactcctggtgctaaaccgtcaattgtcagttttccatctgctcctgtggttagacctgactgcagaacggttccattggcatcttgtaactcaaaaacagctccttgcaggacttccccgctttggtcatcgatctttgtcaacacgacaccgcctggtgtaagtcgattttctttcgtcaattctaccaccgctgtctgacttctttcgatctcaaactcgatcggtgtcgcatctaattcataccctattggcgcttgagtttctaccagctgatacactcctggtgctaaaccgtcaattgtcagttttccatctgctcctgtggttagacctgactgcagaacggttccattggcatcttgtaactcaaaaacagctccttgcaggacttccccgctttggtcatcgatctttgtcaacacgacaccgcctggtgtaagtcgattttctttcgtcaattctaccaccgctgtctgacttctttcgatctcaaactcgattggtgtcgcatctaattcataccccgttggcgcttgagtttctaccagctgatatgctcctggtgctaagccttctatcgccagttttccatctgctcctgtagttaaaccggtttgtagtgtttctccttctcggttctgtaactcaaaaacagctccttgcaggacctcaccactgccttcagcatgtttaattagttcaacaccacccgtatcaaggatgttttcaatggttaacgtcacttcttctatggagtattcatttataaaaacatcatgtaccgtcgcatctaaaagatacccttccggtgcttctatttctcggacttgatagctgcctacaggaagcggttcacttaaaaattctccgttttctgccgttataccttcttgtatcacttgtgaatcgcttgataaaatttcaaattttgctcctgccagcctttggccattctcatcagttttaattactttaatacgcccatcgattttccttgttcttacagtactcgtattcaatcgattgtcactattcacaagcgttgcaaagtttaaaatttgatcgccgaccgcatacgcctctacattgaccttaaaagagagggtaaaacttgtcggaccaccaatcgtattattcgcactgaaacgaactattccattattgacttcggcatcaataaaagagggaatatctgatagaaatgacacaaattccatgccttcttccaaaacatcttcaataacaagcgtattgcttgttccagaaaacatcgagacatgcagagtatacgttagttcattttcattgagattgataacatttttgtccacactttttcttaaagagattgccggaagattactttcagggattctcaagcggtagtctcggctcattacctgattattgtaggtcatactcgctcgattccgagaaaacccatcctcttgtcttccttcattgaacaagtcgacatcggtcacttcaagagcatattcaataaaatacgattgaccctctgctagattaccaaagtccacaacaagtgtattcgtttccttattaaaagatactttgtccacaaattcctcggaaacataatgagttctaacgtttgcttcacctggattcgttacttctgcgatccgaaccccacctgaaataggttctctatttccagtggaactccatgtagtcggattcggtgccaaagttgttccttgcggtagtacatcggtaaccactacaccgtcttttcgtgatccttcataatttacctgcaaaataaatttattactgttggtcacgtcttgcccgtcaatcagcagattcccaagatttccttggctgtcgatttctctagagccatagtataatttcgaaaaaatgggtcttgatgaaggaataggcgtaattgaaaattccgtatttgctgctcgctcagcataagtaagactcacttgaaagtcattatttggctcagtaccgcctgattgaaagaaagcaacttcaaacgtgatactgaatgtatacgactgagcggcttcatttaatccttcataatcaaaggtaaatggaaaaacaacgtctgtgccttcttggtaaaatgccagtggctttaaaggtgaatcatcagcgacctccactctaatgaactcaattaagccaatcgatgctctaggaactcgtacgaccatctccccatattcttcaagaatatcgccagcgcctccttgaatgtatccctttaacgtttgtgtatgcctgctcggcaaagtggggcgctcagcagagatgccgatgtcataattcaagagctcctcttgtctttcaatctgagattcctgcgttatagatggctcagatgatctcgcttcattaaaagattcacttaagctttcttctggtatattaaaagattcacttgtgctttcttctggtacattaaaagactcacttgtgctttcttctggtacactgatttctattgagaccgtatttgattgaatatcaccgcttcttgcggtcaattcgtatttacctgaatgctgggaagaataagtaatcagacgttcgtaatcattgagttgcttcacttccccttcaatcaaatcctcactcttatcaatgactaatgcatttagcaggtctggtgttcctctgactcgcaactggaactgctcacccaaagcagcctcctcttgatcaacttcgatcgtcagcgaacgctctggctgttctgctaaagactcagctagaaccgttatgttcccaaattgattgatcacaataagcataactagaaacatacttaacagtttatgaaatttgttcctcactattactcccccttataattttgactaaacaacaaggtacccgataattttctaaaaagattccccaactcaaaatggctgcgttacctccctcgtattttcggttcaactcaagcgttgcaatgtaagctgtaaacaaagctaatgattgccgattgtcttctgttgattgattcgatagctttgtatgacttttagttgtccgtgtggcttaaccataattatgatttcacgattcctcctgccagtgccttgcacaagctggagcgtaaccctaatagttattttgttaatgtacttatatacttttatacttttccattagaaacaatcactaaatcgttgataccaaggtcagactctagaatttcatcagtgagtccctgtattggttaaccttcatcaatcccaaaaaaatatatcaatgcttagcatcaaaatgaatatatagtttagaatacttgggattcatcgataactgatcgcttatttggccatattatttggcacttggttcaactaaacgcatttaggatgttccttcattctcgtcatggatgttctcaaaccgtcattactaataaacagtccaccgaatcgatggttcatttcttgcattttccacgtccaattactctttttgctctttatttgggcgtagttttactttcttaacttgtatcgtcttccatcaactccttaatcatcttcttagctttattggctcggtttccttgtaaaaggtatctacaaatagtgacaatctgtattaaatcttcatcattttctgtaatgtcaataatttctatattctgtaccatatattgcaaagggtttcactaagttcataaccgaagcgaattaaacaacttttgtatagaataactaccttttctatttttccattggtaattctatctattaattggtttaatccttttgttgtagttgattccactaccaagatgattctctcgaattttaaagcttgaagatgtattgctatttttgctaactggcgtatttgcaactatttttcccttctattcttccttcattgattcccctctaaaattactatccataaaaaattgcataaatgacaatagtatttatattagtcatactgctttttaacacagcaaattccagaaaaacattcgttacatatttgtgaatttttccaaaaaataacatttttataaaacgacgaaaaataaatcactaccagtcaacttctataatattaccaaataacaaactaactatccatcaataacgtgttttattttttaaaatttctataaaaaaataatcattcttaaaaagaatatcaaaaaataacaataacctttgtgatttttcttgtttgaagaatgttagaagaaaaatctctaaatacttataattattttataagcaaaaaaaatgctatcggtagtatcaccgatagctgaggaaagtcacagtagggactatttgattaaaaaatatgtttattcaatccatctatttatttttgccttattaacatattgtaataatgtaagcaacaatgtattttaagtgtaatgcttttatgcacctatttaatttatcattctcatctgatacaatctcactcataacaatatgaatttttcttctcattagtctcagttcaccatgaattatacataacacccaatacaattatttttccatacttttttaagaggacaattacatcgtatatatcgctaagaattgcaactgttccatttttaaagacatatttcctctaaaaaactaaaattctatctatccacgactaataatcccccacattaaacccgtaatcgaaccagaaaatttttctttataactaaaacaaccatcatttccgagttatcttaaacacatatttcctattttttcatttctatccatgcatgataatattcagttctgatattgttttcatccgtattcgtcaatagatactggccgatcacttctcctgttttccatcctttttcatacattctttctctgatttctaaaatattattacgttccgcatggttcatctcggatttcaataagaatcgacgataaacagccgtatcttttttctcccaaatcacgtcttgagtaaataaatgtacttcactagggtcgataaaaaatccatacatcgtctgtgaactggaagctggcatactcatcatcccaaagcttgaatagttaggtagaaattttttgatttccacaatatcttcaaactccgttgagatcatacagtcaaaagggatctcttctacaggaaattcttcctcgtttgtatcgatcatcaatttcaactgtttttttcgcgcccttatctctttttgtttttatttcatcaccaccagttctttatggattcttctttctgtttcatcaagtgtctcatataactccgtcaatgtttttccatataaattcttcatctgtttgatcggtatatctaattttctataaaaaacgatatcataaagcataaaaatatcatcgatatcaaacaatcgataatcattctcttcttgtctacttgaacggattaatccttgttcatcccaatagcggatcgttgattttggcaaatcaaatagttccgatacttggccaatcgtatacatttttttcattttttctcacctcttttccagtttattcttttttctattgaccttcaagttacttgaaggtatagaatcgaaaagtatcaggaaaaaaggaggaataatatgtctatcttaaaaacattcttacagaaaaacaaaggactcgctctccttacctttgtgatgatctgtttacaaatcgccggtacattaggtgtaccaaaattagtagcaaagctgatcgacacaggtatagcaagtggcgaagcctcagttataaaaaaaatcggagttgaaatgctgtttgtagcgtttctaggaacgattgctgcggttgcctctagttacttttcagcattggcttccgctaggtttggattccaaacgcgggagaaatatttccgtaaattccaacagctgtcaatgaaggatatcagtcgttttagttctggatctcttttgacaagaatgacgaatgatgtcgataatgtccagcaaatgattgttttattttgccaaatgatcttaccagcaccggttatttgcgttttcaccattctcatgatgtttcgttattctctattactaacatgggttacattgatctctgttgttttttatgtatggattgtttatcgactgatgaaacgaggggcacctttatctttgagtatccagccaaaaatggatcggatcaccatcacattgagagaattctttactgggattaatatgatccgtgcctttgataatcaatcatatgaagaaaagcgaacgaataagagctttgctgactatgctaatcaaatgatcaaagtgaaccgaatatttgcttgggtcactccaattgcttttttgctcatgggaatcgtttatgcttctattttgtggtttggcggaaatcttgtggcagaaggagcattacaaatcggtgtcgtgactgctgtagtcgaatactctatgctgacacttgcttacttgatgatcgcagctatggtattggtcattatccctaaatcgtttgcctcattacgacggatagaagaaatactgcaagcagagatcgaaattgaggaagagacgatcaaaacagtggctgaaccaacctttgatcagacaaatgcagctgcttttgaacatgtcacatttaaatatactgaaacctctgatccagttctagaagatattgatttcacaatacctaaaggaaaaacaacagcgatcgttggcgggaccggatctggaaaaagtagtttggcgaaacttctcttgagacttagtgaccctacgataggaaaagtaacccttggtggtattcctcttactcaaatgactcaagaacagatccgctcccacatcagttatgtccctcagaaggctttcttattcagcgggacaattttaagcaacttgcagatgggaaatgaatatgcctcaacagaagagttgtctaaagcgatcaagatcgctcaattagaagaactagtggacacccttcctgacggattggacagctttgttgctcaaggcggttctaattattcagggggccagaaacagcggatatgtattgctcgagcgttgatcaaaccagcagagatctatgtattcgatgatagtttctccgctttagactataaaacagatgcagcattaagagcagcccttcataaacacatgtcggagaaaactctcgtgattgttgctcaacgcctcagtacaatccaacaagcagataacatcattgttttagatgaaggaaaaatcgttggacaaggtactcatgaagaactactgtctaattgccaaacttatcaggagtttgcaaaatcacaaggaatatagaaagaagggatacgatggaaaagaaaaaaacgttgaacacgcgtgctttgatacgtttttggaaaatgatcaaacctgaacataaatatttttacggattgtttctatgcagtttattcgggaacctattagtcgtagccatgcccttgatcatgggaatcgggatcgatgatctcttatcagaaataagaaaaacaggtattggacagctttctttcagtgatatcaaacaagcattgctgttccctgtcttattgctgatcggctgttcagtcttaagcagcatcacttcatttattcaggaacggacaatggcagcgttaagcgaaaagatcacattgagggtgcgaaaagaaatcacaaaaaaattcaaaacattaccgatgtcgttttttgacaatcatcaagtaggtgacatcattagtcggacaactaccggtctcaatcaactttctcaagtgttattgacaggtatcaatcaatttttcacttctgtcgtaacaatagctgctgctggtctgatgctgttttatatcgaaagcaagcttactttgctcgtcttattgctgatcgttggcagttcaattgttacaactaagattgcgaacaaaaacaaacagatttctgaacagaatcagtatgagctgggtgttttaaataatcgaatggaagaaatcttagctggtaatctagtggtcaaaacattcaatcagcaagctcatgcagaagctgctatacacgaagtaaataaaaagcaatacaacgcttttaaacgtgctcaatttatgaactttgctatctatccggccattcgtttcattaatcaactcgccttcatcataagtgcggtattcggtgctatgcttgttctatcaggtggtgtgacgatcggcttcttacaagcttatcttcagtacatcaatcagatttctgaaccaatttctaccgcttcttatgtgatcaactcgatccaatccgcaatggcagcaatcgataggatatttgagatattagatgaaacagatgaaattccagaccttccagatgcaagacttttagaacaaccgaaaggaaaaatagctttcaaaaatgtacagtttggttacacatcagataaaatattgatgaatcaagtcgatttttcagtaaagccaaaacaaacggtagcgatcgttggtcccactggtgcaggaaaaacgactttagtcaatctgctgatgcgtttttatgaactgaataaaggaaagatcgaattcgacggtcttgatattaccaagctttcacgtggagaactacgtcgttcttttgggatggttttacaaaatacctggctgtttgaaggaacggtagctgataatatcgcctacgggaaaatggatgccacaagagaacaaattatcgaagcggctgaaatcgcacaatgtgatcactttattcgaacactgccagacggatatgatacgatcatttctagcgaaaacggcacgttatctcaaggacagcaacaattattgacaattgctcgagtcattctagcgaatcctcctgtcgttattttagatgaagcaacttctagcgtagatacacgaacagaagcattgattcagcaagcaatggaagctgtgacaaaagataggacaagttttgtgattgcacaccgtttgtcaacgattgaaaatgcagacatgatccttgtaatgaagaatggcgatatcgtcgaaaaaggaacacattctgaactactccaatcaccaacgctttatgccagtctttataatagtcaatttcagatagcgtaacaaacattatctaaaaagctatcgatcatgtatgattagtccatgatcgatagcttttttaaatgtactagtggtgccactagaaacacaaagaataatactaatgatactttttggatagctccttcagtttcgttcggtaagtagtgacaaaagacttgtcacaatccctttttacgaataaacggtgttcaagagacaacctatcggcaataagacacgatcttgtaaaatacgggaagctattcttcaaaatcgcttcttgttgctcttgtcaactccgaatcacgagttacactattcaacaaatatgagaagctgttttttgaatttgtttcttgtgactcggagctgaacgtcaggctcacaatctctcttctttaatctccttgttctacttgcgatagttgctgaacgaattgccatgtttccccgttatcagttgaacggaagaggcaggcaaacattttccctgcatcgattggtccttttttcaacaaataaaattttgtctctaacgtattcgcgcttatttgagtaacttcatttggtgattgaaaaagatctatcccccctgtctgatagttttccggaatcgacagaactgattctttgaatgagcgtcctccgttgtttgtataaaacaaactttcacgtgtcgaaacaaaacctaaagaagttgtaacgaagctgacattttgtactggctgattgatcattgtacttccactttttatccaagtgattccgccatccatagtagtgtaaatgtacaaagtttctgcagacatcccactggctgatgtacagataaatagaccatcgttgccataaaataccgcttttcgataacgtatcggctgaactgattgggtgataatagacgtttgccatgttttaccattatctcttgaagtcagcagacgtacatcatccccagaagaatagataaaccatgagaaatcggcggaaatatcatatgtgttgtccatccaataaccttcaggaatcagccccgttgtcagggtgtattcgccaaaacgcaaccattgcgaatcaatcggcacaaatacccaattagcaccactatctgttgtcatatagagagagtgcgtctctgtatcaagtttgagatcatttatcttttgtgttgtcaaatttaccttttgcttaggatcagctaacaatccttcatttgtcttttgtatatgcgtatcgttagttgagttcattgtcatgtgagaagcagcatttatatgagaagacatttttggctgagtgtatctcccataatagattgttccagctaaaagaatgagaaaaaaaccagtgactaatgtactcatcttagttgtcaggtatccaccaggcgaagactggcttttttcccatctgggttcgttttctagtaaaaaaatatggaatgtgttcattccgaattttgatttgctttcgcctaagtagacaggtaaatcatcaagtgatctcagcaataactggcaatcacttttttgtatccgaaaagcttggctcgtcgaagtcttctcaaaataaagatagtcatcatcttgagaagttggtttattatgtaaaaactgttgtgctctttgactaagccattgatcgaaatgacgcgacaattgatggtaacggagccaaataagtagaagaaaaacaataagcacaacaattgttattccgccaactccccacgaaaagtgatacaaattatttaatttttgcatcccttcagctgaacggactactgcactcatatggcgatataggaacgatacagctccgaaaaaaagcaaaccagagaaaaatactaagcttaaaagcttgaacattattcttttcgctctttttttcgctttctcgataattttttgtttagctgataatacttcgataataaatagttcttgatccatttgtcgctccttttctcatacttcattcattatgcgtcaaaatccatacaatcactagtcccactaataaaaaatttatgaatttggtatgtactctcaatttcaggtagtttatacatcaaaaaatactaagattaatagacaaaaatttgatgattacagagatctcttacaagaccattcagaagaaaaagacattgaacgtgtttgagaacatgaaaatcaaaacctttttgatcaatcaattaatcaatttgaaataacaaaaaatctgagacagaatgaagttcattctggcccagatttgattttgcacaactcatcagtccttattgacaaagagccaattaattagcaacgatattgactaacttgtttggtaccgcaataacttttctgactgttttgccttcaatatattcttgcactatttcattggctaatgctgctttttctagctcatcttttcctaagtctcggggaacattgcttttcgcacgaactttaccgtttacttggaaaacaacttctacttcgtcttcaacaagtgctgcttcatcgtatgttggccatggtgcgtaagaaataccaccatcatttccaaggattgcccatagttcttcacccatgtgaggagcaatcggtgcgagtagttgaacaaatccttcgatatattcataaggcagagcgtccactttataggcttcattgataaagaccatcaattgggagattgctgtattgaaatgaagattttcatagtcttctgtcacttttttcactgtttgatgatacactttatcaagcttgccatcattcaatgtagtgatacggtcacgcattttattgttctcatcaacgatcaaacgccatacacgatccaagaatttacggcttccttctaagccattttcgctccaagcaatcgaagcatctaatggccccatgaacatttcgtacatgcgcagtgtatctgcaccgtaagtttcgaccacatcatcagggttgactacattaccacgagattttgacattttttcgttgttttcgcctaagatcattccttgattgtatagtttttggaatggttcttttgtaggaacaacaccgatatcgtataagaatttatgccagaatcgtgcatatagtaaatgaagtaccgcatgttctgctccaccaatgtagatgtcaactggtagccaacgcttcaacttttcataatctgctaattcttttttgttatgagggtcgatataacgcaggtaataccatgagcttcctgcccattgtggcattgtattcgtttcgcgacggccttttttacctgttacaggatcaacgacattgacccactcctcgatatttgctaatggagattctccagtaccgcttggcttgatgttttttgtcttaggcaaccgtaatggtagctcttcttctgggacagctgtgactgttccgtcctcccaatggatgattgggattggttcaccccagtaacgttgacgggagaatagccagtcacgtaagcgatagctgacttcttttttccctacgccattttcttctagccattcattcattttatcgattgcttcttgtttgttcatgccgtctagaaattcagagttgatgtgcgtaccatcttctgtgtaagcagctttttcaacatctccaccttcgataactggaagaatttctagtccgaaagtttgagcgaattcaaagtcacgttcatcatgtgccggaacagccatgatggctcctgtgccgtatgaagataatacataatcggcgatccagattgggatttccttgccattaactggattgattgcataagcaccagtaaatactcctgttttttcttttgcaagatctgttctctttagatctgattttttagctgtctcttcgatataagcttctacagcagctttttgttcaggggtcgtaatttctctaacaagatctagttcaggtgcaagaaccgagtaagttgcaccgaatagagtatctggtcgtgtcgtaaatacggtataggatttatccgtaccagccactttaaattcaatatttgctcctactgaacgaccgatccaatttctttgcatttctttaatgctttctggccagtcaactaattctagatcatccaataagcgatcagcataagcagtgattttcagcatccattggcgcattggttttctgactacatcatagccaccacgttcacttttcccatcgatcacttcttcatttgaaataactgttcctaattcaggtacccagtttaccgctacttctgcttcataagctagacctttttcataaagcttcgtaaagatccattgtgtccatttataatactccggatcagttgtattcacttcgcgattccagtcataactaaatcctaaagaattgatttggcgtcggaatgtttcgatatttttttgggtaaactcagccggatcgtttcctgtatctagcgcatattgttcagcaggcagaccgaatgcatcccaccccattggatgcagtacgttgtatccttgacttcttttcacacgtgaaaggatatccgttgccgtataaccttcaggatgccctacatgtagcccttgaccggatggatagggaaacatatccagtgcgtaaaattttggcttttcaggatcatcatgggtgttgaaagtattcgtttttgcccagtatttttgccattttttctcaatttctttatgattgtaactcatttgctgtcctcctgttctattgaaaacacttgtttctattataaatataacgaaaaaaccggcagaatctgtttatttttatttccttttgctttgttttctcaaacttcacaaaagaaataaaaaaatcctataaaaagattgctctttttataggacgtaatctacgcggtaccacctaattttaccttagtgaaaaggcctcgaacgttgtaacggccgtcaccgccgcttgcttactcgggtattcagcaaaggcaactcaaaggcgagttcaaaagcatccgtgcacattctcaccagccatgcgctctctgaaacttcagtctttttactacttccttttcaagtgttgtcatatttaagtagccttatagtaacaaatatttttgtggaattcaatcgttatttcttcgaacagctattttatttagctacaatcaacgtttgacctggataaataaagttgttcttaatattgttccattcgattagttgagccattgtaattccatgactgtcagcaacactccaaacagagtctccagatttcacagtataggttttcgaaccagtaactgattgttggtttgttgattgagatgaacctttcttcacaatcacttgctgtcctggatagatgaaattatttttgatattattccattcgattaactgatccatcgtgatatgatgtttgttcgctacgctccaaactgactcgcccgctttcacggtatacatcgtattaccagtggatgatgtacttgtcgtagcagacgtattcggtgtatttggtttcgctgcagaagtagttgaacctgtatttgtatttgccgaagttccacctttaacgatcaattgctgtcctggataaatgaagttgtttttgatattattccattcgattaactgatccatcgtgatgccgtttttatttgccacgctccaaacagattcacctgctttcacggtataagtgccttgagacgaactgctgccagtattaactgaactgctattatttgtattggttgacgaacctgtattacctgacgtgctgtttgttgatccactgtttgaaacagtcagttgttgtcctgggtagataaagttattttggatattgttccattggattagttgagccatcgtaattccgtatttatttgagacgctccaaacagagtctccggctttaactgtatatttcgttcctgaagctgtattagaagaacttgagctggacgaactagagccacttgtattcccagtatttgagccagtatttgctccagcattagaagaaccgccatttgatacgattagctgttgtcctggataaacgaaattgttcttgatattgttccattcaatcaattgagccatcgtaattccgtgatcatttgagatcttccaaacagaatcaccagattgaacagtgtatttcgcaccagttgtttgtcctccgtttgatgtaccagcatttcctgaagaattggtattgttaccggaattattcgtcgaagagccattttcctggctacctttgattgtcagtttttgtcctggataaatgaaattgttttggatgttgttccattggatcaattgatccattgtgataccgaatttatttgagattccccaaacagaatcaccagattggacagtataagtggtcgaagttgctgaacctgagtttgtattaccagaattgcttgaaccgccagtactacctgtacttccagtattattgccacctgtagtcgctccaccgcctgcgtttccgctagctggtgtatcatattgggtcaatccgtaagttgcgatgatattatttaatttgcctgcgtaaccaggatcagtcgcataacgccctgtcaaacaagctgtcgcatctgtataggatttcgtgttgctcttccaagtaccggcatagtaataaccgttgccaaatgaagtatttctaagtacataggcattgtcattgaaagattcagcaaaagaaggatattgtcggaaaggctcctttttatttacccattgattatttaaaaattcaagcgtatccatgtagacggtttgtccttgatagctgccttttatcccaaaaagattataataaggtgcttgagataacgcactactgccccaaccgctttctacaactgcttgtgcgatcatcactgatgcatatagatcgttggcttgagcgattggttgagcataagtagcaatttctgtgataaatgccgctgtattgattcttgcgccgaactgaacaggtgtttcatccgcttgaacaggaaccggctgtactaatggggcagcgacagaacagcctaccatcgcagttcccacgattgctgcccctcgttttgcttttcgaaaacgtttggtctgttctaaacgtctccgttcttttcttgcaatgttttccatcttctatcctccaacttcaatttatctattattaataattataacttctcttaatatttattaaaagttatttaagagctttgttgttttttgtaatcatattgtaatttaccgtaatgaacaacttctgttcattttcaagttcttcctacgtctacgttcttgtttaaaaggatttcgaaaaacactgattttatttccctaacatttcatttgcattaccaaaaaatgtctttccgattacagttattttttttataagaatattggttattcaaagaggaatcatacattggttttatctctttaccgtttttttcgctggaccaaaaatgctataataagtcattgcttcaaaggaggaattgtatgaaatataaaacatcatttcaggtggctggtagcttctttcttgtcctgtttttcattttgggctggatcgtaaagttccatctgtcgtggctttctggtttcgatcagtggtttacaggcattgtcagagcttcttatcctgatctgaacagctaccaactctttatgactaaattcggtaatcctcttaccgtcatcattttatttgcttgtgcggctttatggatgtggtataagaaaaaaagggcagaaacattttggttcgtttctggatttattgtaattgctggaatcatcaacccggtgatcaaactatttttcatgcgagagcgtccttcattggcgcacttagtagttgaaacaagttacagtttccctagtggacatgcagcaggcagtatgattctttacggttctttactatttctgcttccagcttttgttcaaaaaagaaccttacgcacattgcttcaattgctgatggtgtttattatagtaagtgtcgggataagccgcatttatctgggcgttcattttcctactgatatcatcggcggctacttactcagtctttcttggctgtgcctgacttatccagtgtatagagaaaaaagaaaacaaatagataactcttacagaaagaaggacttttaatgacttttccttattcagaaggaaataaaagatatcattcttggaattacgctttacgaaatgagtttggcgggaaaattttcaaggtgcctatcgatggagggttcgactgcccgaatcgagatgggactgttgcccatggcggatgtactttttgcagtgtatctggttcgggtgacatgatcgttgcacctgaagaccctcttccaatccaattccagaaagaaatcgacatgatgcatcaaaaatggcctcatgtccaacaatacatcgtttatttccaaaattttacaaacacccatgcgccagttgaaataatcaaagaacgatttgagcaagtagtcaatttaccaggtgtcgtaggattatcagtcggtacacgaccggattgtctgccagatgaagtagttgattaccttgctgaactgaacgagcggatgtatttatgggtagaacttggattgcaaacaacttttgaagaaacttcaaaactgatcaaccgagcacatgattatcaaacttatttagatggcgtggctaaattacgcaaacataatatccgtgtttgtacgcatttgatcaacggattaccaggcgaaagtttagaaatgatgaaagaaaatgtcagacgcaccattttagattcagatatccaaggaatcaagctccatttgatgcatctgatgcgcaaaacgagaatgttgcgggactatcatgaaggtcgccttcaattaatgagccgtcctgactatgtcaatgtcatttgcgaccagctggaaatgataccaaaagagatcatcatccatcgtttgacaggggatgcgccgtgggattccttgattggaccaatgtggagcttgaaaaaatgggaagtcttgaatgcaattgatgaagaacttcttcgcagagatagcttccaaggaaaatatgatgtacggaaaaaggtgagcgtctgatgttgcaaactgctttgcatttcagccatacattactgcaagaaatcttgcaaccaggggatcacgtcgtagatgcaacgatgggcaatggccacgatacggtttttctagcagaacacatcggaaaaactggtcatgtctatagtttcgatatccagcaacaagcaatcgatgctactcgtgaaaggctagaacagcgtcagttagaagaacgtgtctcattgtttctacaaggccacgaaacgttaggagaagtgatagctgaacaacaaaatctcaaagcagggattttcaatctagggtatctcccaaaaagtgataaagcaatcatcactatgccagagactacacgcacagctatggaagaaatattgaaacgacttgtgcctcgcggacgattgatccttgtcgtctactatggtcatgaaggtggagaaaaagaactggatatggttgattctttttgttccaaactgccacaggaaacatataatgtgctgaattatcggtttatcaaccaaaagaaccagccgcctattttatattgtattgagaaaaaaagataaataaaaaacgcaaaacataaatgatatgttttgcgtttttttctctaatactcaggttaaggcgttgatttcataacctctttattcacggtgctcaaaagcttatatctgcggtaataagtccaaccaaatcaaaaacatgagaagctgtttttgattggctgttcttattacttgatgcaggacagctttttcacaacctctttattcaaatacaaattgattatgataaagttccgcataaaatccattttctgctaataactcgtgatgactgccttcttcaatgacttccccatcacgcaagacaacgattctatctgcattcaagattgttttcagccggtgagcaatcacaaagctggttcttcctttgattgcttcatccattgctttttggatccttgcttctgttaccgtgtctacattacttgttgcttcatccaaaatcaataaagatggatttgtgatgatcgttcgagcaatactgatcaactgcttttgacctgtactgaataagttattttcttcggatatctctgtatcataacctttttctaacgtcatgatgaagtcatgaatattcgcttgttttgctgcattgatgacttcttcatctgaagcgtccggtttgccgaatgtgatattgtctttgatcgttccggagaacaatacagattcttgcaaaacgattcctacatgtctacgtaatgcatcaagatcataatctcggatatctattccatcgatgactactgaaccatcattgacatcgtaaaaacggtttagcagattcatgatcgtcgttttccccgatcctgttggaccaacaagagcaaccatttctcctttgtccacattgatcgagacatctttcaagactagtttttctggagaataaccaaaatctacatgctgcaacgcaagacctttttcaacaccatcaaatgctttaccgttttctggtttaacttcatctttttcatcaaacatttcattcaatcgtcttgcccctgtaatcgctaattggatcatgctgtatccagatgaaatttgcatcagtggttggtaatattgttgtgaatactggacgaatgtcacaactaagcctaatgccaccgaacgttccaaatcaccatttaatgctaaccagccgccgaaaaagataactatcgctgtattgaccagtgacattccttgcatcatcggaaatagtagaccagaataagcttgtcctttgaaggttgcttcgcgaacactttgattatgctctaagaatccttcaatcgtttcttcttgtaagccatttgtgatgatgacacgttgtccgctgattttttcatccatataaccatttagtttccccacttcatcttgctgaagatccacatatttccgtgctttgcggataatcaagacagctatcaaaacggctactggagtggaagcaattgtagcccaagctaactctacattttggcggaacatcatgatcaagatcccgacaagtaaaacagcattcgtgatgacttgaagcaaagcttggttcaaactattttgaatattatctaagtcactggtaaaacgacttaaaatttcaccgtcttgatgagaatcaaagaaacggatcgtcaatttttccaatttgttgaatagaccgatacgcattcggttcgttgacttccctactacttgtgtgaacaaaatactatagataaagttggctgcactagctagtacataaaacagcaagagtttccatattacagaaacaaatttgcttttatcgtctacgccttgcatcaagcctcctacgtaattagctaattcttgaaaagcttccccgatgtattgaggtgcctttacttgtagataggtagcaatgatcactgtgataaagataaagaaaaaggagagtttgtaccgcttcaaatagtgatagaaaaatttacttgcttttattagatcagtcatacttactcctccgttcctttttgagtttcaaagatttcctgatagacacggtttccagctaccaattcctcatgggttccttcgccgactaatctgccttcatccaatactaagatgcggtctgctttgacaacagaagcaattttttgtgcgatgacaatcgtcgttgttcccttcaaatctcgatcgagtgcttctcggaccagcttttcagagcgagcatccaatgcactcgtactgtcatctaggatcaagatctttggattaccgataacgccacgagtaatggataaacgttgcttttgaccaccagaaaagttactgctacgttcttctactggtgcttcgtaacgatcagataacttttcgatgaattcttttgcttgagcaatagaagaagcatgttccatctctttttctgttgcattctttttcccttgacgcaagttttgagcaatcgttcctgagaataaaattgctttttgcaaaacaaaggaaaccgtttgtcttaaactcttttcatttacttgacgaagatctacaccacctacttcaactttgccttctgtcggatcaaatagacgagggatcaattgtgctagtgttgacttcccggcaccagtcgccccgacgataccaaccatttctccaggtttgatagaaaagctgatatctttaagcgtatctgtatcctcaccaggataacgaaaagaaacatggtcaaaagtgacagaacccgtcaactcttgttctggaacgtctaaataagtaagatctggttcagcatctaaaatttccgtgatccgcttcagcgatacggctgctcttgaagtcatcatcatcatcattccgccaataatgattgccatcataatctgcatcaagtagttcatgaatgaagcaattccaccaattaacgtaggatcatctttaacaagatcgctcacaaaaaagatcgccccaaccacagccaaattggcagccagcatgaaggacgggatcatcacagaaaataatgtaccgactatgatgttgtgttttgttaagtcctcacttactttgctgaatgacttcaattggttttcttcttgtacaaaagatttcactacacgaatccctagtaagttttcttttgcaatgctattcacacgatcaatcagtttttgaatgatcatgaagtgcttgcccatccttgtaaatgagagtgccgtaatcagaaataccgtaacgataagcgctacgatgatccaccataattgcggcatcgtgatcatagctaaaatgaaggcaccaataaataagaatggaattcgaaaaagtgattgcaaagaaatcatcactaaattttggatttgcgtgatatcatttgttagacgaacaacaagatttccagcagagaactgttcgatatttccaaatgaaaatgtctggatctttcgaaatgcttcttctcggatatctgcacttacgccttgagctacttttgcagagaaaatcgtgttcgttacacctgcggctaatcctagcaaagccagactgatcaggtaaataccaattgttttcatttcatcattatcttctgtaataatagcctccaatacttgctgtagtaacttaggttgccataatgctgctgcaaccatgactgctacggacagcaaggaaataaaaacagctactttatattttttcgcatgtcgtaagattaatttcattcgttgattacacccctttgtttaaattgacaggactaatttaacactgtaaaattagaccgactaacaatttaccatgtttaaaaagataatgcaatacacgaggttgataaaatggaaataaagctttctcaagcaatcatcattcaggccgcctttgatatcctggctgaaacacaagctctttcgcagctttccatgcgaaacatcgcaaacagaattcatgttcaagcacctgctttatattggtatttcaaaaacaaacaacagctcttgcagaaaatggctgaaacaatggaagatgaattagcgcttccagatccaactttgccttggaatgaacagttgctgcagtatatggaaaattactatgacctttacacacgtttcccttgtggggcagaattagaaatcaatactgtgcccgcttttccgagtcgattagaacatttggagcaaatgatccaattacttgttcgtgaaggattttcagtcacccaaagtcatcaggccattgcctctctccacaatttattgattggacagttaatggatcagcagcatgaacagcagcttcgacaaaagattatggacggaaatgaatttttgaaagaaacagttctatttatgcgtaattatgtagttgaaaatcaattagagggatttaaagaaagtatgcagtcccatgcagaattgaatgaaaaagcactctttctaacgagtgcacaaacctatattgaaggcttatgccaacaaaataaaagaagagaaaacgagcagtaaaaaagctcctatagagatcactatgtttgtgatctctataggagctatctttttaagactctttttttatttttcttccattagccacgccaatgcacgttgaatccattggtcccagaagatccagttatgatcgccaggtccttgttcaaaggtgaccgccaagccttgttcctgcatagcagataccatttcctgatttgcctgataaagaaaatcagattccccacaagccatataaaatcttggaactggttttccgctttttactagttctttcagtaagtattgcggatcattttttgaaccttcgatttgatccaatggtccaaagatcccttcccaaaaagctgctttacgaaccatcaaaagatcatccattcgattccctacagaaacagcgcctgaaagagagattactgctgcgaaattttctgattttgcaaggcctagttttaacgcgccatatccgcccatcgataatccagcggcatatgttttttctctttttcttgttaattgcgggaataattcatgacaaatctcaggtagctcttctgcaatgaatgtccaatacttcatatcataaactgtatctgtgtaccagccaagatcagtagatggcatgatgacagctaatccgtagtctgctacataacgttcaatcgacgtacgtctttcccatacactatgattgccacccattccatgaagtaaatataaaataggtatatccgttgtctcttgctctgaactggtgccaatcaccttttttgttgtttgcggtagtatcacatttagattgacttccatttctaacacattcgaataaatatttgcttgaataaatgccatattttcgccttccttagtaagaagttatttttgaataactttaaatttgaatgattcggctacgtacatatcttaaccgaaactactgttttattttaccacttttttcatgaacgaaaagcgttaagaccaaagcaatgatcacgagtaacaagccaactagataaacggaatgtaacccatcataaagaatttttcttaatggtaacaaaatatccgcatcaatatatttagccgtttgtggattcaccagtttattcatgatatctgcatcatttgttaaatttgctgctgcaagttctcgtttagttaccccatttatcaataaaccaaaaatagaaaccatgactgtttgaccaattgttcgaactaacgtattaaaagaagttgctacaccaagctggtcacgagatacactattttgtgcactgacagtcgaggtagtcatggtcacacctaagcctataccgatgaccgttgatatagcaaaaaaccataaatagttacttctgaaaggcataagatacaaccaagcgcccccaatagctgcgattagtagtccaattctcaagacccaatgagttttcatttgagtcatccacttgcttgcaaggaaagaaccgaccatccagactagtgataatggtgctaataccaacccaccaattgctgcattcagtcctaatacaccttgcatccacataggaatataaacatcgattcccatcaaaaaaccactagccaatgctgcagccaagtttaccacaacaaatagtggatttttgaataaatgcatcatgatgacaggatctttagctcttttttcagcaaaaataaaaatacctaacagtacgatactgcctagcaacaaagcagaaacaagcggactcattccctcgtctcctaataattggaaccctaacagcaatgagaccagcatagccatcaaactaaaactaccaaaaatatccattggtttagactcatgtatgatttttggttcatttaaatatagccaaatcaaaataattaatagaataccgatcggcacattgataaaaaagatccagtgccagctgatcgtttcaacgatgaatcctcccgcaagcggtccaaaaacactggcaatcccccaggctgaactattcaaacctaaaacttttgctcgcttttcaatagaataaagatcgccgatgatcgtcaaagctactggcatcattgccccagcacccatcccttgaatcgcacgagcagcaatcaacccaatcatgctttgagataaaccgcaaaataacgaaccgataataaacaataatgtcccaaaaataaagattggtttccgtcccactttatccgcaagttttccgtaaatcggagtaagcatagcgtttgtcagtaaataaatcgaaaatacccagttcatgatttccattccatgtaatgaaccgacaatcgttggcatagcggttgttacgattgtaccttcaatagccgtcatgaacgttgcaatgaaaatactcactgtgaccaaagtaacatttgtttcttttttcatcttattcctccctttcattatgacaggatctaaaaatagataaataattactatctttttcaagaggttaactgccataaaaaaagctggaacaaccaccacttggcgatcgttccagctgaatataacttattttgctaaacttgctttcaacgcatctactttgtccgtatgttcccaaggcaaatctacatctgtacgaccaaaatgaccgtaagcagctgtttgtttgtaaatcggacgacgcaaatcaagcatctcgatgattcctgctggccgaagatcgaagttttctctcactgcagcaatcagttcttcttccggaaccgttccagtaccgaaagtattgattgagatcgaaacaggttgagcaacaccaatcgcataagctagctgtacttctgctttgcgagcaagccctgctgcaacaatgtttttagcaatataacgtgcagcatagctggcagaacggtcaacttttgtcgcatctttaccagaaaaagcaccgccaccatgacgagcataaccgccatacgtatcaacaatgatttttcttcctgttaatccggaatccccttgaggaccaccaatgacaaatcggccagtcggattgatataatatttcgtttgatcatctaataattcagctggaataacttccttcactactttttcgatgacatcatgacgaattgtttcattatctactgcatcatcatgctgtgttgaaataacgattgtatctacgcgttccggttgtccttgatcatcatattcaaccgttacttgagattttgcatctggacgtaaatacgttaattcatttgatttacgcaaatctgccaagcggcgtaccagacgatgactcaaagcgattggtaaaggcatcaattctggtgtttcatctacagcaaacccaaacattaaaccttggtcaccagcaccaatctcatctaatacgtcttttttatcttcatcccggatctcaagtgcttcatcaactccttgagcaatatcaggagattgttcatcaatcgcaaccaatacagctgctgtatctccatcaaatccgaattttgcacgtgtataaccaatttcttttattgtttcccgtacgactttttgaatatctacatatgccgtcgtagatatttctccaaatactaaaacaagaccagttgttacagacgtttcacacgctactcgtgctgttggatcttgttttaaaattgcatccaagattgcatcactgatttggtcagcaattttatctggatgtccttcagaaacagattctgatgtaaataagtgtctttctaccattataatgattccccctagttaaattcggttacaaggcatctccgtcctgcggatcctttcgggaacttgcaacgaaccaagtatagcagataaaacagttttctgctcgtattttttcatttttttgcttaaaaaatataaaaatattttacattagaactgtccaaaaaagcttagcacaatcatccataaagataactctgctaagctttttaaaatcattctttcagataaaaagaaaaagatactcaaaaagtatctttcatgacccgtacgggattcgaacccgtgttaccgccgtgaaagggcggtgtcttaaccgcttgaccaacgggccaataaaataaatgggcctaaatggactcgaaccatcgacctcacgcttatcaggcgtgcgctctaaccagctgagctataggcccataaaaactaaaagcgggtgacgagaatcgaactcgcgacaacagcttggaaggctgtggttttaccactaaactacacccgcataatggcgcgggacagaatcgaactgccgacacatggagcttcaatccattgctctaccaactgagctaccgagccaaaatcgacatatactcatcaatttgttattatactttatatacttatcaatttaatttggagatattatggaaattcaacgtagaaccactaattttttacatttaggctctttttttgcaactttgacgatcttattttttctatgttattcataccttaagacctcacatgcgccttctagtgcattaggctggttgcttttggatcattctgatatcacagaagccgaagaaaatccgttttttttgattttgtcttctctttgcggcttactgttttctgtttatttcggtgcctatttttttcatcgacatcctggtacgttaaacgaagcttcaagcgtattgattgcatttaaaacgttttcttttttagcaattcttttttattcgtttaatcacaatacgcttttcttctttatcatgaacggtttagtcgtgattttatccatttttacttattttattttttcactcatttttagccaattgaaatgtccactcttctttcgattagttcctgtcacctgttttatttacagcttgttttccttttttgtccttgctttaatgccactgaccaacccttcgacgatccaagtcgcaggaaatctgttggatatgctcttcatcgtcagtctaggtgtatttatgtggcaaagaaaaaacaaacaaaataaaaagcattttgaagcctgactattacgacttcataaatgcttttttagttttaaacacttcaatctaaaagaataacccaagattggataaattattaatgactcgccattcgtttcttagtgattctggatcatcaaatggacttcctaatctaatcagctagttcttcccataaaatgccatacttgactgaatcataatattgattatttaaaaatctaacttttcttatcactacttcctttgtcattccacatttctcaccatttttttgcattccttgtttccagaccatgtagtgaatccaataggtggtagataggcaaaatactcaaataattcttttaaccataaaggaagagaaaggctcctcctgcaagagtcagtataatttttgcttactgctctcttaggttttactcactaaaactgttctatattctttgatataagaaaatgcatgcggtataaatttcttgctcagctcagaaaagatttgtcgtttaagaaaggccgtttcctccattgtcaatgaaggatccaatgttggtaattcaatctcaaaattgtttttttcgacaataggtaattctaatgtgaatgattcttcttcctttatagtattcgtcacaagtagagactgatggaaaatactaggccggcgatttttatatttattcttacgtatcctgtcaacgataacttctatttgatcaaaaaagtacgcttcatttacgtctccaataagttcggctaattctttgaatgccttcgttacaggaagctgattcttctgtacaaaaaagtaattagccaaagtaagcgggaagtgttctatagaggaaagtgtgataaaacggtacttctcatttcctgcagtcgtcctcaacaattctgtctctcggctgtttcttactccataaaaatacgcttctttccgttcatcttcgaaacaatacgcccaaataacttctcccatcgctaatttttgttcatcaacagagagtctcttcaattgttcagctatggtttcagcagccgaagtggcttgttgcaagtaatctttaggatcaaatattggaaagttcaaatgatatcttcgttcttccctcttgattaatcctgcatcgatcaatagatcgagaaaatgggaaaatttattttgcgaaaattcttttttcaattctcttagaatcgtttcttgttctcgatgttcatatagataatcggtcaatgaagaaaaaagcggatcatcggtcagtttttgataaaagttttccttattttttgaataataatagttcatatatgttctcttttctatccgttttattttacttaaaaggcttttacgtaaaaaggaggaagaacaagagtcataattgactgctattctcctccatttcttcggcctttagttatgttttatgtttctttttatatcaatcgcttatccattcattttgaatgcttcatactaccatttgattagctaaatacagccgtcaattgaggtacgacttgttttttacgtgaaacgacacctttaagcaaagcacggttgttggtcaaagttgtttggaaagcttcttctactttttcttttcctttaccagcaacaagtaattctgaatcactgtctaagatgtttgtgacaactaatacgaacagatcgtagccatttgctttcatttcatcttccattgctgcttctagctctgcttgtcgatccatcacttcattaaggtccactgtattgacttgagcgatacgaacgttggaactgcccattgggaaactttttgcatccaaatcaagaagaaccgcagctgatttatcacttagatttgttcctgctttcaacatttcaagtccataagtgtttagatcgacttcagcgattgctgcaagttcttttgcagctgcttcatcttcaggcgtacatgttggtgatttgaacaacaatgtatctgaaatgatagctgagagcatgattcctgcaatttctttaggaattgttacttggttttctttatatagttttaaaataatcgtacttgtacatccaactggttctgcacgatagtacaatggattagctgtttcaaagtttgcaatacgatggtggtctactacagctaaaatatttacttcgctgatatctgaaatactttgttggaattcattatgatccacaagcatgacatctgcattttctgctttagctgactctactactcgtggtgcagatagctgaaagtggtctaatgcgtactgtgtttcttcattaggtgtacctagagcaactgcttctgtttctttacctaattcattttgcaagtgtgaaaacgcaatggctgccccgattgcatctgtatctggattttggtgaccaaaaactaaaatttttgacatgtcattcgctcctttgtgatttctcctatttaataatagcaaaaaaacggaaagaagcaatacttatcttctttccgatgcgacctatcgcgttaaatattttgtatactcttctgtatgaagcaatcgtttagcattttcgacacgttcttttgtaggtggttcgatcccttctaatggatatttcaaaccaagtgtttcccacttgtattttcccatcgtatgataaggaagaatctctactctgtctacatttgacaaggtttgaataaagttgtctagtcggatcaaatattcatcataatcacttcgctcaggaactagtacatggcgaatccaaaccggtttgttgatttttgacaaatattgagccatttctaaaatattttcattgtcccaatgcgttagttttttatgctcttcattatcgatgtgtttgatgtcaaataacagtaaatctgtatacttcatcaattcttgaaaacgtgaaaagaaaggttcttcatacgtaaaaggttttccgcatgtatccaatgtagtatgcatcttccgctcttttgcttttttaaatagttcgatcaaaaaatcgatctgcaatagaggttctccaccactaacagtaataccacctttatctccccagtaaggtctgaagcgttctgctttatctaaaagttcatctgctgtgtattctttccctccgccaatattccaagtatctggattgtgacaaaattggcaacgcatgcggcatccttgcataaacacgacaaagcgcagtccaggtccgtctactgaaccgaaagtttcgatagaatgaacatagccgattgttttttcttccatttaagttcacatcttttctttgatttcattttaagtacaagttagctgtcgaagcgaagctttctgaacaaaatttttcgcaattgccgcttcgttatgtgtaaaatttacagggacggaacatacaagtcctgcccctgtaaatcgttactttcaaataagcatactgattattcgattttgatgcgatggctattcaacgtcctttcgacgctaagtcgaaaaacttttttcacgaactttttacattctgtcgtgtgaagttctcatcaagacatctaattgttgttctcttgtcaagtcacggaatttaactgcataaccagatacccggatcgtcaagttcggatatttcattggattttccattgcatcacgcaataaatcattactgaatacattgacattcaaatgataagctccttttgagaagtaaccatctaagacattacgcaagttttcgattcttgtatcttgttcttttccaagacctgaaggattgattgtttgggtatttgaaattccatccaatgcacagccgtaattcattttagctgttgagttcaggctagctaataacccactttgttccgcattgtaacttggatttgctcctggcgcaagtggttttccagcttcacggccatcaggagtatttcctgtatttttaccgtaaacaacatttgaagtaatcgtcaataatgaagttgttggttttgagttgcggtaagttttatgacgtttgatttgtcccatgaagtattccaagatccatgaaactaattcatctgcacggtcatcatcatttccgtatttagggaagtcgccatccacttcaaaatcaactgctattcctttttcattacggattgcttttacttttgcatatttgatcgctgacaagctgtctgccgcatgagagatcccagcaatacctgtagcaaatgtgcgttgcaagtcagaatccatcaaagccagctgagctgcttcataagaatatttatcatgcatataatgaatgatgttcaacgtattgacatatagttctgctaaccaatccatcatattcatgaagttatgtttcacttcttcaaagtctagtatttctgatgtgattggacgatattctggtccaacttgggcgccagtcacttcatcgactccgccattgatggcatataatagtgttttagccaagttagcacgagcaccaaagaattgcatgtcttttccgacaactgttcctgatacacagcaagcaatcgcacaatcatcagaaccccattgttcacgaagctgattatcattttcgaattgaatcgaagaactttcgatagcgattctgctagcatatgttctgaatccttctggaaggtgttcagaatacaaaacagtcaagtttggttctggtgaaggtcccatatttgttaatgtatgaagcagacggaaatcattctttgtaactaatgaacgaccatctaatcccatacctgcaatggataaagtagcccagatagggaatcctgagaataattggttatattcaggtgtacgcgcgaatttgaccatacgtaatttcattactaagtggtcgatcaattcttgtgcttctttttctgtgattactccattatccaaatcacgttggatatagatatcaaggaatgctgagatacgtccgattgacatcgcagcaccattttgtgatttgattgctgctaaatatccgaagtatagccattggacagcttcttttgcatttgcagctggtttagaaatatcatagccatatttcgcagccatttctttcatttgcgctaatgcacgatattgttcagtgatttcttcacgtaaacgaatcacttcttcactcattgtatgataaccagtcatatcatgatcttttttcttttgttccatcaaatagtcgattccatacaatgccacacgacgatagtcaccgatgatacgtccgcgaccgtaagcgtctggaagccctgtaatgattttgtttttacgagcagcacgcatttcagcagtataagcgtcaaatacaccttgattatgtgttttgcgccagtcagtgaaaatatgtgtcaattcatcgtttggtgtatagccattgctttttagcgcattgttagccatattgattccgccgaacggcatgaatgcttgtttcaaaggtttgtctgtctgtagaccgacgattttttccaaatctttatccaaatagcctgcatcgtgtgaagtaatagttgatacgatttctgtgtccatatcatagacaccgttacgttcgaattggatatcatttaacttttgcaattcatcccatagtttttctgttgcttctgttgggccttccaaaaagctgtcatcaccgcgatattcagtgtagttattttgaataaagtctctagtgtctacgccttctttccatttggtacctttaaatccattccattgctccattgtatggacctcctaaatttctgttttatgtaacagtttttacgtgattagtataacacagcaccctatctttgcaagggttttcttgttttttatttaacaatttttatgttttatttacatatatttaaatcaacgttgacataccaacatttaagcattgtgaacactttcatctttttttgcaaacgtataaggatttattaaaaatgaatgaaaaagagacgccgtctgtattaatacagacggcgtctcttcattaaaatactacaacagttacgactcgatgaaaatctcaggagcatcgttgacttcgatgacttctccaccttttttctcatccatcgcaaatgatccattcgatgttcgatcacctatagggaaatcagttgggtcaatcgttaactgctgccctttttgattcatcaaggttatttcttttgatcttccttccgacatatagataatacggtgcggattttttttcagctcacgcatgaccgtcactccccgcttcgcacgtgaagtttggctgatttcttgagcaagcatgcgtttaacagctcctcgctgagtaacgattacgatcggcgtatcaccttctgctaacacaagcagcccgttgataatcctatctccatctttcaaattcatagacttcactccagctgcctttgctccaacaacgggaacatctgttaaaggatagcgcaaacccattccttgatgcgttactaagaaaacatctaagcctggctgatcttctttcagatacacagcaatcagttcatcttcttccgcctttagcttcatacagctgagcggacggctcttataggtgcgccatggttcgaactctgtcattcgtgtttgcttgatcaatccattcttgctgatgaatacaaatgttttctctgcttggattttttgatatgggaaaacagctaaaatcgattcgtctacagacagattggagattgtttgagaaatgtgctcaccagcatctttccatttcaaatcaggtagttcatggacagggcggtagatcacatttgctttatttgtgatcagaagaacatggtccaatgtactcaattcacctgagtatagcaagtagtcgccttctcgcatcccgatttcttctggtttggaagcactataagaacgaaggcttgttcgcttcacatagccttctcgcgtcacactgacaattacgtcttcttgtgccactaagacttgcgtatcaattttgatttcttcgatttcgtcttcgattgtcgttagacgagcggaagaataattttttttcacttctcgcaattcttttttcataacagagaaaagctctttgtcatttgaaaggattttattcaactctgtgatttgcgcaatcaagctttcggattccttttgaagctctgtgatatccgtgttcgtcaaacggtataattgcaatgtgacaattgcttctgcttgttcttctgtaaattgaaagacgtcgactaaattctttttggcgtcttttttgtctttactttcacgaatcgttgcgattacttcatccagaatcgataaagctttcatcaatccttctacgatatgctgtcttttttgagctttggctaaatcgaattgactacgttttgttatgacttgctttcgatgctcgatataacttcttaaaatgtctttcagtccaacttgatgcggagtcatatggtcgatagcgaccatattgaaattgtaattgatctgtagctcagtgtttttgaacaaataattcaaaattccttgagcattggcgtcttttttcaattcgacgacaatttgcagacctgttctatcactttcatctcgtacttcagctattccatcgattttcttattcaaacggatctcatccatttttttcaccaaggtcgctttatttacttcatatgggatttctgtgatcacgatttgctgtttattacccttcattgcttctatctttgttttcgaacgaagaataacttttcctcgccctgtttcataagcttttttgatttcatcttttccttgcaagatccctcctgttggaaagtcaggtccaggaatatattccatcaatttttcaaggctcgcttgtggatgatcgatcatatagattgtgccatcgatcacttcagctaagttatgagtcgggatttctgttgcatatccagcagatatacctgtcgatccattgacgagaaggtttgggtatcgagctggaaggactgttggttctttttctgtatcatcaaaattccacacgagatcgactgtttctttttcgatatctgctagcatctctccacttaacttggataatctggcttcagtataacgcatcgcagcaggtggatcaccgtccatactcccgttattcccgtgcatttcgatcagtacttcccgcaacttccagtcttggctcatgcggaccatcgcttcataaatactgctgtcaccatgaggatgataattccccatgatatttccgacagattttgctgatttacggaatcctttgtcatacgtattgccatctttgttcatggcaaataatatccggcgttgcactggcttcaatccatcacggatatcaggcagtgcacgttcttggataatatatttggaataacgtccgaagcggtcacccatcacttcttctaaagttaattcttgtacttcttgtcgattttccatcaggtgacctcctattctacttcaaataactgatttttttcatttttatctgctcgttcttcatctaataaatcattagaaactgaaggagagatttcagtatcctcttttttatctaagatactgccatcttcttcgagcgtaaattgtacgtgattttcgatccattttcttcgaggttctactttgtcacccattagtgtggttactcgacgctcagcttgcgcagcatcgtcgatacggacgcggatcaacgtacgggaagttggatccatcgttgtttcccacaattgttccgcattcatttctccaagtcctttataccgctgcagcatatatcctttgccgacttttttaatcattgctgccaattcgtcatctgtccacgcatattcaatgacttgtttcttaccttgtcctttggatactttatataaaggcggtaacgcgatatatactttcccagcttcaatcagcggtttcatatagcgataaaagaaagtaagcagcaatacttgaatatgggcgccgtctgtatccgcatcggtcatgatgattactttgtcgtaattacagtcttcgatagaaaactcaggaccgactcctgcaccaatcgtatagatcatcgtattgatttcttcatttttcaagatatcttgcattttagctttttcggtattgatgacttttcctcgtaaaggtagaattgcttggaactttctgtctcttccttgtttagcagatccgccagcagaatccccttcgactaaatacaattcatttttcttagggtttcgggattgtgcgggtgtcaattttcctgaaagaagagattcgccttttttacgcttcttcccatttcggctttcttctctggctttacgtgctgcttctctcgcttctctggctttgattgctttacggaccaacatctggctcatttcgctattttcctgcaaataaaagcccatttgttcactgatgacgttatctactacggtacgagcaactggcgtaccaagtttttcttttgtttgcccttcaaattgcagaagattttcaggtacacggatagaaagtacagcagctaacccttctctgaaatcactaccttccagattcttgtcccgttctttcagcaaaccaacttttctcgcatattcgttataagatttcgtcatcgccgctttcataccagcttcatgggttcccccatcttttgtccgaacgttattgacaaaagataagacattttctgaatacccgtcattgtattgataagcgacctctacttcgataccttctttttctcctgaaaaataaacaactggtgtcaatgtatctttttcttcattcagataatcaacaaattctttgattccttcttcgtaatgaaaaatttccttgactggttcttctccacgaagatcagaaagagagattttaacgccttttagaagaaaggcagattctcttaaccgttcggctaaaatttcatatgaaaatttcgttgtactgaatattgtatcgtctggtaaaaaatggacagtcgtcccgtttgctttttttgtttttcctatctttttcaacgtaccgtcaggtttaccgccgtttttaaatttctgctgatactctacgccatctctaacgatcgttacagttagccatttcgataaggcatttaccacactggctcctacaccgtgcagtccaccagaagttttgtaccctccttgaccaaactttccgccagcatgcagcacagtaaaaatcacttcaactgttgggattccggaagcatgcatccctacaggcatcccacgtccgctatctgcaacagttatactattgtcttcatggatggtcacatcaatctcactgccataacctgataatgcttcgtcaactgcattatcgacgatttcatagactaaatgatgcaagcctcggctgtcagtggatccaatgtacatccctggtctttttctaactgcctctaatccttccaatacttggatggacgagtcattgtattcgttgtttactttttttgccaaggcaaacgctccttcaataatactttgcggcaaaaccgcaccacgattatcatactagaaaaggtcgtgaaaaaaaagagggtagacgagaaatcaattttaattatctcctaaccgctttttcgacattcccctctatcgatcatctcttctttgtggtcatttttatttttggttttctttcaacttaccaagttcaatcttaatacaacgatccattacgatatctgtacgtcctgcttttcttagcatctcagctacttctttgttttcaatccctaattgtgcccagaacactttagcatcagttttcaaaaaatcatctgctacttcaggtaaaaattcactccgtctaaatacatctacgatatcgattggatcatcgatttctgtcaaattcgcatagactttctcgcctagaatttcttcaccagccaataatggatttactggtatgattttatatccattgtcttgcaatacctgtgcaaccatgtaacttgttcgttctggtttattgctcaagcctacgacggcaatattttttgcttcttccaaatagttgaaaatcgtttcttgtgttggattttttacagacatttctgccaccccttgcttttctttttattccatctattatacttgtatctttcattttttcaattgttcctgttacctattcatgctaaaataaaggatagttttcaacttgaaagagggtaaaaaatgaaattgatcttattacttattttagcatatcttttaggttctattccttccggtgtctggattggcaaattgtttttcaaaaaagatatccgacaacacgggagcggtaatactggaacgaccaatacatttcgtgtattaggcaaaacagccgggattgttgtcctgcttatggatattttaaaaggtacattggctacttgtttgccgatgatcttccacctttctgggattaaccctctttggtttggggtatgcgccattcttggccatacatttccgatttttgctgggttcaaaggaggaaaagctgttgcgacaagtgcaggaatgcttttaggatttaatcctgtattttttgtttattcttgtatcatctttatcgttagtttattttgtacaagtatggtgagtttgagcagtatgatcagtgcagtattgatcactttatctacgatcgtccttccttatgtagctcctgtgattttggctaagcccaattggttactgacgatcattgcctttttagtttcttcctttatcttttatcggcataaagacaatatcaagcgtatcagaaaccatacagaaagtcgaatcccgtttggtttgaatagcagcaagaaaaaatcctgatactttttcattccaaagagataaaacgggagtgtgacaaatcgatgtcacactcccttattacttacaggatagcttttttacacaccttggtaaacggtgttccctgctaacttctcggtcacaacctcttacttcactgtgatggaatattttgtcttgaagatttcatgggcacctagttgattgatccctactttttccatcaagtttccactactgttcaccgtgtcagcgattccgcaccacggttcgatacaaacgaaaggcgcttcttttggataaggagaccagatccctacataaggcatatctttatagcttaaagttacgctatgggaagatttttcacttcgaatggcgtacgcatttagaccccttgtttcaaaaaccaaggcatcttgctcaaaaagttcacgattcaaagccagattcgtatttgtctgacctaacgtcttttgatccatatcgatgaatgggcctttcaatggtaggcgtaatcttgatttcaatggagaaaatgccagatagaaatcttcaaatgacaatccttcttcaagaggtacattgaaagcaggatgtccaccgatagaaaagaacatttctttttcaccggtatttgccacttgataatgaaccgtgatgccgtctcctcctaattcatagctgatcactaattcaaaatcaaatggatacttttctaatgtctccggcgtactccttaagatgaaactagccatttcttgtccatgttcaatgacttcaaaatccatatcccgagcaaatccgtgttgccccatttgatatgttttcccttgataaacatactgatcatcttttaaacgtccaacaaaagggaataaaaccggtgcatgtctgccccaatacgctggatcaccttgccagatatactctaaaccgtgttcttttgatttcagactgatcaattccgcaccgtgttcagcgatttcggcgatcagctggtcattttgaataataacagtcattgccattcctccaacttcgacttactttttaaaatgggaaggctggaacaaacatttctatctgccccagtccccttacttctaataactgtgttttgctaactcgtctttaaaacgggaattcaatacttttaaataagttcccttcatgcctaacgaacgagattcaatgattccagctgattccaattttcgtaaagcattgacgatcacagaacgagtgatgccgatactatcggcaatattagaagcagtcagacgaccttcatctccatccaatgcttcaaagatagcttgtacagccttcaattcgctataagataatgtgttgattgccatttggacagccgttgcactccgtacatctgcttcgatgcttcgagacttctgataaaggatctgcataccgacaaccgtagctccatattctgctaagactagatcgtcatctgcaaacgattgttccatacgagataagataatcgtacccaaacgttcgccagctccaaagatcggaacgacagtcgtcagaccaaatggatatttctctcttgactctaccggaaatgcagtaatatcactagtaattgggatattagcttcagttttcatcaactgtgccactgtatcagtataagattcaggaaattgtttctcaacaaacattgttttgattcgttcattgttcacatcgtgacgttcattataacctagtaatactccgtcacttcctatgatataggtgttgctgtcaagaataccacctagtgtgacagccattttatcgtaaggcaaatctgcttgcatgtcaaaagtattcttttgctgcaaaagtgtgtttatcttgcgggttttcgttagcaagtctgtcattgtcgtcctccgatttttttataaaatatagcgacttaaatcttcatttgccgcaattgagccaagtttgtcatccacatatgcttctgtgatcgttatttctcccatttgcatatctggtgcttcaaataatagatcttctagtagtttttccaaaatggtatgcagtctgcgtgcgccgatattatctgtgtcacggttgacatcgaaagcgatttgagcgatccgttcaattgcttcttttgtaaacgtaactgacacattttctgtaccgatcaacgcgacgtattgttttactaaagcattattcggttcggtcagaatcttcacaaaatcttcagctgtcaaatcatctaattctacccgtatcgggaaacgcccttggagttctggaatcaaatcactcggtttagataaatggaacgctcctgaagcaatgaataagacatgatctgtttggatgatcccgtattttgtatttacttgtgaaccttcgacgattggtaatatgtctctttgaacgccttctctggatacttctccagattgctgtgatttagaagtgatcttatcgatttcatcgataaaaataattccactttcttccgctaatttgattgcctcactatggatatcagcatccttgactaattttgctgattcttccttgatcaataactctaaagcttctttgactgttaccgtccgttccacttttttcttcggtgtcaaagcacctagagtttcatttaggtcgatccccatttgctccaatccattgttcatcattggtgcaggtttcttttggtcttcaacttcaatggttacttcacgactatccagtaaacccttttgtagttgttccaagactgtacggcgattgattcgaatatcttctgtcacttcttcttgcggttcagctgtattttgctgactagcattaaaaagattcatcatttgttcaaattgattagtggattgtttctgttcttttttgataccaggtaccaagatttttaccaaacgtttttctgcattttttttagcacttgtgtatacacggctgtactgctctttttctacgatttggatcgcattttctgctaaatcccgaaccattgattctacatctcttccgacataaccgacttcagtaaattttgttgcttcgactttgacaaatggtgcattgacgatttttgccaaacgtcgtgcgatttctgttttaccgacccctgtaggtccgatcatcagcatattttttggtgtaatatcttgttgcattttttcatctaactgcaaacggcgatagcggttacgcaaagcaacggcaacagatttttttgctgcgtgctgtcctacgatatattcatctaattcacttacgatttgtcttggtgtttgttttaattcatacatatctactcacctcttacagttcttctacgataatattatgattagtaaagatacagatatctgcggcaatatttaacgcattttctgcaatttctttcgcactcatgtcgttttgagcatagtttttcattgctcgggctgcagccaacgcaaaattcccgcctgatccgatagctaagataccatcatctggtgtgataacttctcctgtacctgaaacaagaagcatttctttatcattcattacgatcagcatcgcttcaagtttttgcatagattgctgtgtccgccattcttgagctaattcgacagctgcgcgttgtagattcccgttatattcgtttagtttgccttcaaatttttcttctaaagtaaacgcatctgcaacacttccggcgaaacctacaacaacttctccattgtagatacgtcgtactttctttgcagtgcctttcatgacaacagattcacccattgttacttggccatctccagccatagcaaatttcccgtctttttcgacggcacagatagtggttgaatgaaatggtgattcgaccatgtttgtttcctcctaaatttgttcttttccttatttttacgctcttggatggaaagaacgatagtttttttgtaaactttcttttgttacatgggcatagatctgggtagtcgataaattggcatgtcctagcaattcttggactgtccgcaaatctgccccattatttaataaatgagtagcaaatgtatggcgcagcatgtgaggatggatatcactatccaaactgctttttttgatcatttgattcaagacatattcaattccagtaggcgtgattggttttccatgatgattcacaaaaacgatatcatgctcttcgtgatattttgtcatcaatacctggcggccttccctgaaatattcttgcagagcatcttgagcaaaagaacctagaggagcatatctctctttgttccctttaccatggatcaacatgacctctgaatcaaaatcaatgtctgataccgacaaactgctacactcacttaaacggatgcctgacccgtaaaggacttccagtaaagcgcggttcctcaaatccaaaggactatctcctgctacgctgtcaaaaagtgcttgcatttcattttcataaaaaaaacgtggcagtctcaaatttttctttttgagatgaacgtaagaaaatggattttcttttatcacttcttctttgagaagatactgataaaacgaacgtaggctggctatcttgcgactgatagaatttctgctatagctaggacgatgatcagctaatgcactcaaatagacacgaaccgtaaaatattccgccttcagcagatcagcgtctccagattcctccaaaaaatgtttgaaatggagaatgtcttcttcatatgcttctttcgttttttctgaatatcctctttcgacaatcaaataacgcaaaaatttttgttcccacgtggcttctgtcattttctcaccttccttttgtcccagagaataatttagcacagcgtttataaaaagacaaataaattgtcagaatttaaccaatatttctaagtttgttcacaattggcgcaattcctcacattttgtttgagaaattcttaagaaaaacgcaagaaaaagagcgagactatccgtctcaccctcttcatggagtttccttactcatttgggactgcagttttttctaattctgtttttattgcctcattagcttttaaagctcgttgtgcaattgcttcatatcttgcttttttgtctcgaatgcgctctggcagttcaggaaacagaccatagttggcattcatcggttggaaatgttttccttccgcatgagtaatgtagtaagccatacttccaatagctgtttcttgtggaaactcgactggttccatttcttttgctaagcgtgcggcgttgattccagcaagtagtccgctcgctgcactttcaacatagccttctacaccagtcatctgacctgcaaagaacagatcttcgcgtttcgttgattggtaagtcggtttcagcaattctggcgaattcataaagctgtttcggtgcatcacaccatagcgaacgaattcagcattttccaacccaggaatcatccggaaaacacgtttttgctcgccccatttcaagtgagtctgaaagcccacgatgttgtataaagaagctgcagcattgtcttgacgcagctggataacagcataaggacgtttgccagttttaggatcttccaatccaactggtttcataggtccgaaaagcatcgttttgaatcctcgctgtgccattacttcaattggcatacatccttcaaaatatttttctttctcaaaagatttaagttctgccacttcggcattgattagtgcctcatggaaagctttgaattcctcttctgtcatcggacagttcaagtaagctgcttctcctttgtcatagcgggacttcaaatatactttatccatatcaatcgtagctttgtctacgattggtgcagctgcatcatagaaataaaaaccatctgaaccattgaatgctttgatgctttctgctaatggatgagaagtcaaaggtcctgttgctactacggtgattccttccggtatttcagtgatttcttcgtttatcactgttactaatggatgctctttgacttttcgggtaattgtttcagaaaaagaatcgcggtcaacagctaaggcaccaccagctggcactgctgtttcatctgccgaagtgattactaccgaattcaatcggcgcatttcttctttcaataaccctactgcattagccaaactgtttcctcttaatgaattggaacatactagttcagcaaaattacttgtgtgatgcgcctcagtcgatttgactggacgcatttcatataaacggacagggactcctgcttgtgcgatctgccaagcagcttcacttccggcaagccctgctccaacaacatttaccattttcaatgaaagaacctcttttctattatttttggatgtcttcttcgtaatctccatttacacagactacttgtttaccgcctttgactttcttctcgaccagatatccgtcacattttggacaatttctgcccactggtttatcccaagaagtgaattcacattctgggaaacgggaacaaccatagaatagtctgtttttcttagattttcgttcaatgacttgtccttcatgacatactgggcaagtcacaccgatttcttttacgattggtttcgtattccgacaatcaggaaaattactgcaagcataaaacttcccatatttccctaattttatcaccatcggatgtccacagacatcacaatcgaatcctgctggttcatctttgatttgaattttttcgattttttcttccgcattcgtcagttctttttcaaacggtttatagaaacgatcaaccactttgacccacgcttccgtgccttcttcaattttatccaaatctccttccatttctgctgtgaaatggatatcgacgatttgagggaagaattcacagatcagtgaattgacaatttctcctagttcagtcggctcaaatcttttttgtgtcaattttacatagtagcgtctttggatcgtatcaagtgttggtgcataagtggaaggtcgccctaccccgttttcttctagtgcacgaatcaacgtagcctcactaaaacgtgctggtggttgagtaaaatgttgttttggttcaatatcaacagattggactatatcgccttcttcaagttctggaagaatattttctttctcttctttgccgtcatctctaccttccacatacacttgcatgaatcctttgaatttgatttttgaaccgttcgcaatgaagatgacaccattttgttctaatgtcactttcattgtatctaaaatagctggtgtcatctgactagccacaaaacgtgaccagatcaatgtataaagtttcaattgatctttatctaaatattgtttgagttcatctggtgtacgaagcacactcgttggacgcacagcttcatgggcatcttgtgcgccttgagcatttttgatctttcggtgatcatgtctagaaaattcttttccatacgtatcttcaataaatgctgcggcctctgcttttgctgtatcggcaatccgggtagaatcagtacgcatgtatgtaatcaagccgactgttccttgtttacccaaagtgattccttcatataattgctgtgctaccatcatggtttttcttgttcgaaagtttaacttacgggcagcttcttgttgcaggctacttgtagtgaaaggattcgcagggtttcttttgcgctctttcttttctacttttttaacttcgaagtctgttccatcaattctagcagtgacttcttttacactttgtgcatctggtaatttctttttcttaccgtcgattccccagaaatttgctttgaatttcttgcgagcttttttaaaattaccgtcgatgctccaatattcttctggaacaaattctcggatctctttttcacggtcaataataatttttaaagcgacagattggacacgtcctgcacttaaccctttcttgaccttacgccagagaataggactgatcgaataaccaacgattctgtctaaggtacgacgagcttgctgtgcatctactaaatctacatcgatcgttcttggttccttaaaagctgctttgactgcgtcttttgtgatttcattgaagaccacccgatttttttctttcagatccaacccaagtaggtacgctaaatgccaagcaatcgcttctccttctctatccgggtcacttgccaagtaaactttttgagctttttttgctgcggctttaaggcttttgatgacatcgccttttccgcgtatagaaatataatggggttcataattgttttcaaaatcgatacccattttacttttcggtaaatctcttatatggccaacactggccattactttatagtttcgtccaagatatttctcaattgtcttggcttttgcaggtgattctacaatcactaaatatttatacgccattactgaatggactcctttccattgtcgtgttcctactattaaaagaggattcatacaaatcgtagctaatcatatccattcagaaaacgtttgtcaagaaaagcaaatgaaaagtatggtgttattctttaaattctgccaagatatcttcacccgaaaccgtgcaaactgcaccgtcttggatcaaatgatgacatccggtagaatgttctgttaaaatatttcctggaacagaaaaaactgttcttccaagatccaatgcttgctgtgctgttatcagagagccgctttttttcttggcttcaaagacacatgttcctttagacaaagctgcgataatccgatttctcattggaaaacgatgctttttcgggccggattgaggaggatattcactcaaaagaagatgatcatttgcaatcacctcttgcaagtcacgattttcagcaggatagacttgctctatccctgttccaatgactgcgattgtccgtccaccatgagagattgctgcttggtgaccgtatgtatctatccctttcgcgcagccactgacgatcacatatccagcttctaccactggttttagtaaataataaactgtttttttggctaaagcagaagtgtgtcttccaccaacaacgcttaacatgttacaagaaagtaaagatagatcaccattataaaacagtacaattggcggataggtcaagtgaagtagctgagggggatatttgggatcaaagcaagtgataaacgactgtttcgattggattttgccccagttagcgtgaatttcctgccaacttttgcgaaacagctcccgatgtgtggttattttacctatcttaatgatgtcttcaaatccgatttctttataaggatactgcatcatccagttagcaagtgcccattttccttgactactgattccttttgtataagcaagtttcaataaattttcttctatttgatacatcataaaaccgcctttcgtctctctttctaataagatacgtaaaagcggctgttttttattgtaaatatttttttacaggtgcaaaacttttacgatggattggcgtaattccttgtcgttcaagtccttctaagtgttcctttgttccataacctgcattatgcgagaaaccatatccaggataaagcacgtcatattctttcatcaattggtctcgatatactttagcaatgatacttgcagcagcaatcgacacagatcgtgcatcccctttgattattttttcctgctggataggcaaatccaaggtcatcgcatcgatcaacaaatagcttggtacaatggacaatttttctactgcttggatcatcgctaatttacttgcttcataaatattcacatcatcgattgtctgctgatcaacgatcccgatcccgattgccagggctttttcttgaacttgttgataaagaagttctcgctttttctctgataattgtttggagtcattcagccctaatatgatctcatttttcggcaagataactgcagctgccacgacaggtccagctaatggtcctcttcctacttcatcaatgccggcaatccattggtgaccttgtgcgtacccttgcttttcaaagcaaaacatttcttcatatttttccttaattaatgcttcctttttcaatcgtcgttcaaaagaagccagtgcttgctgcacgcctttgcgtggatcatttcttaatgattctagtgtaggatcatctattctctgtatgcttttcaatcgttctttgatactttggatggattcagtcatcacttttttgctccatttcttcgcaacgatccagtgtgtatcgtccaagttttccttggcgaatatcatgcacgactaattcgctgccgcgatcatagtcttctttatacccacgttttgctgtaatatccatcagtaattccggtgccaatttttcttcttgctcgattgataaaccataacgatcgctgattcttcctgaataatatcgggcaaaaaagtctaatccgtaaaccgctaaatcatctaaatggacaagctggtctttgatcgcgcctgtcagcgctagttttttgccgatttcttcatcttcaaatttgggccataaaatccctggtgtgtctaacaattccaactcattacctaaacgaagccactgctgaccttttgttacgccaggcttatttcctgtctgtgcaattttcttgcctactagtcgattcatcaacgtagatttcccaacatttggaatacctaagaccattgcccgaatagcgcgaggcttgatcccccgagcagcatctcttgcccgtttttctttcaatgcttctttagccgcaggtactagacctttaattcctttactttcttgtgccgtgatagctaatgcaagatggccttgtttacgaaaatattcttgccacagctttgtctgttgtggatctgccagatccgctttattcaataaaacaaggcgaggtttttgctgaatgatctgatctagcattggattacgagaagataaaggtaatcgtgcgtctaccaattcaaatacgatgtccacatatttcattttttcagaaacttctcgtcgggcttttgccatatgtcccggaaaccattggatggtcattgttctctccattcctttcataccggaatattccccggctttacttgttttttttctttttcaatataaattcacttttttattataaagaaattccatctattagttaagtgaaagtgaaccagtcctcattctatcacatcttcacttttttgatgatgtaaatttttattttggtttctatatatgaatctaaatttttgacagcgtttcctaaacaagagatgatagacgaacaaaacagaaaggagacgaaacaaatgaatagtatggtttttgttaattttcctgttgctgatgtcaatcgttccgttgctttttatgaaaagctgggttttaaaaaaaatgaagaattttctactgaagaagctggttcaatggtatgggatgacactttttgggtaatgcttctctctcatgatttttataaaaaatttataaaagataaagaaatagctgataataaaaaaacaagtggtgctttgatttcgtttagtgttgaaaacgcggatgaagtaaaaaaatttgctcaaattgcaaaagaaaatggtggtactttccacgaagtagatatgggaatgcctgaagaagaaatgttttcattagaagtccaagatctagacggaaatacattagaacccgtatggatgaagatgtaagcagataactaatctgacgttttttataacaaaaaaacaaaggcggatgatacgataagtattctccgcctctattttttttattcgtacaatctcttttttacagtttataaaagcagtcttctcaccctttttttaattgttagatgccagtgtatgtaaatcaccaatgtgtcatgacacattggtgattttatggtatccttttattattaactgacaaaggagagaatattttgaacactttgattgcaaaagacgtttttagattgcccgaaatgaatgcaagattgttgtcgacctctgcttttttattagcccttgatgtcatcttatacaagatagcgattggtcctgcttattttcaaatcacattcggatttttaagtatggcgcttatgggttatctatatggaccgatctgggctggtttgcttgaaatgttgtcgaacactttaaatttcacgatatttggttcaggaacgtttcaagctgcttttcttatcacggctttccttggtggatttattaatggcttatttttatatcataaaaagataaacctgccttccgtcatcgctgcccaattattgattatgatcccagtcagcctttttatcaattcttggctgatgtctgttttgtttggtgcagatttcaaagtgatttttctaggtagagtcatcaggaatatgatccaaatccctattcaaataatggttgtttattcatttatcaaaactttagaggctagaaaagtgtttaaacgagctgtttgattttacgtactaaggtagtaaactgattttggattaaacaataaagcgtgcagtctcaacagactgcacgctttattgtttctcactggatccattttatttcatcaagtggataatagacaaatcttgctttacctagaatatcagttttattgatcgtgccaaacgaacgactatcttttgaaactcttcgattatctccaagtacaaaataattatcttccggaagcttggattgtcccgttagctcttgtagtgtaaagtccgtcgtataggatgcatttgcatgatctgatttcaggtttttagttagataaggttccttaactactttcccattgatcttcaattgatcattttggtagctgacattttctcctggaagaccgattactcgtttgatataaatcgtgccatctgctaattgaaaaacaacaatatcaaatcgtctgatctccgaaaatttttccatcacaaccatatcaccttgcttcaacacgttttccattgaattgccttccactggtaccgggatgaataaaaatccccgcaacatgaacgcaaggaatacagaaacaagtaagtatttgaatacaagccagaagcgattaatatagcgttgtttttttgtcaatctctatcaatccatccctcgttttttcattctttctttattataagaaaaatatcaaaaaaatgcgactagatagctgaaataaaaataattctttcaattaggctattggacaaaaaacttttttgatcataaagtacaaaactatctcttatatgtcatgattattttctaaatatttttcccatgcttcgtcaaagatatccatggacggcaaatagtcgacattcagttccagataattagaaatttcttcgtagctagagctgtgcttaggaaattggatgtctttaccggcttctgtagcgaaaacagataaagcatcatgtgtgccaccgcctcgcagtgtcattaaataatgaaaaaagcttcgattcacccttcgttcctccaattttcttcgataaaggcagcccggcgtgcatggtttcttttaaaattttcaggatgctttttataatactcttgatggtcttcttctgctagataaaatggttgggctggttcgatttttgtaacgattggctgttcgaaacgtccactttcagctaactgtttcttgcttttttcagcaatgatccgctgttcttctgtcaaataaaagatcaccgggcgataattgtcaccgcgatcctcgaattgtccgaaagcgtcagttggatcagtttgctgccagtaaagttctactaattgttcatatgaaatcaatgttgcatcatagataatctccactgcttctgtatgtccagtcgtttggctttttacttgttcataagtcggatctggtacatgccctccagtatatcctgacatcactgtatggataccaggaagcgtgtcgaaaggctggatcatacaccagaagcagcctcctgcaaatattgctcgttccattatgattccccctctaatactactcatccgatgattttttattttcttttgtcttgctttcagtactgctggtgctagttttgttggtatttgagttgtttgaagcatcagaggtatcttttggcaaatatagactaaaccgaatgtcatcatttactaagtcgattttatctgctttaatatacatcccgttttgcattcggaattgatccaacctaagcatgatagtcagatcatctgtattgacttcgatccaatctggtaatttatagtttctcttgatcatattcatcacatctttgattggcaaactcaatgttccgatagaaagacttctagcttttagttggacatttccgttttccatcacatacggatcaaaatataaatagaaatcgataggaaaacctagtacttcgaaagtaccattgagtagtgcttcattttccaaataaaatttatattcaatatcactatctttttgatactcactaaggaaaaagctgatgatttgattgactttttctttatttgaattgatcgttaagacaggatctccttgtctttccgtaagagctggtatttctgggagttctggttcccgattagcaaaaatacggctgcctaaaaatacggtcgaaccaagtactaccccaagaaggataaggaaggcgaatttccagtaatttgttttctttgttttgtttgaagatacgtcagatcttgttttcatgtttattgatcatcctccttctctagccattggttttgtgtctcgatcagctgatctctcactgcatttgccatcaattgataacctaaattatttggatggaaatgatcttcttcatagagcacattatttttgatgccatttagattttctgtcgtgctagttgtttgatctgttccttcttctgtgacacctacttcctgattcaatccttgataaagcaaatcattgattgggataaagtagcagttcggcattttttttgtcaccgtttctgttcctttgttccaattgttaacaattgtctgcatgtcagtgatctcaggaaagttcaaataaaatggattgtagatgcctaaaatgtaaataggtgcagttttatttagggatcgaaattcttccaatagttctgtgacattttcctgatagtttttcagtggctttttaaaggaattgaccgttaacccgaataaattattttggataactttcatcaaatcattaccgccaacagtcagtgtgataaaatcagctgttttgatattgtttcgaatttcttcttttgtttttactcgctttaagatctggtcacttcgttcaccatttacaccatagttttctgtttcaaccgcggtcaaattataacggtcttttagatcatttgcgacaaggggaacgaatcctccttgcttggtttgatctcctactccttcagtcagcgaatctccgatagctatgtagtgaagtttttcttttttatttggatcttctctcacagtagttactggtttcattagtgggccagctttcggtatagaagcagctaaacctgcatagatgatgatcgcaattaataatgggaacaaaacgaggatcaaatgtcgtttcgttaatttcattttttcacctcttgtattcgattggttctaatgttatcaaaaattttatcaaaaaggtagtctttatgaaaaaagaaaacaattattttcctaattttataaagaaaaagagaataagctgcaagcctttcaggctgagggcttatcctcttttcgactaatctacataatacatgattgcaaacgcgtctttaccagtatgcgtagcgataaccggattcgtatgcagtacagggatatgcatgtccgggaataattcttgcaaaccctctttgaattcttgcgccaattcttttgcatccgcatgtgaaataccgatttgtcgcacatttggcaattctttcagttcatttttcaaattattaaaccatttatcgaacgttttctttcctcgccccttagttacagggattaattcagaatgggcgaaattcatcaccacgcgtatgttcaaaacactagacagcaaaccagttgttcggctgattcttccaccttttaccaagttatctagtgtggatattccgatgtataattttgtattgtcttgtacttttttgacttcttcaaggatttcctctactgttttaccttcttttgctaattcagctgctcgaattacctgaaaagataatccttggtcagtggtatcactgtcgataaccgttactttcgtttttgttagattactggcttgtcttgctgcttctactgttccactcaagccttttgtcatatggatcgaaatcacttcactgccgtcttctcctagctcatcatacatcgagatgaattctccaatcggtggttggcttgttttgggcagattttttgctttcgccatcatttccataaatctttcgccgtctagttggtcatcatcgggatatactgttccgtcgatcatgatggatagcggcatgacacgaatgcctaaagcatcgcgtacatttttttccatcgtacatgaagaatctgttacgatttttacatttgtcattattttctctctctttctttaacaagatgccttattcatgttaaactacatgtaagacaatttctatttttagtataacagacaaataatgatttttcattaattacacctagtaaaggagccgttttcatggaaaaaacgaaatttaatcgaacgtatgaaatattaaatgaagtgttcaatgcagtcacccatggaattgggactggattgagtatcgcgggactagtggttcttttagtaaaaggtgcccacttgcattcctccctccatattgtctcttatgctatctatggatcgatgatgattcttttatttttaacgtctactttgtttcattcattgatttttacaaaagcaaaaaaggtgttccaagtattcgatcatagttcgatttttcttttgattgcaggaagttatactcctttttgtttgctgagtatccgaggatggctaggttggactttatttgtattaatctggttgtttgcgattcttggcattatatataaagcgttgacgttgcataaacgggagagagtatcaaaagtatctacgatcatctatatttttatggggtggctctgtgtcgtggctgctgttcctctttatcactctcttggaatgactggtgttattttgatggtagcaggcgggctttcttacacgataggcgcattcttttatagcttgaattctatccgctatatgcatgttgtttggcatttgtttgttatgttaggtgcaggttttatgtacttctctgttttattctttacttaataaaaaaaataaagctatggatgggacagctctaaataacagctagtctatccatagcttttttatatcgtcaattcgcctgtcccgctttttacaggattctcattacgctgatacgtttcaaattgatgcggataacgatttttttcatctatttctccttgactagtattgatcagtgaccaatcagaccagtcaacaggtggaaaataagcatctccatcgaatacatgatggatgactgtacggtataatatcgtacaaaatggcagaaattcttgataaacagctgaccctccagcgatgaaaaagataccatctgtttctttttccagagcaagcacgtcttccacactatgcatgacatgcacgccttctgctttataggaagaatctctcgtcaaaacaatcgtctgacgattcggcaacggacggctacccatcccttcgaatgtttttcgtcccatcactagtgtatttgcttctgtcatttgtttgaagaatttcagatcatttggcaaacgccaaggaagacggtcttcttttccaatcaatccgttttcatcctgtgcccaaattgcagctaacattttctcatcctttctgattctaaacagcgataggagctttgatcgccggatgtgggtcatatccttctaattggatatcttccatctcaaaatcaaatactgactgcttttcctgattcaaaactaaagtcggaaatgcgcgtatttctcggctcaattgttctttcatttgttcgatatgattgatataaagatgagcatctcctaatgtgtgaacaaattcgccaaccgctaaacctgtttcatgtgcaattaggtgagtcagcaacgcataacttgcaatgttgaacggaacgcctagaaacacatccccactgcgttgatacaattggcagcttagccgtccctcttgaacataaaattgaaacatcgtatgacaaggaggcaaagccatgctaggaacatcttccggattccatgcagaaacgatcaatcttctagaatcaggcgtctttttgattgcttcgatcacttctttgatttgatcgataaagccaccgtcttttgtttcccagtgacgccattgatagccgtagatgtgtccaagatcgccgtatgtttcagcaaaggaatcatcggttaggatcttctcgcaaaaaagcttgctctgctttttatattcttcattgaattcaggatctgtcaaacatctatggccaaaatcagtcatatctggtccattatagtctggacttttgatgtagcgttcaaatgcccattcatcccaaatatggtttttattttgtaatagatagcggatattcgtatctccttttaaaaaccaaagcaattcgcttttgatcaatccaaaaggtactcgtttcgttgttaacaaaggaaaccctttttgcagatcaaaccgcatttggtatccgaataagcttaatgtgcctgtgcctgttctgtcttctttacgatgcccttcttccaacaattttcttcctaagtcaagatacgcttgttccatcctttttcctcctaatcttctacccattcactcaagtattcccaccgtgccattttttcttcaagttgtgcttctgtttcagatacgtcgttttgcaattcttgtaatcgagtgaaattatctccttgatgattcatctcttcttggagcaatgagattttttcttcaagttctgcaatctcatcttcaatcgtttcccattctttttgttccatgtaagataatttcttcttttcagcaggttccttgctctgtatttttggtttcgctttttcagcaggctgctgggtctctttttgcttcagtaaataactggacatgtttccgtaataaagttcttgttttccgtttccttggaatactaataacttatctgctaccttgtccaagaaataacggtcatgggaaacagtgatcacagcacctggaaaacttctaaaataatcttccaaaatcgtcaatgttgctatgtccaaatcattggtcggttcatccaataataaaacattaggttgctggatcagcagtttcaacaaaaataaccggcgtttttctccgcctgaaagtttgcctatcagtgtcccatgcataaatcttggaaataaaaatcgttcaagtaattctgctactccgatttgactgccatctgctgtttttgcttcttcagcagcttcttgtaagtaagcaatcatccgtttatctggtgccatttcttcattttcttgtgtataatacgcaagatgaaccgtttcaccgatagacattgtaccgctatccaggggaattctgccagctagaatattaagcaatgtcgattttcccgcaccatttttaccagtaatacctagtctttcccgagattgaatcagtaaatctaaatgttctagcagtgtttggtcatttatacggtaactgccatctttgatttccagtacttttttccctaaacgttgtgtcgctaggttcagctctaaatcatcttcttggtttacttggtacaagttctcctttagatcttcgaaacggttgatccgtgcttgctgcttggtgccacgtgcctgtacgccagccctcatccaagctaattcctgtttataaagccgcttgcgcttttcttcttgttctacttctacacgatcacgttctgctttttctaagacgtaagcttcataatttcctttatactcgtataattttccaaatgaaagttcgaagattcggtttgctactctatctagaaaataacgatcgtgggtaaccatcaatagtgcgccacggtattgtttcaaatagttttccaaccactcgatcgcttcataatctaaatggtttgttggttcgtctagtaatagtaaatcgggttcatcaatcaacacttgcgccagactaactcgttttttctgaccacctgataaagtactgatttttttatctaattcactgattcctaatttttgcaaaataatctttgcgttggtatctgtagtccaagcatcttctttattcatttgttcttctgctttagcataacgtttttgcacatcagggtcttctccgttttcccctagttcgatcaatgcttcctcatatgctcgaacagtttggatcaaggggctgtttccttgaaagactgcttggagaacagttaattcatcggaaaattcagctgcttgagaaagataaccaatacggtaatcagttggataaaacactgtttgccgatcaccgtcgccgctatcgataccggcaataatatttaagagacttgttttacccgtcccgttcgtcccaatcaacccgatacggtctttttcgtggaccaaaaaagaaatctggtcaaacaaatctttttcaccataagtttttttgaggtcagttacttttaattctttcaacatgttccctccttatcttggatattgtatcataaaaatagtgaacttcaggaaaatttttttggtatttgttctttttgtgttctcaaaaaaagaacaggaccgattcgatcctgttctgatatgttttgttttttataaaacttgaaaatttttacctttttattttattggactcgtttttttgactttgctcgaaacgcaaatcggaaagaaaagttatcagatggtttgttcatcgtataagattctaacaaattgatattcctgcgatagctgttcgcagaaaacgtcgtgattttctcagcaacttcgtattcatcaatgatttttctttcaagataataacctcttagcatttttttcgtaaacagactatcttgctggatcatccacgaagaaatcaaattccccgagttcatttttattccttcaagtttgcgttgctggataaaaaattgaaccatcgtttcgtcataaatatcagtcaagttatctaaactttcaataatcaactgagtatttttttgatatgtctctctgatttcttggatatcttcatcactaataaatgtctgacgatcagcatatcttctttgccaaaacattttcggatggagaacgattcgcattaacctacggacaacaatgaaccaaaagccgataaaagacaaaatttggcttgtgatagaatgttcgaatcgagaaagaaaacgggagtaaaaacgataaccattagaagaaagcttgcccgaacgataactttcatccaatccatcccgttcgatcgacaaaatcagtgcttgtatttcttgtacttcttgcttttcatcatcggttaaatcttccaagtacagatcacgtatccgttcttgataattttctatcactgcttcagtggctaaaaattcttttgtattacgatcaatttcctttatttcttttcgcaaaacttcaacgacctcttctaaaatcatcaaagcattcaaatccgtgcttttcgcttcctctgtttccgtcagcataggcaagacaatgatccctataaccaaagtcactaagatgacacccgccgtcagaaacaaaagcaaagaccgctggtaaaacatcatattattgattgaaaatggcaaaataaaaatcgtagccaaactgactgttccctttacaccgccaaatgttaagatcaagatctcgttcaactgttttttgaactttttactgccatctttgaatacataaaaaagactgatagaaatgaatctgatcacaaaaagcatgacagagattaatacgataatcgctaataaaagaccgtttggatataaaccgtctccccatactggcgagaacacttgcgtcaattcgattcctaaaaatataaatactaatgcattcagtgtaaaagcaatagttgtccatgtactgtgagacaagctcgacaattctgcatcaaacacagagattttcctaaaaccagaagcttggagaatacctgctgccactgcagcaatgattccagatacatcaaatgcctctgccaatacataggctagaaaaggaagcaaaagttcgatcagcagataccctgtgacatcttgtgctgatgctttttcgatcaaatgaattattttttgtttgaaccagacaagcaaaaagccgatcaaagctcccccaatactagaaactactagactcatccccgcgtttactgctgaaaaagatccggtgatcagcgcaccaagagcaaactggaaggcagtaacaccagatgcatcattcaaaagaccttctccttccaaaatatgcatcgcctttttagggatattcactcgtccagaaagagaactgactgctaccgcatctgtcggacctaacgctgctccaaaagcaaagcaggcagcaagtgggacacttggcaacaggaatgataacgtcgcacctaccccgacaagggtcaaaatgactcctccaaatgccaagaacaaaattgtcccgaaatttttgagaatcgaagaaatatctgctttttctccttctctaaataacaatggtgcaataatcataactaagaacaattcaggttcaaaatcgattgattgtccccactctgtcagacctaataccactccaaggaaaatttggatcagtggagctggaatcattggcaaaatgcggctagctatgttcgataaggtgatcgttactgcaaatacaataactaactcagcaaattccatcgtccatcccctttattttttattttgtgtaagcatttttaaaaattgttcttttttctttaaaattttggtttcgactacttcaacctgtgtttggttcccctctaattcacactgtacacgttttgactccaaacgaagcagatcatgtttcagacgttccaactgacgatacatcaatatatttcttttacgcaacttacaaagtatttgacggcggtcatccatcgaaagggcgccatagcgatcatgcaacagttttttttgttgttcaaaactctctctcattttccagatctcctatacacaaacttccatcattatagcaaagttctttttggatgaaaaatatttcattgtttcatcgtttattgctagttagaaatttccataaatttttcaacgcctcattctattccaaatagtatcagatatcaagtaaaacttaagaaagataaaagtttctgacaaaaggatgtttactttcccattcctgcctttcttgttcttttatcacaacaaaaaaatggggctgcgacaaaaatcttgtcacagtcccttattctgaataaacggtgtgaaagagacagcctatcagtagtaataagacacatctctttcacagcctcatttttgcgtaaaaatcgatttattcgaaaaattccccgtatacatcttctacacgttgatctggattgatcacgatatacaagttacctgttttttcgctgatttttgttgattgatattgattgtctaatccttctgttcctttatctagatatgggaagtacacaagatcaggtgtgccatttcggtaaaggatttccattcgctcgatatcttcgtatttcaatgcgcgattaaacatgcccatttccagtccgcctaggttgatatcatgtgtcgcaactgcgtccccttcatggaagatttcgattttaaatccagcacacggatggatttcaacaaattcactgccattgattcgtccaaaacttgttgtgatttgtttgatccaaagatcgccgatatgacggcggttgatcgtccaggtttctccatttctaaaataaaattttagcgctgtcatttctttactcattaaaaagactcctttatgatgtaatttattcttgtactacctcagtttagcacaaatttatgtaagtggtcacatcttatgttttttcttctaatgacgtatctgcccactttaagtagccaacaaagctgagcagatacagtctagtgttttttaaatcaatttttctttcgataaaaaatccaaaacctgttttttatcattttttattctttgttctacgacggctttttcagctaattgcaaagcttcactaacccacttaccaggtttttttccagtttcttctagcaagattttaccatctactgctaattcgcttaatgacttgataggtaaacgatcataggattctcctacggcatccatctgaggtgtttcgtcaaaatagatcatcaattcttctacttgcagtgcatgttttttgcctaagaagtacaattcgaatggttccaaagctccagtttctcgttgtcgtagtccttggacaagtgcttgaacgtctttaatcatttggttagaacacttccacgatttcaaaaaggaacgaatctcattttcttttagacccagttggctgatcaataatgtccatacttggctctcttctttcaatgggacggatggtaattcagcaaaacgtaaaagtgcttcgccttcttctttcaaaccgggacagcaaatgtagcactctgtttcaataaatgcatggattcccgcggcccgttcatttcccaagagcatcttgatgaattccacatttatacgttctacagatattttacctaatagctcgtggttttctttgatggcgtagaaggtttcttcctctaatttgaaccctagttgactgacaaaacgcaacccgcgcatcattcgtaaggcatcttcatggaaccgctcatgaggattgcctacagctcgcaagatctgttcttctagatcttgcagaccatcgaacaaatcgatgatttctccatcttctttcaaagcaaacgcattgatcgtaaaatctcttcttttcaaatcttctgccaacgaacgaacgaattcgacatgatctggtctgcggtagtcctgataagttgattccgtccgaaatgtggtgatctcatattgttcatcattttctaataccaacacagttccatgttcgatcccaatatctatcgtttttggaaaaagctgtttgatttcttctggaaatgcgcttgttgcgatatccacatcatggattggctggttcagcaagatatcacgaacacttccacctacaaaataagcttcatatcctgcattctctaattttttcagaactggaattgccttttggtattccagaggtaattgttttaatttcatttttccaacctttcctgcgtgtttcttgtactgagataaagactcagttgcatggtgactgtttgacaagtccgtttcagagtcttcaaggccaggaccacttcatcttgtttactcgtccttacgctcaaagcgattatggtctctttgattgaatttttccatgtttttttcaaaaacttcagttaagtcgatattcaatgaattagccatgatcatcgtaacgaataaaacatcaccaagttcttctgctaccgagttaactggttcagaagcctttttgcttttttctccataagtgtggttgacttctcttgccaattcacctacttcttcagttaatcgagccatctgagctaatggagagaaataccccaccttgaattgctggatatattcatccacttcctgctgcatactgtataaagaacgctttttatccatctttttccctccaaaactatcttaccaaaactttaacgcaaatcctagataagagcaattgagaaaatcgaatttccatgctacatttaggaaggaatttctaaatggaaattctgtgaaaatacataattgaaagctggaattcatatggtcaaacgaaaaacagtaaaagaagttctttttatcattataggaacaagtatttatgcatttggtcttgtttacttgaacatcgctaatcatttagcagaagggggagtctcagggatcaccttgatcttaagagctttatttggtattgatccagcttatacgactttattaatcaacatcccattgattttactaggaggaaagatcctcggtaaacgttccttggcctatacagttctaggtacactttctttgtcattctttttatggatctggcaaagggttccactagaaatcaatttacagcatgatctactgatcgtttctctacttgcgggtttagttgcaggtgtaggaagcgggatcgtctaccgcatgggtggaacaacaggtggcagcgatattattgctcggattttagaacaaaattacggcatcactatggggcgttccctattggtatttgatatcatcgtcttacttgcttcattaacctatatcgacttgaaacgtatgatgtatacgttgattgtttcgtatgttttcagtcgtgtgattgattcgatcttagatggcggatattctgcaaaaggtctacttgtcgtctccaacaaaagcgaagagattgcaccactactgatgaccggtctgcaaagaggtgtgactttcctttctggagaaggcgcattctctggtaattcaaaaaaaatcatctatatggtcgttagctctagtgaattaactgaagctaagaggatcgtccacgagattgacgaaaaagctttcctttcaatcatcaatgtgcatgaagtggaagggcaaggctttacttatttgaagccacagacaagattactgaaaaaactataagaaaaaagacaaagataggctatgaggaaagattccacatccagctgacctttgtcttttttagtactatactatttttaactaattgttatgttcacttacccggttacttttcttttgtgtctgcaaaaggatctttcggttaacttcatcagataatttcaaaaaagcatccctatctccatcttctagtgcttgatcgatttgagcataaagcatttttagttttgcttcttcttctttttcttgaaaatatcgttcaattaattcagtatcttcttcactgactgaagaatcccaagaagaaaatggattgtcttctaagatagatagatattctcttgtctgccaagcattttcgaatatacattccacatataaaggctttttccaattcaaacggatttcatgaaaaatctggtctgtgtccgtaaattcttttccctgcaaaaacaatttcatgggttccccttcaacagatagatcactgatctgcagtcctcgatccgcaaaattcgccccttcaacaaagtggacattgcttaaaatcgcttcatgattggcaagataattcaagatccaaaaaacttctcttcggctaaaagatacatgattgaccatccacgttaaaaaattcttcttttcccgtacatcaattagcatttttctcacctctctgttaggtcatctaataatgacagtgcctccatatctcctggttcaagtgttaaataataagtcaataattcttgcgctcttttcagctgcccttcttctcttaagaaaaaggcatactctttcaagaaatctggttcatgtgatagttcatgataagcctgttcatagtgtacagctgcaacggtaaagtcttctaattcattataagcatgggctaggttccattctgcataaggattagcagtttcttccatctgattgatcacttgtatcacatcttcatatctttcatcatccaagtaaagattgcttaaagtaagtaatgtttcatcttgtttgtctcctacttctaaagctttcagtaaaagttcttctgctcgctgtctatcatgcagacggaaagcattttccgaggccaggtgataaagttcgacttggtaaggattttctttgattccttcttctaacactgtttgtgcttcttcaatcatttcttcttcttgaagagcttgtcctagatatagatataacgattgataatgcggattaacttctcgaagttcttccagatagttgattgcctgctgattttctttcaattgaagattcgtaaaagctagctggaacagtcgatcatctgtcctttcttctttcagtgcttcttctaaaggtgcgatagctgcttcgaattctccttgcatacttaaggattgtcctaaacgttcctgcatcgagattcctgaaatttcatttatcccgcttgccaacaatgtttcataaaccactgctgcctctttgaaacgatcaactgaaaaatacaattcagctagcgcaaactggatcaatggttcatcaggaagcaacccagctgcttctttcaattttgcttcactcacttcagggattccgataacttggtacaaatcagctatcgccaataaactttgcggatagtaatcactttgcttatccactttttccaggtattcaaaagctaagtcgatctcattatcttcgattgcaatttctgctaacgggatgttcagtccgtcattttctgggtattggttgatcagttgttcaaaaatctgttttgcttcgatcaaaaagccaatagccagcaattcttcgcctagttcagctaatatatctgctgggtcttcttttaatgctttttctaaaaagatttgtgcttgtgacaagtcttcatctgataaagcttgcaacattttttcgctatttgtattcatttcaattccctcttatctcactgacgatttgttgaaataccgtcattgttctcaataattctttttcgtttggacgttggtatccgtctattatacctattttttctaaaacaagtatttttttgcttttttctgccaaaaaaagaactttttccaaatactccatctttgaaatctgttccagccagtggattggatagccaagcaagtccagccacacaaaaaagttttttagttggaaatcaaaaggatatgcttggagattccacacgaaatgaaacatcattcctaaaaattttttcatactagcagaaagtagatggccattttcggtcagataaaaagcttgttcaaacagtttaccataatttgacaggttttctgcctctaattgataaaaatagatcatttcttcgatcatcccggcaaacggccgagtcgttaattgctttttatttggatagtttttatacagattttgcaaaaaacgatgatcacaaatcattccgcaacagataaaagtcaaaaagtcaatctgctttccgtccacttgccgctcgctgattgtttgatcataaacgatgcgttctggcagattgatggtttgcagcactacacgatttggtagctgcaaaatcgtccgctgcggtgttaatgctcggcttagagaacggatcgatacagggatcatccatagtgatgaatcaagggttgtatgtttttgaaaaaaacctgccagatccatgatcccttcatttccaaatccgatgacaaacatggattgattttcgggatagcgtttgacgaaatcaagcaggttctttaattctgttaaatgattgcattgagtgttggcacaaatataccagtcattgtttgcttgatttgcaaataacgggttgatcttatctgcaaacaaatcataatagcgctgattcgttaaaaataagattggctgatcaatggaaagttctcttagctggctgactagcgtttctccgtaaaacactttcgtcaacgtatcttctacttgataatcaagttccatacgcatccctcctcttcttatttttattttaccattagtaagcaaattctagaaaagataagagcaaagctcacctcataacttggaaataaataaaaattaaataaaatacatgtgttttctatgtatgacatacggattcggaatctctgtctcttatttattccttttctgctaggaaataaaaagaaaagcacttgtagccctagagccacaagcgctttttcaactgtcttatttaacagcgtcttttaatgctttacctggtttgaatgcaggtactttgctagctggaatttcgatttcttcaccagtttgtgggttgcgacctttgcgagctgcgcgttcgcgaacttcaaagttaccaaaaccgattaattgaactttttcgccgttagctaaagcatcttgaatagttgaaaatacagcatctactgctgcagttgcatcttttttagttaaatcagtagctgaagcaactttttcgattaattctgctttgtttgccatggatagattcacctcctccacaagagatatgatagaaatatcatttagttaaaactttctgagtggtccagaagtttaaaaagaaatattgattaacttcaatattctgttatcacgatatcatatgaaccgcttaatagcaaggtttttaccaattttcacatgctttttttagtcatagaaacgtaacaaacgaaactgtctttttcttttgaaaaaaaaacgtcgatatggtaaaatgcctattttctcctacgagggataattcggatggacgtcccttcaaaagtaaatgcttttctgatttgattttctaagaaacgttcataagaaaaatgcatcaattcctcttcattgacaaaaacgacaaatgtaggtggtttgacagcgacttgtgttgcataaaaaatcttcaggcgttttcctttatctgttggtgttggattgattgctacagcatccataatgatatcattcaacacagccgaagagatacgaagattctggttcatacttacttgttcgatcatttcaggcagacgttccaaccgttgtttagtcactgcagaaacaaaaacgattggagcgtaatcaagataccggaattcatcacgaatctcttgttcgaaatcacgcattgtattggtttctttctttacaagatcccatttattcacgacgataataattccacgaccagcttcatgggcgtaacccgctactcgcttgtcttgttcccgaatcccttcttcagcattcagtaccatcaaaacgatatcagaacggtcaatggcacgcattgcacgcatcacgctgtatttttcagtattttcgtatacttttccgcgtttacgcataccagctgtatcgatcattaagaatttctgaccactttcagaaacgaagtgggtgtcgattgcgtctcgggtcgttccttcaatatccgaaacaattacacgttcttctcctaaaatcgcattgatcaaagaggatttaccaacatttgggcgaccaatcaaactaaacttaatcgtgtcgtcgtcctcttcttcagtctcttcagagaaatacttcactgcttcatctaaaatatcaccaatccctagtccatggcttcctgaaacaggataaggatcgcctagccctaaggaataaaattcatagatatcgtttctcatttctggattatctactttattgactgctaaaatcactggtttattacttctgtataaaattttcgcaaccatctcatctgcgtctgtcacgccttcgcgtccgctgactacacaaatgattacatctgcttcttcaatcgcgatttctgcttgatgcttgatctgatccataaaaggttcatcgccaagatcaattccgcctgtgtcgatcacgctgaattctcgacctaaccattcaccttttgcataaatacgatcacgagttactccaggagtatcttcgacaatcgagatacgctcaccagcgatgcggttaaaaatcgtagacttaccgacgttcgggcggccaacgattgcaattgttggatttgccatattatttcctcctcacaagtttccaatctcacttagtttaacgaatgcattgccaactttcaagcatagattgtcaattaaacgaagtatttttattccttattgaaatactaatcgcttttcaaaagaaaaactgagacaaaagcagctgctttcatctcagtcacagatacaaaatcaattatttttcagaatcatcggttgctttttcttctacttcttctttcaacgcatcacctaaaatgtctcccatagtaaatccagtattttcttctggtaattcataagactcaacattttttggttcttcttctgaagctggtttttcttctaaagctttgatactcaatgcaatacgatgttcttctggatggatctctaatactttcactttcacttcgtcaccttcatgaagcacttcatgtggtgtcgcaatatgtttatgtgaaatttgagagatatggactagcccttctactccagggaacacttcaacaaaggcaccgaagcttgtcaaacgtttaactgttccgtctaatactgtgccaactggagcttttgtatcgatttctgaccaaggtccaggctgtgtgtctttgattgacaaggaaacacgttcttgttcaggattgatagacaacactttgacatttacatcatcattgacagccaatacatcacttggttttgctacatgactatgtgaaatctctgagacatggactagaccgtcaattccgcctaggtcgacaaatgcgccaaaatcagtaagacgtgcaacacgtccactgagaacatctccctcatggatagttgaaagaatttcttttttcttttcttctctttcgttttccactaccgctttatgcgataagatcaaacgattttctgatggttcgatttcgatgattttaaagctcaatgttttgcctttatagtctgaaaagtctgcaacaaaatgatcttccaccattgatgcaggaacaaaaccacgtacaccgacgtcaacgactaaaccgcctttgacaacatttgtaacaggtgcttcgatgaccttgccctcttggaaatctctttcgatatcttcccaaacttttttagcatctaaacggcgttttgaaagtaggtagctgccgttttctttatctttgccgatcgtactgataacgactaaatctaatacatcaccgacttttactacttcgctgatatcttctaccggcaaagttgataattcttttgccggaacgactccttcaactccagccccttcgattccgacaatcacttgtttgtcttcaatgactaaaacttcgcccttaacaacatcgccaacttttacttcttgtacgcttttcattgcgtcttccattgactggttgttctcttgattttgatcaaattctgtcataacacttgtcctcctaaccaacattctgccgtaagtacggtactgtttttagtttaattgattattcaaaaaaaataaagcgatttcgttcgttttccttgaaaaaacaattgtttttcatttttttcttaatttaaaaaagaagataaccttttttcaaaacaacagcttttattgctgcaacgacttctggaatcgatttgccagtcgtatcaatacgaacagcatcctctgcttgcttcagcggagagacgtcccttgttgaatcataatggtctctttgctgtatctctttcgtcagtgtttcaagatcagtcggaattcctttttcttggttctctttgaaacgtctttctgcacgctcacttacgcttgctactaaaaagattttcacttctgcattcggtaatacagctgtcccgatgtctcttccgtccatgacaacgccaccgcgttcccctatttttcgttggatagcaactaattcttctctgacttttccatgtgcagagacttcagaaacagcttttgtgacatctggttgacggatttctaaagtcacatcttttgatgctatgaatacatgctgtccatcttcttgttgcgaaaaagagataggatactttttgatcagcgaaactagcccttcttcatctgaaaaagatacattgttcgtaatagctaaataagttactgcgcgatacatggcaccggtatctgtataaatataattcaattcttttgctaatatcttggcaacggtacttttcccagatgaagcaggcccgtcgattgcaatactgatttgtgtcatgatataactcctttttctcaaaaaaaaagccgcaaagcgcggctattattatttaattcttaattcttgaccagggtaaagcataaagttgtttggatctaagccattcaattcaaacaattgatcagtggtgatccctgcacgctcagccacttgttttggaccttcgcctgcttgaacagtcgttgttgaaccggctgcagctgatgaagaaggtgttgtttctgctgcattgctgcttgaatcccctgcttgataagttgcttcacttgaggaagtcggtgttgtctctgctgcaatactgctttctgacgttacacctgtatcttgagacacagtagattcttccgcgattgtactagattctactgttgaagtctcagttgactcctcttttgttgtacttgtagaactttcaactactgatgtcgaagtttcagaagaagttgctgctgttgcattgttgcttgatccatttctgatccagaaataagcacctgctggaatagcgatacataagaccagtaaaatcaaaaatagcgaaagaaataatgtatttcctttcttttgttgtctctgagaacttcttgatgaaacttcatcatctgtatcgtagattggttgttcccatggttcttgtgtttcgttattttctgtagattgatgtctatcttttctgctcactgttttacctcctaaactctatcgtgtgtattataccataggaaaaagtgtcttgtcctaaaaaatcaatgttccatgttttttttaaataaatttagtaaaatcgtttcccaatgaagttgttcagtcttagaaaaaagcttcctctttggcagaagttctgcttttgctccatcaatatcacaacaattctgcggcttttcggagagtttttcgccaaaataagctaagatgaattttctgcggcagttttcttcattaatatagcgaagcatctgctgcaggcggaattctttttctttttcctgacgtttgagccgttccacccaattttctggtttttcagactgctggatcagctccatccattttttttgcagctcatcaaagggagcttgctctgtggcatattccaaataaagctcaaaactttgtcgctgttctctagaaagttgattaaagaaataatggatacgttcatccccactttgataaaaaagaattgctgcactttcttcctgatctctgcctgctcgaccgatttcttgtacatagttttctagactgtctggcaaatcataatggaccacataacggatatcagatttatcgatccccataccaaatgcattcgtagcaatgagaaactgcagctgattttttacaaactgctgttgaagttgtcttctttgagctgcatcaagaccaccgtgatagtatccaactgtaaaacgttccctgaataaatgatacaatcgttcgacttctttttttgttgcacaataaatgattgccgctccttgtgctctttccatgaagtgttcaagttcttgttctttttgctgcgttttccgaacaaaaagcgagatattttgccgattgactgattgtctgatctcttttggtggtcgatcaaatagtacatgacgtatatctcttgctactaaatctgttgctgtcgccgttagtgccagtgtgaccgggtttcctaaaagctttcggatttttcctaactgttgatattctggacggaaatcaactccccattgagacacgcaatgagcctcatctactacatataacgcaatattttgttttttcagatgctctaaaagagaaggattagtcaacatttcgggactcaaaaacaaaaatttatattgcgatagatgacggaggacgtatcttctttcagattgcgaaagtaaactattgaaagcagctactcgtttctcccctcgtttttgtaattgcgtcacttgatcttccattagagaaagcagcggtgacacgatgatgaccagaccttccattaaataccccgtcaattgatagcaaaggctttttcccgttcctgtaggcaaaatagcgagagtatcttctccatcaagcaacgcctgaataatttcttcttggccgggacgaaatgaatcaaatccaaaatatttttttaattcatttattaacattctgtatcgcttcctttctcaatagatagatttgatacaaacgaaattctccataatctaattgtccatctacattccattcgctaaagcgccactctcgcacggaatccttatttggttccaaacgttcgattgtttctgcagagagaatccactcgtatggaaaatcatcaaaaaacaaggcccactcaataagatgatctgttactgttcctctttttaaatgacggattgccatgatctggtcaattgtctgaccattcataaacatctgcttggtgatcatcatgctttgattgaaattttgctgtaataatgaatcgatcaaagcgtgccaaagcgaatctggccgtttttcgatttgtgctaacaaaaggtggatacatctgctttgttgcagataaaccgctgactcatcattgttttttgccagctgataaggaagcagccctgttcgctcatttccagataattggttagctaaaaaatctgctgcttcttctggtatctccgaaaacagctgcaccaaactctcatacgcagtatcaatcaaaatttcacgtggcaattggctttcactaagccatttttttagttggaaagtataaaaaggacttgtctctgctggaagatagtcttgaatacccgttgccagattagaaattacttgaacagcaaatttaatgagccgccaactagtttcccctgttctgccatagcggtcaaaacgcaaaccagtatgttctatttgatgttcggacaacatatcagcccctgcaggcgttagctttgcttcattttcatttatttcgatccaaccttgctgcgcaattttttgcaaaatttgataaaacttatcctgcttcaattctggaaaactgttatggataaacaaaagttcgtggataaatccataaataagtactgaagtcgttcgttttcccacaaggagttggtaaagagaactaatccgcagcttgtgtcctgatgaaaatagcgataaaataaaaacaatcatattattctccttaagttaggatggttagaaatgtcactactatgtaaacttgtacctgaatgctgtattgcatgcggtctttgtcaaatcgaagcgccagatattttcgattatgatgaagaaggaatcgttttatttgcccaagaaccagaggctcatcaacagttcgtgatgccggaagaagaaacatatgtaaaaaaagcgtatcaaaaatgtccagttcgagcgattttattagaaaataaaatataaatataaacgaaactttaaaaacgtacactaagttctctaaacttgaaaataagccgggatctgtttctcttgttccgtgaaatcccgacttattttgaaagattcatttgctatctatagttaattgactagttttttcacggaccctataggacccatttatattatttcaactttttcagccagttttccaatgtattgacgatcacagtttgctggtctgcgttagaaatttctgcctctccatctcctttttgctcaccatagctgccaaaacctccatgatttccgccattgattgatacatactctgttctttccggtaaatactgcttagcttcttgataagcttcctgattcaatactttatcttttgtcgccgtgatcgataaaacagggacagctgattctgtcaatgttccttttttgtcgggataacttgccatgaagaataccccttttaaatgtttgtctgaatgattcttattgacataacgacttgccattacgccacctaatgaatggccaccgatcacataatcggaatttggaaaatcttctttgaccttatccgctttgtttccgcccatcactgctagatcaagtggcattttgacaatagcgactaaaaagccgttttttgctaaatcttgcgcccaaatactataactttctggctctacgagagcaccaggataaaaaataagtaatggagactttccatgattctttttctctccttcaaaaaataagtaatcttctttgttttttccttcttttaccaacacttgcgcttctgacgatggttcgtacgtattttgctgtatatagtaataaccggctccaccgagtaatcctaaaatgatgactaagccaattagtattcgtctaaatattttcactttctcccaccttttctatctgagtgacccctttttcttaatcaagtatgattataccttaaaaaaaataagagagaaatgcaaactttccagcatcaaataaaaaaagacggaatatccatttgaatatccgccctttttgtatgtttatttttatttagcacataaacgatacacagcttctgcataaatttccattgctttatacatactacttaattcccatcgttcattcgcctggtgcataaagtcaggagtatcagggaacatcgcaccgaatgccacacactggttcatcgtacgagcaaaagtagcgccgcctgatacaaacggttcagtcatgtctccagtaatatcgcgatatgtccccaatagatttttcactaactcactgtctagtggcacgtataatgaatcaaggaagtcaaattcttcataagtcaacccatatttttctgctgttttagttaatttagctactaaatcatctttcttgaatgtaacagggattctcatatctacaccgatttttgtttgttctggtgtgatttccaaacttgcaaagttcatcgttagctcgccggattgttcatcttctgttttgcccacgacagcttcaccagttgcattttcttgaactaattttcctaagaaattgattgggccaaaatcgaatacttctgaaagagcaattgccagacgagaaatagcattcactccttgtgctgcatctttcgcgtggatacttttaccaagaacgacgatgccttcaccttgttcttcgaaatcgaattcgtgttttttcaatgcttcttttacttcagaaagcttttctccagagtaaggagctgcatcaggaacaacattcaacgctcctccagcttttacagaaaactcgttcgttcctggtcctgtcaagtaagcttgcaataagcctttttctgcataaattaaaggaaattcagcatctggcgcaaatccttgcgtaattccttcttctttttcgttatatttttctaaacaacgccataaattttcttcatctgtaccaaagataaaacgaatacgtgtcttgaattccacgccagcatcaatcaaagctttgacggcatacattgccgcaatagaaggacctttgtcatcttgggatccgcgaccaactaaccagccgtcttttatagttggatcgaatggttttgtttcccaattattttcgtcccctgctggaacaacgtccatatgacacaagataccgaataattcatctccagagccaatctctgaataaccgtaatagccttctggatctttaaatgttctaaatcctagcttttcactgatttccaatactttatccaaagcttcaatcacttttttaccgaagggatgtccttgtcctgaatctgcttcatctagtacggaaggaattcggatcaattcgctcaatgattctaatgcttgttcatgatgttgttctgtcacaaattttttcatgatattatcctcctaatatgttaaaaagggtcatgtcaaattcctccgacacaacctcttcttctcaaataatgacgttttaagcctgctccatcagcaagcagaatgttcttaacaaatgatgaaagaaaaaacactcactgaatggagctattgacttgtccacgtgcttatcgatagccgtttatcggtttcttcattcttatgatagaccttgtacctgtatttgtctaggtttagaacattgctgctacacctaggatcacacagatggctacaaataatatcgcaattaatttaccggtaaatttccaccacactgaaacatcgaaacgagcaattgctacagcacccattacgatagcagatgttggtgtaattaagtttactaaaccagatgcagattgataagcagtgattactaaatccttaccgacgccggcaaattcacccataggtcccatgattcccattgttgcagcagctaagccggaagttgaaggaatcaagaatgacatagggatatagaaaataaatgtaataatgatgaatacacttgaagataatgaacttaatccttgttcgccccaatgtaagatggtatctgtgattaatccattgttcataaccacttggataccacgagcaacagctactacgattgctacaccgatcaaatcagaagcaccagctaaaaattcagagacaaattcagactctttcatgccataagtgattgctactacgatggacattactaagaataacatagtaatttctgggaagtaccagtcacctaatggaagcatgcttttacctagaaccgtacctagtaccggaaggtttgttaaccagtttgtcaatgattcaaaaatcgtgaaattcgcattcaaggttgtccaaggaatcaaactgatgatcatgataccaaaagtaataaagaacaatacattaacatgtttttgttttttcgtgattacttcttgacgaccgattgcttcaatatcgaaatgcttcatatcttctttacgttggttgtatactaatgattttgttggatctttttcgatctttgatgcataacgatacacatatacaatagaaatagctaacaaaataacgaacatcaagaatcgaagaccaataccttcacccatcgaaatcccaacagcttgtgaagctacgcctgttgcaaaaggatttaccgttgaagctagacagcctacttgagaccctactaatacgattgctacagctactactgtatcaaagcctacagccatcatgactgggatcagtaaagcatagaatggaatcgtttcttctgccattccgtaagtagagccgcctaatgcaaataacagcatcaatactggaataagcattttttcttttcctttgaatttcttcacaactgaagcaatcccggcatctagtgcccctgttttgttgataatacctaaaaatccaccaacaaccaaaatgaagaaagagattgggattgcagcaggtgtttctttagttagctcccccgctggtacacctagcatcccattgattggcgccatgaaaatatcccacagcccttgaggattttgttgtactcgttcatatgatccagcgacgatgttgcctgcatcgtctacactatagtgcccagctggtataaaccaagtaagtacagcgattactgcaataataataaataagaccgtatacgctgaaggcatttgaaattttttcttttttgtttgttccatcttcttcttcctttcttttccgttagagacaacaattttggctctaatgttattttatcaaaaagagtatcagaacaaaaataataacacgcattttgtaaaacttttgttcaaaaagttcgtttttccctattccctcctcttttttcaggtttttaaagctttcttctttttcattgtagcgtttccttttttttataaacaaacattttcgtcttttaaaaggagaagaatttcacatttgcaaagaattgattgatttttatgcataaatcaaaaaaatactcaaaacaaacaaataaaacgtttacattattgcatgtcttgtatttttttccaaaaaaaaagaccaagaaatttcttgatctttttgatatttatttgactgctgtatgacgttgttcgaactgatgttgttttcgacttaaccatggaagaagttgcgcatgcagcactaaaaagacagcgctcacgatgaatcctttgatcaagttgaaaggaacgatcccaatcagtacatagtttgctaaagacatgcctagcatctgtgttgcgttcagtcctaaaaacattaagtaaagaggcgtaataacgaaataatttgcgatactcataaaaatagttagagcgatggttcctgtaatgacacctaaaaatttgtttcttcctttatgctgtttctttacactaaagaaataataaatcgggaatgtaaagatcgttgttgataagaaactagcagtgtctcctaccaaattatccggagaaaaacctgtagtcagcagatgtaatactgaacgcaagaacgctgttgcaactccggccgctggaccgaataagaacatgttgatcaataccgggatatcactaaaatcgatcttcaaaaaactaaaagccggcatgatcggaaaagcaaaatactgtaaaactaacgcgatcgcagcaaacatcgctactgcaaccattttctgtacacgggtgttcttcatttgaaatcctcctgttaggactcctcttcagcgaactttttgacgtttctctccaaatgaaaaaactctattttccagggaaaatagagttagagttatttgatcaagcgtcgtcaaataagctctatcttctttatccagactatactgtcggtatcggaatttcaccgattcagctattttttgcaaaataggtcgtggactataaccaccggtcgggaatttcaccctgcccctgaagacgaaccttatataatttttgtttacatattcattatacatatctattcaaaaaacgcaacatctaacacttataaaaagtaagtgttcattttgagtggttcagcaaactgctgacttcttttttgttcagttcacggtaatccccaggacgtaggccttgtaaagtcagatctccgtatttttcacgttttagtttttgcacaggaagaccaactgcttgaagcatatttttcacttgatgattacgtccttcgtggatcgtcaattccacgatactgtggtttgtcttaggatccactgataaaatttggaatttagctggagatgtttttcgtccttcgatctttattccttttgtcaaaggtgcaagcatcgattttgtagcgatcccttttacctttgcaacgtaaactttatccacttcatgttttggatgtgtcaggcgctgagcaaaatctccatcatttgtcagtagcaagatccccgaagtatcgtaatccagtcgacctacaggatagatacgttcttttaccatcggcaaaagatccgtaacaacttttcttcctttgtcatctgcaacagcagaaataactcctttaggtttgtacaataaataataaccgtattcttcttgataaattgggacttcatccacttccacagtgtcatgtttcccaacttttatccctaattcccttacaacttgtccgtttacttttacacgtcctgcaaggatgaattcttctgcttttcgacgagaagtgatgccagcgtgggcaattactttctgcaatctctccattacaattattctcctttattcattccatcaaagaatagatctggtgacacgtcttcttcaagtgaaatttccatttcttgtgtatcaggcagttcttctaatgatttcaaaccaaaataatctaagaagtagccagttgttccatataatatcggccgacctggcccttctactctacctttttcttcaatcagtttatgggcagctagacgctgtaccgctcctgaaacctgaactcctcgaatctgctcgatttcagctcttgtgattggctgtttataagcgatgattgctaaggtttcgacagcggcttgagataatgtgtttgatgtcccttgcgcatatcgcttaagtaagggagccagctcttttttagtcgttaatacataatggctttccgtttcaaaaatatgcaaagctgagtgcgagttttgagtgtaagattcttttaattctttcactaaacttgtgacttctgcttcgctgagatttaacagtccgcttaattcttcattactgatcccttcctcgccaacaataaaaagaagggcttcaagttcacttaatttcgtcatgttcggtatctcctactgctggataaagcataattgattcatagttttctttttgttgcgcaatgatctgcccttttttcatcaattctagcaaagccataaaagtagtgacaacttcacttttagaaggtgactcaaaaaaagaatcgaaagtacagccatgcgcatttctttttatacgctcttcgataaatatcattcgttcttcgatcgttgtgtcatcgggcgtgatcgttttttccactttttgagaaaatttcttacgttctaagattttctgcatggcacggatcaaatcgatttttttgacttgtcctcgcttcaacggcttttcagcatccgctaacccatcgatgttcataggttcttttgtgtaataaagacttcgttcctctgctttttctgtcagtctttcagctgcatatttatatttacggtattctaaaagctgagtgaccaattcttctcgaggatcttcttcccataattcttcatcgtctgtgacgaattcttggacaggaagcaatgtcttgcttttgattgccatcaatgtagcagccatcactaagtattctcctgcaacagctagctctagtgttttcattgtatggatataattcatatattgctccgtgatcgtagcgatcggtatatcatatatatcgatttccatttgctgaatcagatgaagcaacagatcgagaggaccctcgaatacatctaatttaatattgatctccgtcaactcattcactctttcttctttttctttgctagccattttccaatgtaaggctctgtgatttcagttgcacggatggagacatccgggtacttttcctgtaattcatctaacatttgaaagcccatattctcaccgcgataagacggattcaaagaaatgtcatggatgatcagctgatcattcgttgcccagtaaacaccaataatcccttgaatgttggttgaaccttctggcgtaaagaaaaaaagttcataatcgtcttcagattcgtacgtatcaatctccttcaacaaagaagttttacctgtcagtttcttatggaaactcaatagtcccatagcaattttacggttttctttccggtaatgtgttaacatcttctcaccttcctatgactaagcccttggaaaatgctgcttataaacatccgtcattcttttcttcgtgatatgtgtataaatctgagtcgtagagatatccgcgtgacctaacaattcctgtactgtccgcaaatcagctccattttctagcagatgtgtggcaaagctatgccgcagcgtatgtggtgttacttctttgtaaatcccagcctctcgtactagctgcttcagatttttccagattccttgccgagaaagacctttcccatgattattgacaaatacatgcatttcagatgcgtcctttacaagtaatggacgtgcttcgtctaagtagcgttccagccattggatcgcataatcacctaaaggaatgatccgctctttatctccttttccaactgtctgtaccagtccaagagaaagatgaagatctcccaatttcaatccaatcaattcactgacgcgcatcccagtagcatacatgacttccaagattgcacgatctcttatccctaacgtttttgtcgtatcaggtgcttcaatcagcttttctacttctgtcagagtcaatgtacttggtaatttctgtgctttcttcggcgtatcgatatgttgcatcggatcatgatcagtgatacgctcttgccgtaaaaactgatggaatcttctgagacttgagatcatccgagtaacagttgctgtcgcttttttttcttcatgcaacttctccagaaaacggatgactaaaaagcgatcgacatcctgccatgaagcaattttctgctcctgtagaaaatgcaagtaatgttccaaatcacgttcatagctttgtcgtgtattggcggacaatccccgttcaatattcaagtagtggagataatcgttgatttgctctttcataataatccccctcatgcctctctatcatatcagataccgcttcattctgatagtctttttccataatctgagcaaagaaaaagccgtctagacactcagacggactggtttcttttttctttttcatagcattcctgacagattccatggaacgtcagccgatgatcttttactaaaaaatgataacgttcttctactacttgctccacttcaagtaaaagatcctcttctacttcctcgatcgtgccgcagttcaagcatagtaaatgatgatggaaatgtttggcgccttcttttctcaaatcataacgggctaatccatcattaaaacttactttatcgacaattttcaattctgtcaagatttcaagggttcgataaacagtagcaagtccaatttccggactcttttttttcactaaaaagaagatttcttctgcagataaatgctctttctcattttccaaaagcacaagcagagtagcttctctttgcggtgtcagcttaaaccccgcttcatgtagctgctgttttgtttttttcatcgccgaaatagcattcatgaccatttactcaaccccaacaatttataataattacaaataaaaaaagatataacactatgctaattaaaattattataagctagttaagaaaaacatgcaagggattctcaattagattttttgactagttttgtcacaccgttttcttgtttaatcagtccttgtttcaaaagattgcctaatgcccgcttaaaagcacctttgctgatgccaaaagctttcatgatgtcttctggatctgatttatctgtaaagttgatttgctgatctgcagaacgttctaaaatggttaaaatcatttgtgcatcatctgatatagcttcgtatgctcttggcttcaatgaaagattcagtacaccgtctggtcggacaccaatcactcgaccttttatctgctcgcctagacgaggttcattatatcgttcagaaggatggataaacccaagatagaaatcttccgttaaaacgtacgtacctgttaatttcaagcggtatgctgttcctatcacatctttgtttttcatttcttctgttccatatttgcttaaagatttgaatattttttcatctgctaaactgccccaaatacggtcttttgcatcaactctaagggaaatcatcaagcgatccccttttttaggccatagttctgtcattgtcggcaattcatcaagagatacgacaaagtctttatctggaagaccgatatcgacaaacgcacctaaatcttttcgtgtagcagtaacgattccaaaagcgtaatgaccgatacggcttttaggaatttgtgtagtgatccgattttcatgtttttgattttggtaaccgaatccttcaactgcttcaccgattttgtgttcaccttctgatttgcttaagccaaaggtttgtccgtttttttggacaaagtagtttttttcattttcatcaataataatacctgtaaatatagttgctaataaatcgttcatttttttctccctctatagtgaaaggttttcttaatacatttctttgctatcataacataatgttatctacttgaatagctgagccttggtttggaaaggtgaaaaaaggagtatgacaacagttgtgtcatactcccctttttcgaataaacggtgttaaacggcaggctcacagcctctttcatttgcctaaaattaattgctcccatttcctccgaaccatccagttttacagttgatggttacgatgtaaaatggcaaagcactttctccaatgcctttcatcaatgcagattttgttgaagtggcatatagattgtaatagccttccccattttcgattctggctttttctaatctgtatcctccttcaacgatatatccacgttggatacatgtagcaatcactttgctttggacacctggtgcccacgtccatgctggattagatgcatcggcaatatcacttgctctggcagatttgattggctgattcgctgagtttgaagaggaaggggtcgaggatgccgcttcttgctgtgctgcttgtgcgaccgcagcttgttgagcggcttgagctgcagctgctgcttgagcggcttgttttgcttgttcttcagctgcttttttcgcttcttctgcttttttcttttcctcttcttcttttttctctttatcagtgagcatcttatctacttgttgcaattgttcattcaactgagcagatagatctgtatttttcactttttctactgcttcttttgccgtcttgtattggtcgcgtgttgctgaatccactacttttccgtctttaaagactatagctgttttttctttagctgtttgcaattcagcatattgatttttagcttctgtttgtgcttgttgaatcaattttccaaaatctgtgttatccgtttcgattgcttggatctctttatctgctttcaacttgatgtcatctgctagatgatcatcgacgatggcaggtgctatgaaccactcattcactttttggatatctcggatcttagattggatatcttggtaagttgtttctaactctgaatatcctttttcattcttaagactggataaatcattttttagttttgataaatcttgatgaatcatatctgcacgaataaattgatggtgatcatctgtataaaaggcagcaagtttctcatgaagttcttccatttgttgctgtctttttgcttctgctgctacttcggcttctactttttgatgatggtcataataagcccagcctcccccacctagtagaagaactgctgctaaagcgagatacggcactttttttgattttttcttttgcgctttatctggatctgttttttctaagtttgattcttgatgtgttttttcagtatctggcacgattgttattgatttcgcttctgcttcaaacagcttaggctggttctcttctttttctatttttgcttcaagagcagtaccctctttgcttacagattgattttcagcatcggcttcattatttattccatccgactctgttgactttttgtctgtgttttcgagtatttcttttttctctgcttccggcaacccattcgatttctcgtcttctgattgtttttcagacaatgtttcagttttttccgggatatccgtttttagatcattcgttttcaatgattctttacctgcagcgtttactccactaatgtctttttcagtgtctttttcagcttcatgttctggttctactttgttttcctgtgcaattttttcactgatcattttgagcagctcttccgcatgctcttcctttgtatcttcacgatgtgctttgatataggcggatagtatcgaattttcttcctcattatcgacgatttctttcagttcagctactcttcttttttgttttgattcaagggtttcttcttgattctttcctgattcttccgaagtctcatgaacagttgctttcttctgttcatttttctctatattagttacttgatcgtgagcaggtggttcttcgtcttctggttctgctttttcgaataattccattacagattctagaggtaaatctttcaattccgaccattcgattggatcgtttaattctgtatcaggaaagactgcatcttcagttgatttatcctgcatagctgcatctgtatttgtttcttcaattgattcttttatttgctgatcttctgcagttatttgatgaccgcagtctggacagatagtattctgctccatttttttcgatccgcaatttggacattttttcatcacttagcgatcggctcctttactaggtttacgctaccatttaatctatcatattctatacgtcacgccaatagcttatttttaggatttacttaaaaataatgaatgaatttccttcctatagaaaaaaaagcttgagactgcgtagtctcaagctttttttcttttaaaataaaccaaacagttttactgatttctcttctggtcaatagttcatgcttattctaagaagtcttttaattgttttgaacgagaaggatggcgcaattttcttaatgctttagcctcgatctgacgaatacgttcccgagtaacaccaaatactttccccacttcttccaatgttctcgtccggccatcatctaaaccaaaacgtaaacgaaggacattttcctcccggtcagtcaatgtatctagtacatcttccaattgttcttttagtaactcataagctgcgtgttctgctggacttgttgcttcctggtcttctatgaaatcacctaagtgagagtcatcttcttcaccgattggcgtttcaagtgaaacaggttcttgcgcgattttcaagatttctcggactttttctgttggaagatccatttccgcaccgatttcttctggcgtaggttctcttccaaggtcttgcagcaattgacgttggatacgtatcaatttattaattgtttcaaccatatgaactggaatacggatcgtacgtgcttggtcagcgattgctcgagtgatggcttgacgaatccaccatgtagcataggttgaaaacttaaatcctttgcggtagtcaaatttttcaactgccttcatcagtcccatgtttccttcttggatcaagtcaaggaactgcatgcctcgtcctacataacgtttagcgatacttactactaaacgaaggtttgcttctgccagacgctgtttcgcttcttggtcgccttcttcgattttcaatgctaacgctacttcttcttccgcagttaaaagggagacacggccaatttctttcagatacatacgaaccgggtcattgatttttacaccggttggcgcagatagatcttctgtttttgcttgttcagcttttttctcagcactcttcaagctgtgaattgatggatcaccattttcatccaccacactgatacctgcgtcttcaatcttttggatcaatttgtccatttcatctgcattcaaagtgaatggtgtagcaagctgattggataaatcatcatatacaacttgtcgtttgggtttgttttctttgatgaaagctgctactgctgcttcatacgtttttttatctgttccatttgccataaaagaaggccccccttgagtagctatttggcttgttttaactgtttcgttaaattgatgatttcaatcgtcaattcaagctcaagctgtttgtttccagtacgtctggcttcttgctgcatttgtttttttaatgttatttcatcagctaagccagatttgctgatcacatctagcaagtcttggatttctcgtggcgaactttcttctgccaccggtaaatattcgatctccaccaccaaccgccttaaattttcatcttgcaaaaagtctaaaaactctgcaaggttgaattcataatgttgtgagacatatgcatcgaataaaaaataaacttctgcatatgcatcatgaataaactgaaattctcgttcttttaaaatattacggacagaaacttctttaaatgcacgatataatagaatctgctctgccttttctacttgcgtcaaaggtctctttttccgtgcagtttcttgtctcgtaacctgagtgtgttgactttcctgaggttcttgacgattttgctgatttgtccttcgaagatcgcgcagttgtttttgtatcgtctctctgctgacctgaaactctgtggacagctgcgataaatacatatcttgttcaattggtgaaacgactcggctaagttcaactaataattcttcaaggtattcgattttgtctttttcattatctaaatttttcccttgttttaaataacgtgatttaaaagtaaagactgtttcgcgcccgtgagccactaattcttgaaaagatgcttccccatacttacggagatattcatcaggatcaagtttttctggaacgactacgacagaaagtgctaagcgactgttttgccgaagcaattcaatccctcgattggttgcttcaaaacctgcgttgtctccgtcatagcaaaagaccaattctttcgtcagcttttccatttgttggatctgttgagctgttagacttgtccccatagaagctaatccagttttgataccagcctgccatgcagcaatcacatccataaacccttcgaacaacaaaatttctccgtttttccggatatcgcttcttgctttatcaagattaaataaaacttgtcttttattgaacagttctgtttctggactattcaagtatttgggctgatctttttcctgccctttttcaggtgcaagccagcgtcctgaaaaaccgatcgtctggccttgagaattacgaagtggaaacatcactctttgataaaaacgatcagacatacggccatcatcatgcgtgacaaacaatccagagcgttctaacaattcatttgaaattgattcattcttgaatacttgctgaagaaaagaacgctcattaggtgcaaaacctatgttgaattcttcaattaattctaaagacaacccacgactttgcaaatattctaaagctggctgtccagcttttgtatgcaatagcatgtgatgatagatttccgctgctttttcatgagcagcaatcagtttccccgtagcagattcaggattttggacagctatagtacgctgacgccattgatcttctaacggtatctgttcgaagtctgccacttttaccactgcttctggaaaacttagaccttctagttcttgaagaaaagtaaacacgtttccgcccttaccacaaccaaagcaatgaaaaatctgcttgtcttctgcaacagaaaaagacggtgtacgttcttcatgaaaagggcacagccccaagtaatttttaccagactttttcaactggacatattgtccaatcacctcaacgatattcgtttgactgcgtactgtttcgataacctcttgaggaatccgttgagccattttttcaccccctgctctattgatatcttttgggtttaacagaagatatttcaggagaataaccggtaaaaaatcgcactaactgaaatcagtgcgattttaaaggacacaattatacatgtttgattgtatcatatttcattgctttttcaagtataacacatttctatctcattaagcatcaatttgctactcttttcagtaactgattttgaatatcagccttccagtacaatactcgaagaacaatatttacgagcatgaatacaaagaagtatcctacgctctctcccaaccctaagtttacttccaaaattccatggaacagcattgcagctacatatatccctacgatcgtcgttactgctaggaagatgcgcaatgggttgaagggataacaagcttttacaactgccatgcaactgatcccaatcagcaagtaatacatcaaagtagtagtttcagcatttccccatgcgaatgtttttccaagtagatacaccgcaatgatattcactactacaagcaaggcatttggtaaagcattaataagtgctgtaggcaaataacggtaagtgatttttcttttatcttgttcaaaagataaaaagaaggaaggatacccttcaatcgctaaatcaatcagcgtgatttggatagggataaacggaaatccaattgctgtaacggcacatataatcgataaaataaatgaataaatcgttttgataaaaaagatgcctgagactttcgtcacattgttgaccactcggcgtccttcaaacaggacttctggcaatgtagtaaaatcagagtccaacaataccagattcgcaatctgacgtgttgctccatcaccttctgccatagcaatgctgcaatctgcttctcttaacgccaaaacatcattcacaccgtcgcctgtcattgcaaccgttctgccgctttctttcaattcatttaccagcaatttcttttgctgaggactcactcgtccaaaaaccgtatagcgatgagcagcttctcgcacttccatttcttcagtaatttgagaaagatcgacatacgcatcataattcggtaatcctgcacgtctagcgatattggagacagtaaaaggattgtctccagaaatcactttcagatccacaccttcctcatgaagataagctagtgtttcttgagcgttttttcggattggatcatcgatttcaaacagagcaaccggctcaacaaatgctggtttttcttcgttcaattgctgatttggagcgatccccaacataagtacgcgatagccattcgcttgggctgtttttagactgtccggaagccgatcttcttccaccaaacgttcaggcgctcctacgtacacgactcccagttctggaaattccatcgcgccccatttgcgatcagaagaaaatgcgactttgtttgtcacatcataccgattagaaagctcaaaataatctctcatagcccgcatagtgatgttgttatcactgctttctgccagatacgtccccataatttctgggatggctttctcgtacagcggatgtagtgcttctacccgctggatactcatttttccttcagtaatggtccctgttttatccaagcataatgtatcgacatgggccagcgtttcaattgaatacatgtcttgaacaaggattcgtttttttgccagtttggttacccctgtcgttaatgcaatacttattagcaataccaaaccctttggaagcatgcctaacaaagctgctgcagatgcaataacagaaattttgatagaagcatcgcggatgaacagtgcttccaaaaatagtatgatccccaaaggaataatcacgaaactagtgaatttggatactttgcgaatcgaatctacaagttcagaacgaatagctttgtgagtctttgcctcgctagtcaagcggacagcataattatctgcacctactcggataacttcagccatgacagaaccgcttgtcaaaaagcttccagaaagcaattcagctccagtttctttgacaatcaaatcagattcgcctgtcaaaagagcttcatttgcttctgcccgtccagatataacctgtaaatcggctggtatctgttctcctgctccgatttttaccaaatctcctaataccagctctttagtagaaatcgattgttctttaccgtcccggattactagtacttctgattgggaaacaatcgataatttccgtacaagatttcttgcatgtatttcttgataaattccaataacgatattgacgacaataattgctaaatacgccatgttggaatacgcacctacaaataacagacaaatcccaataccaaagttcagaaaattgaataacgtcaatatattatcgctgaatatttgttttgtactttttgatgcatcttcctggtagtcattttgctggccagaagccattttctgaactacctcttgctgtgtaagtccattcattttctttttctccattttccgccaactttcaaaaataatcacgtgtttaagtctagcgtgttccaagattaaaaacaacttgtttttataaaatttatagaaaaacacacgaatgattttacaaaaaagatgccaacctttttgtttgaatcacccgtgtgctgtttttattatcaatctatctttacttatattgttcctccaaacggctcatccaccaacctagtgctgtaccggctataaaaagaacaggacaagctagcaccccagcaactcccaatcccgcgtaatcggtaggaatgatcataatcgttgaagcaaaaactacacctaaaatgaaatggaatagcttgctatatgcctttgagaaaatgtaatccatgatttttgacaatccaagaacacaaagaatcccaccaattccgatcggcacaatcacttcaagtcgtacttctttaaatccgtcagccatcgctttatacaatcccatatacaccaaaaaattagaagggctcaatcctgggacgatcatacccaaaccaatcaatccgccggcaatcagccatgttccaaaattctgatcgacttgcccgtcaaataattgagcgccgtataataaaaacaaataagccagaacaaaagtaacaaccatgatgatcacatcagaagtatctcttccttttttccctgcttctttccataacgcaggaacagttccagcgatacatccgacaaaaaaccataatatcgttgtttcatacgcacctaataaaaaactgactaaaaaagaaagtagaaagatgcctgtcactccgcctagaccaacaggcagaaaaaacaaaacattttctttgaaattttttgtaaggtgggctaaaaaagaaatcagccgctcatacatgccaaagacagctgctaatgcaccaccgctgactcctggcaagataaatcctgaaccgataaacattcccttcacaaaccgtaacatccagtctttggttgtgtaccccactttttgattttccattttttgccttttttccactatttgcgcactccttctttcatttaattttattcatgattgaacatttcctgctattttacttaaagactttttcataggtctctattattttttcattcattttgacaatatcaggataaaacatgttacctccattatgatagagatagccgccattgtaaagcaaggactggatccgccaatatcggtattgtttcccttcctcatttcctaaaagtgggctcagcacatctttagaatactcttctgctaattctactgtgttttctccgccatgattttttacataggcaatataatctttcccaaaattatatgcttggacagctgtccataaatcgcatccttgtttctttgcttctactatcatttccgccaaatatttgacaccttgatcaatactgtcagctggattatcaatgatctcagcttctccatgcagactttccgagctctgcatgagatctgtcccttttccttttgattcggtcaatattatcgccttgatcaaattctcgtagttttccatatgataattttttgcagctgttgttatttctatttgatagctttccactcgttttaccgaacgataagttcttcctcctaaaaacaacaccgcaccaataaccgtcagaatgatcatgtaaaaaagaatacggataatagataatcgttttcgcttcatttcatcacctagttattttgacatctttttttatcttactatttctttatcttcttggctatttcttccttgatttctgtgtacgccttaagaaaaaatgaattttcctgtattttttgtcatcttacgaaaatgatcgttgtttttcagtaaaaacaattgcccaatgactgatataatcgttatactttacacagtaggtgattatgtgaaaaaagaaaagaaatatgcaaaaatgccagatgggagcgaaatttactatgaaaagagcggtcaaggcttccctctctttttactgcatggcaatgacggcagcggccgctttttttcagaacaggtccctgtactcgaacgctactataccgtgtatctagtagatagccgaggacatggtcgttcgacaaacgaagcatctatgttgaattttcagttaatggccgaggatctgaatacgatcatgttgctggaaaaaatcgatcaggcagattttcttggatttagtgatggagcaaatctagcactggtatttgccagcagcttccctaaaaaagttcatcgattgattttaaattctggaaacacgcttgttaaaggcgttcgtttttctgccagagtcatcagtaatattcattatgcatgggtatggttactctctttatttcgcccaagtcttcgcaaaaatcttttagttatcaaacttttgctgcatgacatcgggcttacagaaaatgatttaaaaaaaatcaactcccccactttgatcatcgtgggaaaaaaagatgtaatcaagctaaaacattctttgtatatagctaaaactataccaaaagcttcctttgtgcttgtgaaagaacaaggacatgaattagctagaaaagatcctgaacgcttcaatcgagaagttcttcaatttctttctgaaacataactattaggaatagaaggtgatttatttgttaaaaaataccatacaatggctgaaaaaccacctaggactgttcaaaacaatctttttgatttctgtcattgtcattattgtcggtgaattgatgtccatcggtaaaactctatctatccagcaattaggagaaacgtttgccactatacctgtctggaaaagcggactaatgctattgattggtcttatctctgtgttacctatggttggttatgatattattttgaatcggatgcttgaacaaaagcagaatcctcgttacctgtttgagacaagctggctgatcaatacgatcaacaatattgccggtttcggcgggtttgttagtgtggggcttcgctctgaactatatggacaaaagaaagagagcagaaacgtgatccaagcattatcgaaagttttcttgtttttgatggctggactttctatttacagtctgctttcttttttacttgtagtcttcacgccagttgctccttttttgaagcaatattggatatggttgatcggcggcggtctatattttcctgtcgtctttttatttactactttcaaaaagaaaggattccttggtggtacctcacttaaaactcaaggacagctattgctagtttcattgttggaatggaccggtgtcctgtttagtttcctttctgttggttatttaatggaaatccggattgatctgtggcaaacaattccgttattcattgctgcttcagtgataggaatcgtgtctatgattccaggagaaattgggagtttcgatgtaatgatgattatcgggttgtccgctattggtgtgccaagagaaatagtcgttgtgtggatcttgctctatcgcctgttctactacatcattccgtttttgattggaatcgtctttttcttcaaaaatatcggttccacttttgatcagcgttattctggtatccctaaacaattagcaacagaaattgcgcataaaatcgtggttgtcttattatacttttctggaatcatgctagtactttctgccactatcccgcaagcttttacagagtttcgctggcttcatagtttgaacccattgaaatttcattttattatccaatttcctagtatactattgggatttcttttaatcattatgggcagagggatcgcagcacgtgtgaaacgagcatatttgcctacaatattcttgattgttctagctttactttatgttttattaagtgattttagtttcacaccggtggttttcttgtctattctgcttctgatcattcttgcttctaaaaacgaattatttcgggaacaattgatctattcatgggagtggcgtacgatcgatggaatcattattggtgcactgtccttgctttacatcgttattggagtatacaatctgccggatttccctcatcggcgtcaccattttatttcctttttcttatttccttctgaaaagatttggttttcgggattgttggccatcatcgctgttagtttcatgatcgttctatttgttcatttccttcaaggagaaaagaaacagattggcgaagcctttaatgaagaaaaggccctgaagatccttacaacttatgggggaaactccgatagtcaattgatcttcttaaaagataagcggatgtttgcctatgaaaaagacggtgaaccaactgttcttctccaattcgcttgcttcaataataaatgtattgtaatgggtgatccttctggtaagaaagaagattttccagaagcaatcgaagcttttatcgaagaaacagatcgactatgctatttaccagttttctacgaaacaagcgaagagattgttatgattttgcatgaattcggctacgatttcattaagatgggggaagaagcttatgtagacctgaatagttttacaacttcagggaaaaaaatgaagggcactcgtgctgtcttgaatcggatcgaacgagaaggatttacatttgatgtcttacaaccaccattttctactgagcaaatgagtactttcaaaaatatctctgataattggttgggttcacgaaaggaaaaagggttttctttaggctttttctctgaagattatctacaaagagcgcctattgcagttgtcaaaaatacccaagaagaaattgtcgcttttgcaacgatcatgcctacttacacgaacaataaagtaggaacgattgatctgatgcgatatgatcctaaaaaagcaccttctggcagtatggatttcttgttcttgcatttgtttgcctatatgaaagaagaacatatccaatggttcaatttagggatggcccctctttcaaatgtcggaacttccagaaagagttttttacaggaaaggattgcatacttggtttacgagtttggttctcatttttattctttccatggattaagagaatataaaagcaagtacgctacaaactgggtctcacgttatactctatattctagagatagttggattgcatatgttatgattgctttgctgattattgataatgcgccagttgagcagacacaaggtagaataagtggtttgaaaaaatggatacgaagaaagtattaaaaactgcataccgatagatgaacactctcatgaggaataaaagagactgaagtaaaacgaaagttcatgcttctacaatctcttcttatacaattgaagaacaaagagcggtccaaacagaaatcctgtttggaccgctcttttattttaaacatttttcattaccaaaatattcgagtcgcgtttcttatgcttcgatctctgtaacgatacctgaacctactgtccgtccgccttcacgaattgagaatgtcgttccgttttcaacagcgattggatggatcaagtcaacatcaatcgtcacgttgtcaccaggcatgaccatttctgtatcttctggcaatgtgattgttcctgtaacatcagttgtgcggaagtagaactgtggacgatagttgttgaagaatggagtatgacgtccaccttcttcttttgtcaacacgtacacttctgctttgaattttgtatgtggagtaatggaacctggtttagcaagtacttgtccacgttcgatatcgtcacgttggatcccccgtaacaacacgcctacgttatccccagcttccccgtaatctaacgttttacggaacatttctacacctgttacaactgctttttgtgtttcaggtttgatccctacgatctctacctcatcaccgacacgaacagcaccacgatcaatacgacctgaggcaacagttcctcgacctgtaattgagaagacgtcttccactggcaatagtaatggtttatctgtatcacgttctggtgttgggatatattcatctactgtatccatcaattccataatagcagcttcagcatctggatcgccttgcaatgcttttaatgcggaacctttgatcacaggagtgtcatcgcctgggaaaccatattcgctcaataactcgcgaacttccatttctaccaaatcgatcaattcttcatcatcgactaaatcaactttgttcaagaaaacaatcaggtattttacaccaacttggcgtgacaataaaatgtgttcacgtgtttgaggcatcggaccgtcagttgcagaaacaactaagattgcaccatccatttgtgctgcccctgtaatcatgtttttcacatagtccgcgtgtcctggtgcatcaatatgcgcgtagtggcgtttttctgtttcatattctacgtgtgcggtattgatcgtaatcccacgttcacgttcttctggagctgcatcaatactagcatagtcttgaggatttgctaggccttttttgcctaatactgtagtgatcgcagcagttaaagtagttttcccatggtcaacgtgtccaatcgtaccaatgttaacgtgtggtttacttctgtcataatgttcttttgccataatttacaaacctcctaaataatatagatcactgaaaaatttcagctctcacctttttattatagtctttttttgactaaatcaaaaagaatacgtccgacttactttttgtaagattcgaactaagcttattatacgtcaatattggtcaaagtcaactaagagcactcgcttgtcttatacgcgaaaaaagtaccttttataaataaaaaaatgtgttttttgagaaaaacttcaagatagtccttaactttcttttgaagcaataagaacaaaatgaggaaaagtttaaaattcagctgttgccaacaactttcaatagacgaaatcttctatttcgttaataataaggaaagaggtgaagtacatgaaaaaattaattggcgtacttgtcgttttaggcatatttctcggcggaagttttgcagcttatcattatttttacggcggcgaagcttattatacaaaaatcacgacgaatggcgaaatgtcagctacccaagcagatagcggagagaaattcacgacttatacctacaagcaagcggcttataataaagatggtgaaaaaaaacaggtgacgcttcgcgaagaaagagaacatccattaaagatgaatgcgtatcttaaactcaaagtcaatcctcgtaaaggtgtgttaagctgggaagaaataaaggcttctgaagtgcctaaaaatgcggcagaaaaaatcgataattagtaaatggtcttaaaattttattagataaaaagaggctgggacagaagcgtttaactccaagaaataagaaggagttgcttctgcttccgccgtttatacgtgtttagagcgtgagacaaaagtgttctttacttttgtctcacgctctttttttgttatattcgtcttttccgatccttctcttgacacaattcatttaactgatcactggtacttgaacacctaatgttctagtcatttttataaacgattcaatacttcatccacatttttgatcatcacggatatcgtaccatccggattattcacaaattcaatcaaatctgggttgcgatatacatctactggtacgatcagttcgatcccgtttgatagcttgaatttttgttttccaaattttttctcagaaatttcttgtacttcttttacaggaggtgcttctgggacaaatccttgctcttgtacttcttctttaaaagccatttttgccgtgatgttttccttgaagactttttccgcaatcatctcatgatccaaccgacctttttcttctatcgtatcatagacagcttctttcaaatcagccatgatatcaaattcttctgtctcaaatttttttccaagatgcttggctactttttggatcacttttacattttcttctaaagaaggtgcaggaacactttcgatcactcttccagaaaaataaagctcttttttgccagaaaactcatattttttttcaattaattcgtaggtccaatcagtcaaattcacagcgaatgcttcatctgctttttgtgttttcgcccctagaattgctcgattcaaaatcaagcggttgtcgatccctgcttcgtctgcttcaacaaagtgagtgtaagcctcacgataattgactttcaataaagataagtacatcactgtatctaattcatacaaaacaacaaatacatctgcactaggtgcttcttcactttcttggtagatatcgaaccaccgctgaacgattgcttcacttgcttccacaaaattttcttgagcgattttaagtgattcaacgatcatgctttcttctgctagttgtccagtttttgtttgagcagaagagattttttggatcttcttttgaagaaaatcacgaatatattcttttgtcagatccagctctttttgtgaaaagactggagaaccagtttctctgtcaataatatgcagaattgctttttttaaatagatatccattttctcattcccttctgtcttagtttacggaaaaaaaatcaaaaataccagaatcaaaatcattttcttttaaacaaaaatttcaagagtagaaacaaaatggattctttttttcgaaaaatgcgctacacttatagttgaacgaataaaaaaggagctgaaagtatgaattcattaacaagcacttatcgtctatcaaatggttacgaaatcccggtagtaggattcggcacatggcaaacacctgatggggatgtcgctgtttcctctgttaaagaagcgctggctgcaggttatcgccatatcgatactgcccaaggatacaagaatgaagaaagtgtcggccaagcgattaaggaaagtggaattcctagagaagagatattcttgacaacaaaattatggaatgcaaaccacagctatgaacttgtgatgtcttcttttgaagaatcattgaagaagctccaaacagattatttagatctgtttttgatccactggccaaaccctgttgcttttcgtgataattgggaacaagcaaatgcagatacatggcgagcatttgaagaactgtatgaagcaggtaaaatcaaagcaatcggtgtgagcaatttcttaccccaccatctagatacactagcaaaaacagcaaaaattatgccgatggtcaatcaagttttccttgcaccaggcgaattacagccaactgtagttgagtatgcaaaaaaacatgatatgatcctcgaagcatatagtccattaggcactggtaaaatcttcgatgtgcctgaaatgaaacaaatcgctgaagcacatgacaagacgattgcacaagttgctttgcgttggtcgctgcaacacgaattccttcctcttcctaagtcagtgacaccaagcagaatcaaagaaaatactgaattatttgattttgaattaacagaagaagaaatgaaacaaatcgatcagttagatggtgtagtcggcaaagcaaaagacccagatactacccaattttaagtcgaaaggtgattttatggatccaatcgaacgcttgaattctctctcggaagaagttacccagacttttcattccgattttgtctttttgatcgatgcagagaaaatccaacattttcctgcaagaaactggacacatgatcaaatcatcgaagaactgaaaaaacggttcgatcattcgttaatggtcaaaccctggcacgaacatgaagtcatttattcacctgaactacctgtttttgccttgataccgaaaaaatagaaagaatggaacggattatgtatatatacataatccgttccattctttatttttctttcaaaaaacgggaaaatacgcaaatttttctgttgtaatttgcgtatacgcaagtttttttgcattactccttttcatttggctgtttttttcttataatcgaaagggtatgagcgaaggagagaacatatgaagaaaaaacagaaacaaaaattattaaatcaattccgtccttcattggatggtgtaagaggacaattattccgttctctagaagaagagagcttgcgacgttatggtttgccgttacaagtcatgcttgatcccaaaaaccgtcaaatcttaacgatcggattagctgggaaaacaaatgaagatacacggatcaacgtgccaatcgatgacaacttcaatactgtattaaagagaattcgttcaggagaaaacgggattttcgaacgattccgtgacaatcttcttattgaaatcgtgtcttactggaatgatcaacgattgaaaaacgatgaaccaactgcgcaagctgttgcgacaccagttacagaagaaacagtcagtgtgccagaagaaaaaacggaaaaaccaaaagcggacacaactgaaaatacacgctcaactgatacgaatgccgctttaagttttgctgatttttcaaaagccgttgctgagtatcctaaattttacacagaacaaaatgaacatgaagtagttattaatgaaaaaaatgctgatgaacctcgtaaattagcaactatttctatgactactgaaaatgagttcgttatcgaaaaagcactcgaacggaaatacaaagtcaaattgactttgattcctttgatcgaacaatttgcagcgacagcgattactgatcgataaaaattctatttgtcataaaaggctgggatttaaaatcccggcctttttagtcatataataatttctacagcaagtaaaaagaaattccttctaacatcaggctcaaatatcagcttgacctgtccaacaaatcacctatgatcctacaatgttaggcgacttctcttctacctgaagatatcttggagttgcctgatttcttaagatgcctaaccttaactataaaaaattctaataataaacatattttctgatagagaaaaaagcaagatctgcagtaaataaaataactgtaaatcttgctttattcttctaaagatattgcttttttatttttcccggattttttccaatatttgtatagctgtctgctggttcatcttttctgcttcacgtaattttttcgcaacttgctcgatttcctcaccaatagccccaattgagatcgctaatgaacgagcttgaagtcccatgtggcctttttggattccttctgtaactaatgcacgcaaagcagccaggttttgagctaaccctactgcagcaattacttgtgctagttccttggctgaatcaatatctaacatagctaaagatgcttttgcttttggcaggatattggaagctccgcctactgtggcaacagccaaaggcaccgttagttttccaactagtttatcccctttgatctgccagtccgttaatccttggtataatccatttcttgccgcgtaggcgtggatcgaagcgctaactgcacgtgtatcatttcctgtagctgccactacagcttctataccattcatgatccctttgttgtgcgttgctgcacggtaagggtcaagcttcgcatattcccctgcctgttggatttttttggcaatttgttcaccgatttctttgtttctccctaagcgttcgaatgggatttcacaacaggcagaagccaatgattctgtagcaaaattacttaaaatactgaatagaatctcttcttcagggaaccactcccgtaacttgtttgccacactctcaagaatcgagttgatcatgttagcgcccattgcatcttttacatccactaaaaaatcaatagataagtatgcatggaaactccccatgaattcccgagtagagatatcttgaacaccgcccccgcgtttcacgattgaaggataactttcatttgcacaaagaatcagctcttcttttcgatgattaactgcattgatcactgcttgatactccgattttcctgatagaacgatttgccctcgcatcagccgctgaggtgtttctgcgcagatatttccacagatttttgcaccattacttgcagctgcaatgacagatggttcctctgttgccatcggaatccattttttcttgccattgatttgaaaattctgcgcgatgcccattgggatttccacttcactcacttggttttcgatcatgtgatcggagagctcttcagaaagtgtttgttcctgaaaaatcaacgcagtttcttgtgtaaatacatttttttctattaattgactgcgccgttcagatggcgtaagctgataaaacttttttttttgcacatccttatgtgtttgctccatattcgcttctaacaagactgccaagcctaaacctccaccaatacataatgaagcaataccgtatctcttctgttcacgaagcaatccgtaagctaatgtagtcaagatacgtgcaccgcttgcaccaattggatggcctaatgcgattgctcctccatatatattgaccttttcttcatctaactgcagttcttggctaactacgatagaagaagctgcaaatgcttcattgatctcaaaaagatcgattgttgataaattcattcctgatctatctgtcaatttttgaatggctttgattggagcgattcccatgatacttgggtcaataccgacctccgctacttctttgatggttgctaaataaggcagattattattttctgcgtattctttggatgcaaggatcaccacagaggcaccgtcattcaacggggaagcatttcctgctgttacagttccttcttctgagaatactgtacgtaacgtgcccagtttttccaatgtactatttccacgaactgcttcatcctcagataacacgtcttcatcagaaatcttgactgggatgatttcctcagaaaatacaccggcttcgacagcatgtgctgctttcaactgggacgacaaggcatagcgatcctgctcttctctgctcacagaaaattgtgttgcaaccttctctgcggttaatcccatatgtgcatttgaaaatgcgtcagtcaatccgtcgttgaccatactggaaattggttcaccatattcatttgtttctgactgatactgtttcagcataggtgcttgagacatactctctgttccgccggctatcacaagttctgcttcacctagttggatcagctggcgtgctaagatcactgctttcataccagatccgcaaacttcattgatcgtcattgctgggacatctacagggagaccgctgttcaaagcaatctgtctggcaacattttgaccattaccagcttgcaggacatttccgaatattacttgatcgattttatcttttttcagttttgttttatctaataatcctttagtcacaagtgtgcctaattcaactgcagtaaatggacttaaacttccgcgatactttcctatcggcgttcttgcagcatctatcataacgacttctttcaagtaagccacctcctacaaaaatataccattctttgctgtaaaaacaaatagctcttgttccagttgtttttttctaagattaaattttaacaatccttaaatattctcttttttatatttcttttaatctttttatgataccttagtaaagtaagttttttatcataagtaaagaggtgttgaaatgaaaatagggattgatcgtctttccttttttattcctaatttatatttagatatgacagagttggcagaaagccgtggggatgatcctgcaaaataccatatagggattggtcaagaccaaatggcagtcaatcgtgcaaatgaagacatcattacactaggagcaaatgctgccagcaaaatcgtaacagaaaaagaccgtgagctaatcgacatggtcatcgtcggaacagaatccgggattgatcattcaaaagcgagtgcggtaattatccaccatttactgaaaatccaatcttttgctcgttcttttgaagtaaaagaggcttgctacggtggcaccgcagctttgcacatggcgaaagaatatgtcaaaaatcatccagaacgaaaagtactagtcatagcaagtgatattgctcgttacggcttggcaagcggtggtgaagtgacgcaaggtgtcggtgctgttgcgatgatgatcactcaaaacccgcgtattttatcgattgaagacgacagcgtatttctgacagaagatatctatgatttctggcgtccagattatagcgaatttcctgttattgatggtcctttatctaattctacgtatatcgaatcattccaaaaagtttggaatcgacataaagaattgtcgggtcgaggactcgaagattatcaggcgattgctttccatattccgtatactaagatgggaaaaaaggcattgcaaagcgtattagaccaaacagacgaagaaaatcaggaacgtcttatggctcgctatgaagaaagcatccgttacagccgacgaatcggtaatctttacactggttcattatacctggggctaacttctctactggaaaattcgaaatcactacagccaggagatcgcatcggtctattcagctacggttctggtgcagtaagtgaattttttacaggttatctggaagaaaactatcaagaatatctcttcgcacaatctcatcaagagatgctagattctcgaacacggatccctgttgacgaatatgaaacgattttcagtgagacgcttcctgaacacggagaatgtgcagaatatacttcagatgtacctttttcgattacaaagatcgaaaatgatattcgttactacaaaatataataaaatcataaaaagaacccttcacgagtcgtgaaaggttctttttttatctgcggaccaaaggagcagtctataggtcagcttagtcgtactaaggatttctcgtttttcactgaatagtttgcgaatgtacctagtcacaacaggatcttttgcgtacgcgtcatagtatagcttcatcaattcttcagtaattgattcctgtgtaaaataagtaaaatcttttttcttcactttgaatccttcatcaattaagtatgtttcaaattgatccattacaactggcgatgtattaggatcttcttctatcattcctagttgcttttcgataggataaaaaacatcatcgattgattccactactctgattatcacgcaccatttgcttgactttttcatcaatttttctaattgaataagatgtaccaatgctggatttgctgctgtaaaaaccatttcatatgtctcatttgattggataaattcttctaacgactgtttgataaaggaaacatttggcaactcatttttttctgcttctttttttgcattttctagcattcctgaagaaaaatcgatcaaatcatagcgattaatttcttttgctaaggaaagaaatctgccagatcctccagcaacgtctgctgctgtttcagcaggcaggactttctccgttttcagataattttttacatcttcagcaatagttacttgcgattcttgctggatttcataatattcttcagcaaattcatcccattctttttcattcatttgatttcctctaattttttgttatatgttttcgcttttcggaataaattattctcctcttttatctattctatctcttttgatgaataataaaatgattggctttccgtctatcataatacttttcagatagagtactaactaaattgactatacagagatgacaactaatattatgttaaaatttaatttgataagtgaacaccttccatcagttcgtaaatctgatttcttaaatcagtggccggcaatttgatgtttttgtcagattggatattactttccatgacgattgcatcttttgtgtcttttttcatcgccgctactgcatggaatcgattgatatttccctgagcaaggatataatcatttccactgtaaacaccgccgctgtaaggatgtttatcaccattattttgccacaatgagaaaagtagttcttttggtataatatcgccagacagaacactggtaaagaatttgttcaagtcataaacagacatacttatatttcctgtgcctaattcatttcggatgtctgtttcaggctcgaccaatgcttttgaataatcgtcagttgcagacatttggtaagatacagcatgctgaggggaattttttacattttcgtaaaaatctgtatgttctagatggagtggccgaatgatttctttttttaaaagagtttcataaggctgattcgttagtttgatcaatacccctgtaagcaatgtataatttaatggttcataatgatacgtatcataatcagtaaatttcaaatgatgaagggcaaactgaatgatctcactatctgacataggtttttttggagaagcggttcgatgaagaccagagcgcatgtaaagcatatttttgattgagatttgctgacttccaggaatctgaggataaaattcagatagctttgtgtcaaaagttatcttgccagattgaatttgttttaggataagtaaagcagtcatcgctttttggatcgaaccgatttgatagtaaagagaaggagaattcgattcttttatgcgtagatttgcgtacccatatcctttttctaatatcactcgattatttttgcgtacataaatcgaaccgatataatctgatttttgcagtaattgatcaattttgctggcaagcatctgctcattagatgttaaattggaagcaagttgtgcgggttccgttttataaatttgtggttgaggttgttttgttaattgccatcctgtaatgatgcctgttgaaaagaagctgacagccagcaacaaaactgcgagaaaagaaagagagatctgctgttttttttgatgttttccttttgccatgttaattcctttctatccatttttaactatttttcattgtaatcctcaaaaagagcatttgccacttacaattttgacataatatttggtaaaataattcacggcagtagaaatttcatgtataataaacagagttacgaagatgatagtaaggaggagttgttttgtcaggaaacaaacaacacccaagcaaagacaaaaaagaagccagtaaggcagctacagcagatataatcgacaagcggagaaatctgcgtaaaaaagaagataagatcgtgaggaagatcattttagtgatcgctcttacattattgattattggcggatttctcgggtttaccgtatatcgttatgtagatagcgggttgaagcctttagataaatcggacgaccaattagtccaagtggaaatcccaagcggctcttctaataagcagattggcgaaattttggagaaagacaatattattaaaagtgggattgttttcaattattatacaaaatttaaaaacttaactggctttcaagctggttattatcagttagcgcctaatatgactcttgatgagattggcaagcagttgcaagaaggcggcacatctgagccaacaaaagttgcagatgggaaaattgccattccagaaggctacgacatcgatcagattgctgagcgggtagcgaaggtaactggtaaagacaagaaagaatttttagatttagtaaatgatgagactttctttaacgagttgtatcaaaaattcccagaattgttggaaagtgcctctaaagctgagaacacaaaataccgtttggaaggctacttattcccagctacttatgattactacacgagtacttcgcttaaggatcttgtgattgagatggtgaacaagacaaatacggtcatgcaaaactattattcagctatcaaacagaaaaatttgactgtacaagaagttttaactttggcttctctagttgaaaaagaaggcgtaaaagaaaatgatcgtaaaaatattgcacaagtcttctttaaccgaatcaaggcaaatatgccacttcagtcagatatctctgttttatatgcattaggagaacataaagaattggtgacgtatgaagatacagctgtagattcaccatacaatttgtataccaataccggctatgggcctggtccttttgacaatccaagcgaagaggcaatcaaggcagtattagaaccagcagaaaatgactattattatttcgtagcagatacgagcactggaaatgtttatttcgctaaaacgtatgaagaacatatggaactagtgcaaaaatatgtaaataattcttagaaaaacaggggctagtcattgatcatttttagaaaaacatttacattttaagaaaagcgtggtaatcttttttggactatattcctcaaaagattaccttttgcggtattttatcgaaaaaaggagacgttacacatggtagagaaagtttatccaatgactctagaaggtaaagaaaaattagaaaaagaattagaagaactaaaaacagttaaacgcggagaaatcattgaacgaatcaaaatcgctcgcggtttcggagatctttccgaaaactccgaatacgaatcagctaaagatgaacaagcatttgttgaaggaagaatcacaacaattgaaaatatgatccgttttgcacaaatcatcgataatgacggcgtagatgcagatgaggtatcgatcggtaaaacagttacgttcatcgagttgcctgatggagatgaagaagagtacacgattgtcggaagtgctgaagcagacccgttttctggaaagatttccaatgattctcctatcgcgcaagcattgattggcaaacgtaaaaatgatgaagtaaccattgctacaccaggtggcgatatgttagttaaaatcgtcaaagtagaacaagcgtagtctgactgaaagatctagagagttcatcttactgatgacgcactctagatcttttctctttgagtattgcaggtttcactgaacgatcttacatctaaagtcctatagccaacagtcaaaaaaataggtatgatgaaatgagaatgtgtcaggagggagaaaaagcgatgaatagttcttggcgtttttttgtggtagtcgaagcactgctgctgttatttgctgtttggcaaatcgtaaacaatactggacttttgcttttagtaatattcggtattttcaatatatatctagctatgcgcaaatatcctcgtactaaatttcaaaattttcaattgatcttagggagcttggtcattttttttagcttagtcaacagtcctgctttatggatgatggttgtattggccgttttatttattgggctgaaaggtgtagagatttcaggaatagatttgacaaaaaatgctttttggcgaaaaaaacagatcatgatggtccaaacagagcaattaaaaacacataataatgagcgtaaaagacagcaattatttggtaaccaacgtattggaaacgacgtctatgaatgggatgatatcaacattgccatcatttctggtgatactatcatcgatttgggtaatacacttttgccaaaagatgataatattgtgattgtaagaaaagggataggcagaacacggatcttagtacccctgggagtggctattcgtttagagcatgcgacattagtaggaaatgtcttgtttgaagaagagcagttttccttaaaaaacgaacagatcaaaatctgcagcagtgattatgatgaaaatcctcgcagattgaagatcattaccaataccttggttggagatgtcgaggtgatacgaatatgatgggaagaatatccaaagcaatgctagctgtttattcggggattgcggctttccttattattctattttcacttttcacttatttttatgccagtaaccaaagtcattggtggggagaattgctgcgtgcgcgtttattatacgttccgcttatcttccatttgatggcaatttcattaggtgtaggattgatcgtatttctattgttatcacttattcaaaaggcaaaatacgggaaaatcgaagaaaagcttcgtgcactttcttctggcaattatgaatccaaacttttgcatcagccgatcccaagcgcgtcggatgatctgtacatcaaagatattgatatggaaattactaaaataaaagaaaaaatgatcgaagtatccagtgaattacagattatgactagccgtcctcaatatgtagatggacaaaccaaagaagagattttagaattagaaaggcatcgattagctcgtgagcttcatgattcagtttcacagcaattatttgcagcgatgatgatgatgtcggcattgacggagcaagcagaaaaaagtgagacaccagaaatgttccgtaagcagttgaaaatggtggcagagatcatcaacgcttcccagtctgagatgcgtgcgctgcttcttcatctgcgtccagtcaatttagaagaaaaaagtttaaaacaaggcattgagcagttattgaaggaattgcagaataaaatccagatttcgctaaaatgggatgtagaagatgtaaaattaactagttccattgaggatcacttgttccgaatcgttcaagaattgttatcaaacacattaagacatgctaaggctaatgaattagaagtctatttgcataaaatagataacaatcttttattacgtatcattgacgacgggacaggatttaatatgaatgaaaccaaaacgggaagttatggattgaacaatatcaaagaacgagtagctggtattggtggaacagtaaaaatcattagttttaaagggcaaggtacgagcgtggagatcaaggtccctttgatgaaggaggcatagataaagatgataaaagttttattagtagatgaccatgaaatggtacgcttaggcgtctcttcttatttatctatccaagaagacattgaagtgattggagaagctgaaaatggacgtcaaggctatgaaaaggcgatggcacttcgaccagatgtcattttaatggatctagtcatggaagaaatggatggcatcgaatcaacaaaagcaatcttaaaagattggccaaaagccaaaatcattatcgtcacaagttttattgatgatgaaaaagtttatcctgcaattgaagcaggagcagcaggatatttattgaagacgtctaccgcacatgaaatagctgatgctataagggctacgcaacgcggcgagcgagtattggaacctgaagtgacaacaaaaatgatggaaaaaatgagtcggcgaaatgatccagtattgcatgaagaattaacgaatcgagaaaatgaaattttgatgctgatttctgaagggaaaagtaatcaggaaatcgcggatgaattgtttatcacactgaaaacagttaaaacgcatgtgtcgaatatattagctaagttagaggtagaagaccgaactcaagcagctatctatgcgtttaaacatggtttggtgaaataaaaacgatgataaagaggataatcaaaagctgagaaaataactattatttttcttggcttttttacaataatgatgcttgcttttgtttttggaaaggctttgttatactgagaaaagaagatactaaaggaggaaaatggtgaaacaaaattttgcaattgtaggccttggacgatttggcggaagcatctgccgtacactgatcgaagctggacaagaagtactggctattgacagtaatgaagatcgagtcaatgaatatatgaatatagccactcatgctgttgtggcaaatgcacaggatgagatgacacttcgttcattaggtataagaaatttcgatcatgtaattgtcgctattggagaagatatccaagccagcatcttagttactctgatggtaaaggaaatgggcgtaccgaatattttagcaaaagcccaaaatgagtaccatgcccgtgtactagagaagatcggagcagatcgtgtcgtacaccctgagcgagacatggggatacggattgcacataacttagtatcaaagaatattctagactacttagagctgtcagataaatattctttagcagaaatccgagtctccaatcctaaatttttcaacaaaacattagctgaattaaatttcaggcaacgttttgacttaacagtagtcgccatacgaagagtagatcaaacggttatcgcttctcctgcagcagatgaatatgttcgtgaaaatgataatctactggttattggagagacaggcgatgtggatattctagacgataagatgaatcaatagaaagaaaagagaaagtaggttgttgggatgaaattaacggtaacgccaaaagcacaaaagtggtttgactcagaaattgatctgccagaaacttacggaatacgtttttttggaaaagtctacggcaaaacagaggttcatgatggtttttcgattggaatgtcagttgaacagccagaacatcctgtaaagaaagtggaaatggatgggacacttttttttatcgaggaagcagatgaatggttctttaaaggatatgatttacttgttgattatgatcccaacctggaggagccaacctatcactttaaaaaacaataaaaaaagagagggtgacacaatttttgtcaccttctcttttttcttttgaaaatattgttttcagctattaatatcctgcagacaattttacttgattggtttgaagctcatgggtggcaaagtagcttttcagattggttaaaaaaatagccattaatttcttttgaaaatcaggtgtcaaacctgcaatgtgggaagtaatcagtacattgtccattttccaaagaggatgatcttgtggaagaggctcttcctcaaaaacgtctaatgctgcaaaggaaagttgctggttatttaaagcctgcaccagatcttgtgtcttaacagaagcaccacggccaacattgatgaatacagattttggatcaaagtgttcaaacatatgctgatcaaagagcccagttgtttcctccgttagaggtaagatattgactacgaaatctacttcaggaagaacttcctttagttgatttaaagaaaaagtctcaaggggtagctgatcaacaccagctgagatagattggacccatttcaaggtagaagaggctaatagtttttcttggtagtctgagttccagcccaaactgatctctacattttgtagatcctctggttgtaattctgttttaaagatataaccaggcgctatagtatggatttcttcgataaattcatcacgaaatggacgatctgcataaatgattctttctgacatagttaatttcccgcctttctttactctaagtgtagcgcatacaagaagaactttgaagcgccttgcttgttttttgagaaagaaatatttttcaaataaaaaaggggctgtgacaaaaaaaatgtcacaacctctaaaagggtctattgaagtagaaataacgagttgtctttatttcttaattgatcgatatttttgcccatcctttgacagcttgagcaaaaataaagattcctgcaaaagcaatgaaggcgctagtgtcaaaagaaggaagaaagaccatcaagattgttgcaattatagtaggcaatgaaattgaatagatcaatgtttttaaacaatcaagaaaagtagcttttgttagtcgaaagcgtgcatagagaaaagcagcaatgttggtaaatagcaaagtgatcagcagattcagaaaactaggataaatagaaaatataaatgtcaggacttttatccaaagtggtatagatgattcacttaaaaaagaacggagctgcttacctgttaagttttttaaagattcattggtgtagggaagttctaattggttattgttcaacaaagcagaagtcgtgcctgtattaggaagagctatgataagtttgttttttaacatcccgacactaacaaaattccccatcaaatcagtagagatgtcctgttctgttcgttttccctctggatcaaatgtgaagataatggagtttgtttggtaaatgaatccttctttttcttcggtttgaagctgcccgttttggatggtaaaatcaggaatgcgagtagcaatcttttgcccatccaattgaatgttgtttaagacttgaaaaacttgaaaagagattggcaaagccataaatatactcaaaactaaaagatagacaatggctttccaaaatgggacatttctcgcctcctttaggtctttgaatcgtataaaggaactgataattaattgttttgttgtcataagtactcctcatctagtagtgtcatcacttgcaattctagcgaagtatcaagtgaaatacaagtgctttagggaaacagctgaatgattggtgaaatatcaaaaaaatgttattcttgtctaaagactatccaatataaataaaatggaggaaggaatagtgcctacacagccacagagatcatcaaaaaaactatttggagtagtggttttgaatgcggtgatcactttatcagaatttattggagggattatgtcagggagtttgtctcttgtttcagatgctttccataaccttagtgatacattggcaattattttttcttacggggcacaaaaaatggcccgaaaagaagcaaataaaaaacgtacgtatggctaccagcgtttagaaatattgagtgctttcatcaactcattcatattgatcatattatccttatttttaaccgttgaagcattcaagcggttcacttcaccagaaaagataaatagtcatttgatgctaacagtagcagttattggattgctcgcgaatttgttctcagtattattattacgacaagaagcagatgaaagtttgaatataaaatctagttatttgcatttgttaagtgatacactgtcttcggtaagtgtgattatcggagcaattttgatccgttttttcgatatctactggatcgatccagttattacactgatcatttcgatatatatattgatagaagcgataatggtgatcaaaaaagctgccgctattttgatacaaagtgcacctgctatcgactatgaaaaaatggaacaagaaattgaagcaatcgatggggtaaaggatgttcatcatgtccatatttggcagtatagcgaaaagataattattttcgacggacatattgattttgaagatcagctactaagcgagattgaaaagatatatcctcgtataatttctttattaaaattaaaatatggtattacacatgtgacgatccaagcagagacaaaggcaaaggatcaaaaaaaattaatttttttaaataaagatgaaagttattgaaatatagagtatgataaataagaatttttaataaggtaggttggctcatgaagcagtatcgacagttaaaaggatatttagaagcaaaaggatattgggagatactagtctatctcttttttggtggtttggctacgattgtaaattttgttagttttgctctcgcacgccaatattttgatttaagtatggccttatccaattctatttcgtggttttgttctgtattgtttgcttttgtaacgaacaaactttgggtattccattcaaaatcaccgaattttacacatgcacttattgaatgcggtaagttcttcttctaccgtatcctttcttacggattggacatgggggcaatggtattgttgatcaatgttatgaacagcaatgagtatgtggcgaaaatcatcactcaaattattgttatccttgcgaactatattttcagcaagttgtttatttttaaagaaactgaggtttttgaagaagaagtaggtcaaagtgaaaaagacgactaggcataacaattgaagaatttccttctctttgttactctttgtaatgtagacattattaagaaaacattgaggaggaatttttttatgacttacacattaccagatctaccttatgcatatgacgcattggaaccttatattgacgaagaaacgatgcatctgcatcatgataagcatcacaatacttatgtgacgaatttaaatgcagcaattgagaaatacccagaattaggcgaaaaaacaatagaagaattattatctgatatggacgctattccaacagatatcaagacagctgtacgtaacaatggtggcggacatgctaaccattcatttttctgggaaatcatggcaccaaatgctggtggcgaacctacaggagaaataaaagaagcgattaatgaagcttttggtgatttttcttcttttaaagaagaattcaaaaaagcagccgctggacgatttggttctggatgggcttggcttgtaatggaaaatggaaaattagctattacctctactgcaaatcaagattctccattgatggaaggaaagacaccaattctaggtttggacgtttgggaacatgcttattatttgaaatataaaaatgtccgaccagattatattgcagcattctggaatgttattaattgggatgaagtaaacaaacgtttcgaagcagcaaaataaccatttcctccgtcatatcagtcttaaaaataatttggaaaataaaagagcgaaagcttgctagcgttttctaaattgggtataatgttcttgcaaggttacttgcaagaacttttttggaggctatacatttatggaacacggaacggttaaatggttcaacaatgaaaaaggatttgggtttattacagtagacggcggagatgacgtatttgttcatttctcagcaattcaaggagacggcttcaagagcctagaagaaggtcaagaagtagaattcacgattgttgaaggtgcacgcggacctcaagctgctgaagtgactaaattataataatttgttgaataaagacacgacttcttagagagtcgtgtctttttgtctatttatgaagtttttagattttttggctaagtaaatgcatttgttcacttgacatgtcctaactaattatcaagcaaggaacattttcttcgttagtaatggattttaaagaaatttcagtttttggatgttgaataaaagaccatttgtgaaaccactagtatacatactcattaccatgtcaattctattactttaaaagaaaatcgttttactttgaagaggagcatatctacccattaaaagatgatggtaatgcaatcactagttcgagtcattttaagagccatgcagtgagctggaaataaaacgaatagaagatgggtttaacaaaagaaccagtcataggaagaaattttcgtgaaatcgaatgataatctgaacggtaggcaaagactgttaaaaagatgggaaaggtatgtgcgatcattttactgcacgattatttggaaaataccttgttgttcgctttttctggaaaaaatacataaaaaaagataaaacgattgcgaactgcgtgtattcggtctttcgatctttttcacggtatggtatgatagttaagaattttgagaaattttaaaaaataataatcgttacacaaaaatgttttttaaagttttcttatgattaaaaagtgaatttgctgattgaacagttatatgagacaatattttagaaaatgtgaaacagaggtgtattatgaagcgatggcaaaaagttctattaaccttgttaggggtattcgttttgctgattgccggattatcagcatacggaatcagatttatgggagaagcgagccaaacagtaaacaaaatttctaaaaactctaatcgaatatcctccaaacgttctgagagagtaagcattgatgacaaagaacctttttcggttttgctattaggtttagataccggtggattaggaagaacggaacaaggacgttctgatacgatgatggtagtaacagttaatccgaaacaaaaaaaatcaacgatcatcagtttggaccgagatatttatacgaatatcgtaggttatggaacggtagataaattaaatcatgcctatgcatttggtggtgtcgaaatggccatggattcaattgagcaactgctcgatattcctattgatcattatgtaacgatcaatttggatggcatggaagatttgatcaatgcggtcggtggcatcaaagtgaataataaaattgactttactttggatggtgtccatgtaccagtaggtgaacaaacattgaatggagaaaaaggtttagcctattctcgaatgcgacacgaagatccagaaggcgatatcggtcgacaacgtcgtcagcgggaagtagtgacgaaaatcgtcaataaagttttaagtttagatggcgtaagcaattatagaaaaattttaaaagcagttgagaacaatgtgacgacggacttagattgggatgacatgcttgatgtagcgacgaactacaccccggcgtttgaaacaatcaaacaagaccagttgcaaggcgaaggacaaatgatcaatgatatctactatcaaattttaggaaaaaatgatcttctttcgatccaaaatgaactgaagaaacaattaaatataaaaacaagcgatacattacctaatttgaaaaatgagaatgcttcaatgatgttctttgatgattcggaagatggcgattcgacaaacggtgatggatcgaatagtgaagggtacaccgattattcttcctattcagaaaacacatatgatcagtaccaagatccgaatacctattatcagcaaacagaagatacaagtcagtactatacaccaagtcaagatactcaaagttatgatccttacgctggacaggaacaaaatggttatggttatgaccagaataatgagtatggaacaacaagtgggtactagaaaaaaatagtttggttaataaagagtgccacctaagttagattttttgtctaatttaggtggcactttttctatgtgttaaattacaggacgtctctttttagcgcttagtttaaaaaataaattgaataattcaatagagttgcgaatagtacccataaataataaggaatcatgagccacattgccaggcgatgatgcagccacaactgatacataagcactgacaagaaaataactaaaagtgtaatatcgattgctgcaatgaaaatatttcttaaattaaaaaatagagcagaccatataaaattaaaaatgaactgaatcacaaaaagaccgacaagattgtttcgctgttttttgttgttgtgattaagtaacaaataaagagaaatacccatcaatatatacagtaaggtccacatcggcccaaatatccagctaggtggtgcaaatggtggaagttgcaaagaatagtaatattctccgggatttccgctaagcaaccctgataaaaagcctaatatgacaattcctataacacaaacccaaaaacgaatatcttttatcatcttcattttactaactcctttctataatattagtttaccatgaaggctcacagcaagacctgtatttagtttgtgaagtaagaaaaaaattgatgattgttgttattaaaaagttgaacatttgtttatatgaatgatgtttttgaaaaagatcatatgatttgattctcatgttttctatttgtacttttctcgtctacttctgttataatctgcatcttacttttttcaccttttttacttcaacataaaattataaaagcataatgtttgtgttaatacaataaagcgtttacaatgtggttatcaaatgaaggaggtttctacatgaaaaagattagtacgttattgtttattgggttagttagtttagggttgttcggttttagcattccaggttttgcgcatggttatattacttctccaggaagccgtgcatacctaggaacatcagcagcaggaaacttaaatcaaaatgtcggaagagcacaatgggaaccgcaaagtatcgaagctaccaaaaatacattcattgatggaaaaattgctagtgcaggagtcagcggctttgagcctttagatgaacagacatctaacagatggcataaaaacatggttaatccaggaacattaaatattacttggaatttaacagcacaacatcggacaagtacttgggattactacattaccaaaccaacttggaatcctaatcaacctttgaaatttagtgattttgaattgatcacaaaaatagacgacaaagcaactgttccaccaaaaacagtcaaccaaacgatcacacttccgcaggatcgaaaaggatataatgtgattttagcagtatggaatatcagcgatacgacaaatgcattttatcaagtgatagacgtgaatatccaataataatcaaaaagggctgtgacaaaaactatgtcacaaccctttttttaaataaatagtgtcctcctgttaactcttcggtcacaagtacagtattcataaaacatgaagagctatttttgtttggctgttcttattacttgatacagggcagactttttcacaacctctttcatttagtcagcgagtctcgtcatcttcacgacaacttcacaacgtgcagtctgaggaaacatgtcgacagactgtaaatattcaatcttgaactttttacttaaattaaccagatctctggcaagtgtagaaacattacaggagatataaacaagtttttttggagggtatttcaataatgattggatcaatgcgttatccaaacccgtacgtggtggatctacgatgataccatcaggctgaaaaccttcattcaaccatttaggcagaacttgctctgctgtcccaacttcatatcgagtgttgtgatatcctaatctttccgcatttttttttgcatcagcgattgcttgaggaacggtatccattccccgtacttctttggcttgttttgctacacttaagccgatcgtcccaactccgcaataagcatccacgatcgtttcattaggctggacatctaatgctttgattccttcgccataaagcaattcggtctgctgaggattgagttgaaagaaggcacgaggagaaagatcgaaagtcacttcattgatttgttcttcaatggcttcttttccccataagtggatcgtttcatcccccatcacgagagacgttttttgtgcctggacattttgcatgattgaaacaacttcgggcagtcgttcattgatctcacggatcattgcgtttttttgcgggaattttttactgcgagtaataaaaacaacttgtaactccccagttttaacaccgattctaaccatgattgtgcggaagattccactgtttgtccgttcatcatagatgggtgcatcaaatttattcaatagttgaacaacagtattcattactttttgtgttcgaggttcttgaaccaagcagtctgttatagggactaactgatgagagtttgcttcgtataaaccagcttcaattttttgagtctgcttattttttcgtaactgaaattgtgctttgtttctataatgccaaggctcatccatcccgatcgtcggcaaaagttgataagatcgaaagcctgctggtttgaatttttccaatgcttgcaaaagcagatcctttttaaaatccaattgagcttgataagctaagtgttgtaattgacagccaccgcattcatagtaaacaggacatggtgccactacgcgatctttgcttgtttttttgacttttattaattctccttctgcatagcgaggagttgctttcgtgattttcactagtacttcttcttttggtagtgcatatggaacaaatatgatcaaccgtttgaaataaccgattccttcaccatttatgcctaaacgcttgattttcaaaggaaccgtttgtccagttttgacaattgtttctgccataagtatctccctttttcttttttctgtggtttattctaacatataatacctgattacggggattttctgtggtatgatagagaatatatgttcgaggaggatgtttatgttaaccgttacgagaatcagtaaaggcaaaggccctttctatcgcgtagatttatctgaaggagaagctttacaagtatctgaagatgtattagtacgctatcgattattaaaaggacgggaattagacgaagaaactatccaagagatcaagaagagtagcggagctgatttcggttttcacctagcaatgaattacttaagttatcagttgcgatcggaaaaagaaatccgaacatacttaaaagaaaaggaaatccttcaagaagatcgaaataaaatcgtagcccgcttaaaagaattggaccttgtcgatgatttggtctatggggaaagttatgtgcgcacgaatatgcgcttaagtgacaaaggaccaaagaaattagcgcagcagatgcagcaaaaaggtttgaaacctgaaatcattgaacaagcgctcagccaatatacatttgaagaccaagttcaaaatgcacatcagacagccgaaaaagcgtttggaaaaaatcacggaaaaagccaaaaagaattattgagaaaaatccaacaaacattgatgacgaaaggcttttctcaagaagtgatccaacaagcgatagctgatcttccgcaagaagcagatcaagaaatagaatatgattatttagtcaaacaaggagataaactatggcgaagaaatttaaggtttgaacctaaaaaaagaaatctaaaagtaaagcaaagcttatatcaaaaaggatttgatttggatatgatccagcgattcattacggaaaaggaagaggaaagtgaataaagaatgggaaaaatggacagataaagaaacaaaagaatttcaagatcagttcattcaatggtatgaacaagaaaaaagaaacctgccttggcgctataatcgtgatccttatcgtatctggatctctgagatcatgcttcagcaaaccagagtagacacagtgatcgattatttttatcgtttcatggaatggtttcctacaattgaagagctagcaaatgctccagaagaaaagcttttaaaagcatgggagggccttggttattactcaagagcccggaacatccaagctgctgctaaacagatcatgtcagaatttgatggggaaatgccgcaaacgcctgaagaaattagctcattgaagggaataggaccatatacgacaggcgcgattgcaagtatcgcatttggacttccagaacccgcagttgacggcaacgtgatgcgagtagtcagcagattgttttgcattgaagcagacatcgcaaaagcttctagcaggaaaatctttgatgaagcgatgcggaaaatcattgatgaaaagcatccaggtgaattcaaccaagcaatgatggatctaggttcagctatctgtacaccaacttctccaaagtgtgagacttgtccgatccaagccttttgtttagctaacaaacgaggaatccaaacgagttttcctgtaaaaacaaaaaaagcaaagccaaaagacgtttattatatcagtgcggctcttcaaaatcattctggagcgtattattttgaagaaagagatagccaaaaattgctggcgaatatgtggacatttccaatgatggaagtgacacaagaggagtatgagcgattgaaaaaagaatgggaaacaaagccagaaatcgatctgtttgatgacctagtagcagaggaagagcaaaatctcccatttgaaaagcaggaactctttgtttggcagacacgacatttaggagaagttactcatatttttagtcatctgaaatggcatgttctccttttttacggacgggcaaccgagggagcagaacaagaatttaccgagaacaaaacttcgaagtggttgaagcctgatgcatttgattcggtcgtttttcctaaggtccaaatgaaactggtagatcagttagagaaaaatcgaaacaataggaatcctttctaggcaaagctcatttttattgatataataattatgatgtcggtgtaatgaacacccaaacacaaagcacaaaatgctgcttaaggaagggttgctatgggagttccaaaagaaggagagtttgtgacgatccaaagttacaagcacgacggcaaattgcatcgaacgtggcgagataccatggtattaaaaacaagcgaacactctatgattggcgtgaatgatcacacattagtcactgaatctgatggacgccgatgggtaacgcgcgaaccagcgattgtttattttcataaaaaatactggttcaatgtaatagcaatgatcagagaaaagggggtttcctattattgtaatctagcttcaccttttttgctggacgatgaggccttgaaatatatcgactatgacttggatatcaaggtatttcctgacggcgagaaacgactattggatgtcgatgaatatgagatgcacagcaaaatgatgaattatccgaacgatattgacttcatcctaaaagaaaatgtgaagattctggttgactggatcaataatggagatggcccgttctcggaaggctatattgatatttggtataaccgttacaagcaattgtctcgtaagtaaacacaaaaaagaacagtaagccagtgagagatttttctcaaaagcttgctgttttttgcttttttcgaaataaatttttataaagtctttttcatataaatatgaggcatgccagcatcttcaaaaggatcgccgtaagctgtatatcctagtttttcgtaaaaagtttcagctgtggactgtgcccctaataaaatcgtattatagccttgattcttagcaaagttttctgcttcttcaatcaatatttttcctaacccttggtgtctgtattcagaaagaatcgccatccgctgtaatttcatttttccgttttctaaaggcaaaagacgtacagttccttgcggttcttttttatctgagtacaggacgaagtggatacaatgggcttcatctttgtctatttctcgagacaaaggcacaccctgttcgactacaaaaacttgatgcctgatccgtacagcatctaagtaaatattgctcattgtatcttttgtttgtacaactttcatggtctagccaccttcctttcgtatagtatactggaaaataaaacaaataaaaagtatggcaagttttcaaaaataaaaaaagaataaaagaatttttaacgaatataatatatactagtaagaaagaaaggaggaaatctattgtttgaaaaacttagacagtctaaactaatgttttggtcgcttgaattattgatcatagctgcattgatcatgatttcatcagaaataaactttattttcgaaccgatcgggacatttttttccacgttatttgcacctgtactgattgcaggctttctttactatttattgaatcctattgtcaagctgttgatgaaagcaaaaatcaaaagaatatgggctgtcgcaattgtgctgctccttttagttgcagcaattatttggattttacttagtgtcatcccaagtctagtacagcaaatttcctcattggcatctaatatgcctgatttcatcaaacaggtagaaagctggttaaaagaggtagccgaattgcctttgttcaaggaagtagatatcaataaatattttgagcaattagacatttcttacgggacaatcattcagcaattccttagtggagtatccaatagtttaggttcgatcgttggaacgatcgcttcggcaaccgtagtaatcattacagcaccattcatcttgttctatatgttgaaagacggagaaaaactagtgccaaacatccaacagtttttcccagaaaaaagaagaaaccaaattgtggagttattggggcaactgaataaaacattggctaattacattagcggacaagcaatcgaatgtttattcgttggtaccttcacatttttaggatatatggtaattggtgtggattatgctttcttatttggggtcattgcgggattgacaaacctaattccatatttaggaccttatctaggactagcacctgcatttctagtaacagtcttcaatgatccggtaaaagcattactttgttgtgtggttgtgctaatcgtccaacagttggatgggaatatcatttatcctaatgtaattgggaaatcactgaaaatccatccattaacgatcattatcgttcttctagtagctggaaatattgccggattgcttggtatcttcttaggtgttcctttttacgcaatctgcaagacgatcatttcctatataatcaaaatcgtcaaagaagacaagcaaaatgaaaacaagaagaaaattgctacgacctcgtaggtagttttagtacacttgtttttattgcaaagaaaattgctttgtgataccattttaacgtggctatagtgccacgtttttttctatcgtaaactaaaaattaattttataaggagagaatgcgattatgaatgctgaccctgagagtcagtcgctgttagcgcagattttattattgatcgttttgacattgatcaatgcttttttagcagcttccgaaattgctgttgtttcgatcaataagaatcgaatcgagcaaaaagctgatgaaggagatgtgaaatctcaaaagcttttaaaaatattgcagaatccaaataatttcctatcgacaatccaagtaggaatcactttggtcaacattttgtctggtgcttcactagctaatactttatcggaacggttagctccggtattaggtggcggcacagcggcaaaaaatattgcaaatatcattgtgctggctattttgacctatgtatcgattgtttttggagaattgtaccctaaacgtattgctttaaataaatcagaagaagtcgcaaagttcacttcagggctgatacgcttgattggtgtagtagctaagcccttcgtctggctgctttctgcttccacaagtttattggcgcgtatcacgccgatgacttttgatgatgaagattcaaaaatgaccagagatgaaatgcgttatatgcttgaaaacgaaggcgtattgaataatgaagaattagaaatgctccaaggggttttttctcttgatacgaaggttgcccgagaagtcatggtcccacgaacggatgcatttatgattgatatcaacgacactgtggaagaaaatgtgaatgaagttttatccgaaaactattcaagaatccctgtttataacgaagacaaagataaagtagtcggaatccttcatacaaagaatttactaaaagctgcccataaattcggctttgataatttagatatcaagaaaatcatgcaggagcctttattcgttcctgaaacggtctttattgatgatctgttatatgaaatgaaaaagacgcagaatcagatggctattttattagatgaatatggcggtgtcgttgggttagcaacactagaagaccttttagaagaaatcgtcggagaaatcgatgatgaatcagatgaagttgagaatctttatgaaaaaatcgatgaacacgaatatatcatccaaggacgtatgctgattgatgagttcaatgaagcttttgacagcgatctgcatatgagtgatgtagatacgatggctggttatttgattacagcattaggcatgattccggatgaaggcgaaaagttatcgtttgatgtcgataatattacgctggtttctgaagaaatggaaggttctcgaatccttaaaatccgtgtcatttttcatgatccggaagaaacagaagcggaacctgaagaagaacgaagatacttcagaaaagaattcgaagatgacgagccaagaagataattggaaacttggttatgaaagacgtgttgcttgaataaacaagcaacacgtcttttcttttagtcagctgacaaaaaaatatttgactcttatggtttggtggctttttcattcgctgaatccatgctatactgattcagttgtagtagttgacaaaggttgtgaaaaagctatcctgcattaagtaataagagcagccaagcaaaaacagcttttcgtatttttggcttgggtgggcttattgctgataggctgtctctagaacgccgtttactcggaaaaagagactgctacacggcttttgtcacagccctatatgaaattgtctttctttaagagatcggacaatctgtgcctagagaaaatataaataattgaatggaagaaatggagttaggttatgaataatccagaattaaagcaacaagtggacaatcgcagaacttttgcgatcatttcccatccggatgctgggaaaacaacgattacagaacaattactattgtttggtggggctatccgtcaagccgggaccgtaaaaggcaaaaaaacaggtaattttgccaaatcagactggatggaaatcgagaaacaacgtgggatttctgttactagttctgttatgcagtttgattatcaagggaaacgagtaaatatcttggatacaccaggacatgaagatttttctgaagatacttatcgtactttgatggccgtggatagtgcggtcatggtaatcgatagtgcaaaagggatcgaagcacagacaaagaaattattccaagttgtaaaaaaacgtggcatcccgatatttacttttatcaacaaactagatcgtgatggtcgtgaaccattggaattgttagaagaattagaagagctattagatatcgaatcttatccgatgaattggccaatcggtatgggtaaagggctagaaggtctttatgatatctaccataatcgtgtagagttttatcgtccggaaaattatcaggatgaacgattagtagaattggatgaagatggactgcttcccgaaaatcatcctctaactgaaaattccttatatgaacaagtcttagaagaagtagaactaatcaaagaggctggagatgcatttaatcaagaaaaaattgctcgtggcgatcagacaccagtattttttggttctgcattgactaacttcggtgtacagacttttttagagactttcgttgaattggcaccagctccttatggacacaaaacacaagatgatcagatggtaagtccttatgaggaagaattttcaggtttcgtattcaagatccaagcaaatatgaatccagcccatcgtgaccgaatcgcttttgtccgaatctgttctggaacattcgaacgaggaatggatgtctggttggaacgtacaaataaaaaactgaaattaagcaatgtcacacaatttatggcagattcgagagaaaacgtcgaaaaagcagtagcaggcgatatcatcggtgtatatgatacaggcaattatcagattggggatacattgttcgaaggaaaactaaaagttgcttatgaagaactcccttcatttactccagagctgtttatgaaagtgactgcaaaaaatgtcatgaaacaaaaatccttccacaaaggaatctatcaattagttcaagaaggagcgattcagctttataaaacatatctaacggaagaatatatcattggagctgttggtcagctacaattcgaagtattccaatatcgtatgttaaatgagtataacgccgaagtaatcatgtctccaatgggacacaaaatcgctcgctggatcgatccagaagatttggatgagaagatgagttcaagtcgcaatatcttggctcgtgaccgtttcgaccaaccattgttcttattcgagaaccaatttgcagaacgctggtttgcggataaatatcctaatgtaaaattaaaaagtttgatgtaaagaagtcttgacacaagctgccctgcatcaagtaataagaatagccaaacaaaaacagcctctcatattttgtttagagccgtgacggattttccgtgacggctctttttactatattaaaatcatagaaatgtctaatcaaaaaaatataaaaattattttgcgtacatatgattaaagaaaggagagtgtgacacatggaaacagaatggcaaagacgtgaaagaaaaaaacagaaaaaagaagagatgttacgattatgtcgattattagatgtaaaagactgggacaaaaacgagcaaattgcacaaaaagtacgatcaatcatccataaagaggaaaaagttaaaaataaagacacgcgtagaactgaaaatgaaaagagaaaagtacaaaagaaaagagaaaaatcaaaaagctagaaagaaaaagaggctgagacagaagcgtttaactccaagaaataagctggaattcacaaaaatttgaaaagcaattttcgtgaattttagcttatttccgaaggagttgcttctgcttccgccgtttatacgtgtttagagcgtgagacaaaagtgttctttacttttgtcccacgctctttaattattatgttcaaaatttgtttacacggctaatgtagcgcctaattcatgttttggaatcgagatttcaacaaggcctgccaattcgattactttgatttcatcctcgtggtaaacggcgtctttgattttatctaagaaataatttttagcatcttcgatttctttcggctggattttacgtttgtcattgatcagcagaatttcattatgttcaggggcttcagtgtagacaatagtggtatttccggctgtgtagaccttgactagatgggcatcagtgttttcaagctggtttaatacaagacgggaatggctgtttgttacatttaccaatttcatggcgctcacctcttttatgtatttttaattgcttgtttctcttattataatttcttttttataaaatgaacagtattttgacttttctgaaaaaagaatgagacggcatttctcaaagaaataccgtctcacgctataaaactggatttattcagccgtttcttcggctgattctttagccaaacgttctggtttagaagtaacgatgatttttccatctttatccagttttgctttcaactcatggatagaagggtgatcaagataaaattcagcgataccatcttcgatttgttcttggatcgtgcgtcgaagaggacgagcacccatagatggatcatagcctaagtcaactaatttttctttgacattcgtaggaacttcgatgtgaagttgctgtgctgccagcatttggttgacatcgtctagcattagtgtgacgattgtcatcaagttttcttttgataatgcactgaattcgatgatcccgtcaaaacggttcagaaattctggtgtaaagtagttgtttaattggttcaatacagaacgagtaacaccttcgcgtgccgcaccaaaaccaacgtttgcttctactttaccagttccggcattacttgtcataatgatgatcgtatctttaaagctgaccgttcttccttgtgcatctgtcaatcgaccatcatctaagatttgcaagaacatatgcaaaacatctggatgagctttttctacttcatctaacaagacaagactgtaaggatttctccgtactttttctgttaattgaccagcttcttcgtatccgacataacctggaggagaaccaatcaatttagagacactatgtttttccatatattcagacatatcgaaacgaatcattgaatcttgtgaaccgaatagttcgtaggcaagttgtttcgcaagctctgttttacctacaccagttggtccaacaaataagaaggagccgattggacgattctgtttgtttaatccaacacggtttcggcgaatcgctttcgctactcgatctacagcgttatcttgtccgatgacatgagctttcaagtcatctgctaagtttttcagttgtgtctgttctttttcttttaattcacccactggaatacctgtccgttgttcaacgattttttccatatctttttcggtaatcacaggtgtttcctcttcagtgagctgacgttctttcattttttgaagtttattgatctgatcgcgataataagctgctttttcgaaatcttcttctcgagaagctaaaactttttgttcttctgcttcttgcagttttttctcgattgttttaggatcaacgatttggatcgtcaagtttttcttagaacctgtttcatctagcaaatcgatggctttatccggcaagaagcgatcttggacgtaacgattggataaagttgcggctgcttcgatggcctcatcagtatattttacatgatgatagtcttcataacgtttttgcaaacctttcaaaatactgatcgtttcttcgacagttggttcatctacccgtacaggttgcatacgacgttctaaagcagcgtctttttcgatgatgcggtactcatttaaggtagtagcaccaaccatttgcaattctcctcgagctaaagctggttttaaaatattaccagcatccatatttccatcaccagcagaaccagcaccgacgatttcgtgaacttcatctatgaataggatcacattttctgcttgacggatctcttcaatcaatttttgcatacgttcttcaaattgtcctcgtataccagtaccttggactaaagatacgacatctaaacgaatgacttctttgtccattaatttttgcggtacatcaccatctacgattttttgtgctaaaccttcaacaactgctgttttaccaacacctggttctccaatcaagacaggattgttcttggttcggcgatttaaaatttcaatgactcgtttgatttcgtcatcgcgtccgatcacaggatcgatatcaccttgtcgtgcttgttctgtgatattgattccgtattctcccaataaaccttctgtattgccttgaggtggctgaccaccattgaagttgttgtttccgccaaattgtgttggtggtgtttgctcataatttccttgctgttgcatttggcgagacatggaccggaaaagatcgtccaaactgccaaatccaaatggatcattttgggccatattagtcagacctccattttgttgatttttgattttttgataacagctctgacagtaatcgagttgtgtccgctgaccattgacagtggcatacaagtgaatcgttgcctcattcttgccgcagttttgacaaagcatgaatcattcacgtcctttcacaaaaatgggtacatccatattttacatctcgtttttcatgaggtaaaagaataacccctagttttttaagagatttatgaggtagaaaaggtgaaatctctattgaccattcctgacctttgactcttattatactaaaaataaaaagggaagcaagtaattcgtttcatatgaaaacaaagagggtcaaaggaaagaatgataaacgtcaggagaagagaaagcgacaagaaaaagaaaataaacacgtttgttataaaatgtgaagaaaaggatgaaaaagaatccggaataatttgaatacttttatctgaaattgaatgaaaactgttgtatctaacgaaaaaaaatgttaatctttacagatgaaagggtggcatttgttaggattctctgaattactaaaaaagaaaaccctcacataaaaacaacactcacttaaaggagaccgattaatatggaaaagaaagaatttcacgtagtagcagaaactgggatccacgctcgtccagctacactattagtacaaacagcaagcaaatttaactctgatgtaaacttagagtataaaggtaaatcagtaaacttgaaatcaatcatgggcgttatgtctttaggtgtaggtcaaggttctgatgttactattactgcagaaggtgctgacgaagctgatgcaatggcagcaatcgttgaaacaatgaagaaagaaggcttatctgaataatggttgaaatgctaaaagggattgccgctagtgacggtgtagccgttgcaaaagcttacctgctagttcaaccggatttaacattcagtaaggcaacagtagaagatactgcggctgaagaagctcgtttggatgctgcattagctaaatctactgaagaattgcagcaaattcgtgaaaaagcagcgcaaagcttaggtgaagcagaagcgcaagtatttgatgcccatttgatggttctttcagatccagaaatggtaggtcaaatcaagcaaaatattaaagacaacagcgtaaatgctgaatcagcgctaaaagaagtaacggatatgtatatcggtatgttcgaagcaatggaagataatgcttatatgcaagagcgtgctgcagatattcgtgacgttgctaaacgtattttagcgcacttattaggcgttactttaccaaatccatcaatgatcaacgaagaagtggtcgttgttgcacatgacttgactccaagtgatacagcacaattagatcgcaattttgtaaaagcgtttgtaacagacattggtggacgtacttcacattctgctatcatggcacgttctttagaaattccagcaatcgttgggacaaaagaaattactgctaaagtcaaagaaggcgatattttggctgtcaacgggatcgaaggcgatgtaatcatcgatcctacagatgaacaaaaagctgaatttgaaaaagcaggtgcagattacgcagcacaaaaagcagaatgggaaaaattaaaaaatgcagaaactgtcacagctgacggcaagcattttgaattagctgcaaacatcggaacaccaaaagatctagttggtgtccataataatggtggagaagcagttggtctgtaccgtactgaattcttgtatatggattctccagacttcccaacagaagatgaccaatatgaagcttacaaagctgtattagaaggtatggaaggaaaacctgtagttgttcgtacaatggacatcggtggagataaagaactaccatatctgcaattacctcatgaaatgaatccattcttaggatatcgtgcattgcgtatcagtttatctgaacaaggcgacgaaatgttccgtacacaaatgcgtgcattgcttcgtgcatctgttcatggtaatttacgtatcatgttccctatggtagctacactcaaagaattccgcgcagcaaaagcgatctttgaagaagaaaaacaaaaattgatcagtgaaggcaaggaagtatctgatacgatccaagtcggcatcatgatcgagattccagcagcagcagtcttagcagacaagtttgcaaaagaagtagatttcttctctgtaggtacgaacgatttgattcaatacacaatggcagcagaccgtatgaacgaacgcgtttcttacttgtaccaaccatataacccatcaattttacgtttgatcaaaaatgtaattgatgcagcacacgctgaaggaaaatgggcaggtatgtgtggagaaatggctggagatcaaacagctgttccattgctagtaggtatgggtctagatgagttctcaatgagtgcgacatctattcttaaaacgcgtagtttaatgaaacgcttggacacagcgaaaatggctgaacttgctgatcgtgcattgaaagaatgcgatacgatggaagaagtcgttgaacttgttcatgaatatgtaaaataaacaacgtatcaaaagctggtgtggcttgtaaaagagctacgccagtttttttgttcttttttaagaaaacgtttttgtcagtaagaatagataaaaatagggcttaagtttgagtgacagtttgtaggctatgttatactatataagtgaagggggacgtaaggtgaaggtattattatattttgaaagtgaaaagatgcttgcaaaatctggaatcgggcgtgcgcttgatcatcaaaaacgtgctctgacggaagtcggtatctcttatacactagatgaaaaagaagattatgacatcctgcacatcaatacatacggaatcaatagtcataatatggtcaataaagccagaagagaaggaaaaaaagttgtctatcatgcgcattctacagaggaagatttccgaaattcctttatcggatcgaaccagctttctcctatcgtaaaaaaatatctggtaggattgtaccaaaaagcggactatctgatcacgccaacaccttattcaaaacagttgttggaaagctatggtatccgtgtgccgattcaagctatttccaatgggatcgacttagagaaatatcgccctgatccaatgaaagaacaaaagttcagagaatatttcaaactgtctccggatcaaaaagtaatcatttgtgtcggtttgtttttcgaacgtaaaggaatcattgatttcgtagaaattgctaagaagatgcccgaatacacatttatttggtttggtcatgttcccatgtactcgattcctcggaacatccggaaaattgtaaaagaagatcatcctgaaaatgtcctgtttcctggttacattcgtggagagatcatagaaggtgcgtattcaggtgcagatctattctttttcccttcttatgaagagacagaagggatcgttgttttagaagctttagcaagcaaacaaaacgtacttgttcgagatattccagtgtataatggctggttagaagatagcaagaactgctatatggggaagacaaacgaagaatttatccgactgatccaacagattaccaatcaagaactaccgagtacgacacaagccggttatcaaacagcaaaagagcgaagtatcaataaaatcggtgaagaacttaaaaatgtatacgaaagtgtactgaatgaaaaagtctctagcaaattaaaaaaagtaaatcagatcaaggactagtttggaggcgaaaaacatgaaaatcggcttttttaccgatacctactttccgcaagtcagcggagttgctacatcgatcaaaacattaaaacaagaattagaaagacatgggcatgaagtctatatttttacaacgaccgatcctaatgcggataagttggaaaaagatgtgattcgaatgccaagtgtaccatttatttctttcaaggatcgaagagttgttgttagaggcatgtggtatgcttatttggttgccaaagaactagaactagatcttattcatacccatacagaattcggagcagggatacttgggaagatggtagctaagaagttgaaaatacctctgatccatacttaccatacgatgtatgaagactaccttcattatatcggtaaaggaaaagtgatcaggcaatcccatgtaaaatacttgtctagattatttgcaaatcatacgacaggtgtagtttgtccaagtgaacgtgttattgatacattacgcagctatggtgtaatagcaccgcttcgcgtgattcctactggtatcgacattgaaaaattcaaacgttctgatatcactcagcaggatatcagcaaattaagggagtcactaggtcttcaggaaaaccatttgatgattctttctttaagcaggatttcttatgagaaaaatatccaagccttgattaatgggtttcctcaggtcatctccgcttatcctaacgccagattagttatcgtaggaaaaggaccttatgtagaagagttagaggaattgatctcagaactgcagttagaagaatttgtgcagttcacaggagaagtggacaacaatgatgtagcactttattataaagcggcagattattttgtcagtgcttctacttcagaaacacaagggcttacttatacagaagcgatggcagccggaacaccttgtgtcgtggaaggaaatgcttatttgaaccgattgttcgatcatccttcattagggaaaacttttgaaaccgacgaagactttgcaccagcacttattgattatatttccagtgaagttcctaaagatccaaaagttttagaagctaaactttatgatatttcatctacacatttcggcgaagctatgatcgaattttatcaagacatggttgtttatcatgaagaagagatgcgaagaaaagaagaagaagactcgattgaacgaatcaaaataaaattaaattcatttaaaagataaaattcaaacattttttatgaaaaaatccttgtttctagcgtatactagcatagaagcaaggatttttgatttttaggaggtcgaaaaaatgaaacttggttttatcggaacaggcgtcatgggaagtgctgtcgcacgccatctactagaagcaggacacgaagtagctgtctataatcggacaaaagcaaaagctgatcctttagtaacagaaggagctatctgggcagatacaccaaaagcggtagcagaacaaagtaatattctctttacaatggtaggttaccccaaagatgtagaagaaatctactatggacagtcggggattttttctgcagatatctcaggacatattttagttgacttgactacaagtacaccaagcctggcagaaaaaattgcaaaaacagcaaaagaaaaaggcgcagatgcgttagatgcaccggtatccggtggtgacttaggagcaaagaatggtacactgacgatcatggtcggtggagaagaagccgtttatgatcaagtactgcctttattcaaagaatttggtacgacatttacattgcatggttctgctgggaaaggtcagcatacaaaaatggctaatcagatcatgattgcaggtacgatgacaggaatgacggaaatgcttgtctatgcacaaaaaaacggacttgatttaaagaaagtgattgagacgctttcaggtggaagtgcagctaactggtctttaagcaattattctcctcgtattttaaaagaagattacacacctggtttttttgtcaaacattttatcaaagatttaaagattgcattagaagaagcagaaaaaatggaccttgtattgccagcaactacccaagcattgaaactatatgaagagttggcagataaaggttttgagaatgacggaacccaagctttgatcaaactttggtggcctgaaggaaaaataccagaaaaaaaatcataaaaaacgagtttttttagagaaaatcaatgcaagtaggctatgcttttgatacaatataacagaaataagaaaaggaggacctccgatgacacattcacaattagtcgcaatcataaaacgactggaggctatggtcgagtcagcagataatgaactgcaagttcgccgttttgaaaaagaaggcgtagagaagtgtacagtaacttatgataaagcgaccgatacatttgaattaactgaaacagatactcatcagcaatacgaatttgataatatcgatatcgtagcgatggaaatctatgacttaatccaataaattttaggataattgacatttgaagttgaagatgcctaaaagaagccgagaagcaactaatttagttgcttttcagcttcttttttgtttaacagttcaatttcagactgttctttttctaattttttgcggtaactgatcaagatttgtacaggatcgatttcttcttttgacaattgacgtttcaaagataaatgagcttctttcttttcataatagaagtcaggagaaacgtcagcagaggcaatcattgtttctgcaagttgaccataacaaacgaggtagtgctttttctgactctcatctgctgctaatggcatgctgaatgtgagggatggtgttcttaaaaactgcttttgttcctggatccgtctaataaaataagtaactaattcgatatctttttgaagcataccggctttttcgaaattcaactgatagatgaaatgttgttgtctttttttcaagtaagtcagtagctttttatttcggccttgaaacagcccttggagttccttttttttctgttcaaaagtcatttcctgtaggtcaggaagctggactcgcaaagctaacaaactaatttcagacaaccaaggcatttgataagtttcttccattatacgcaaaatagacggcatttttttatagagacgaaaaggcccgtatgttcgagccgtaggagtatctgttaatacaaatcccttattggtaatatgtacataattataattactgaaataattcatttgtcggttataaaaaggacggtaatgttggatcaattgacactcgagcaataaagcatctaattccgtgtctactacgacgaaatcaaaatctgttatatgatgaatcatacgtaatactttttttgaatgctgtttattctgatgaaaatagctgcttactctatttttgagccgttttgctttaccaacatagatgaccttaccatctcggtctttcataagatagacacccggcagcatggggagagttttcattttttcttttaacataggatctccttttacgctttgaataaaaagactataacaaattttgaaataatggacaagttttaaggaattctatagttctgttcacagaaaatactttgataatcaaaatatgtgagatagatgatttttctaataaaagaaattataaatgctgatttatcagttgttttaaatgagtaaaatcttaaaaaaagctcatatagtaaaaaaatgatcttttaaggttgcattttgaaaaaagttaagatatagtttgaacatcaaaagatttgataatcaaactaattagtggacggtggaacatggaaccagatttaaaaacagtaaatgattatcttgttagtgtcttcaatgatattttgacaatcgaagagtctgagctgaaaaaatctcaattcaaagatctgtcaatcacagagatgcacacgatcgaggcaatcgggatgtacaagaaaaaaacaacttcagaagtagccaaagaactatcaattactgttgggaccttgaccactgctattaacaagttagtaaaaaaaggctatgtcgaacgtatccgcagtgaagatgaccgccgcgttgtaaagttgggactaacgaaaaaaggaaagttactatttcgggtccatcagcattttcatcgtgaaatggtcaagaacatcttagacggaatggctacggaggaacagcatgccttgctggatgcactgaaaaacttgcacgacttcttgcaagactataagtgaggatatttaatggaacaatttggaatgattactgcaacagccagcgtccttcctgaaaagattattactaataatgatctttccaagatgatggatacctctgatgaatggatttcgacaaggacgggtattcgtgaacgaagatgtgtaacaaatcaggagacttctgatttatgcattttagtggcggaaaaattgataaaacagaaaaatctaaaccctaaagatttggattttattttagtagcaacaatgtcgcccgattacacgacaccatctgtagcagcacaagtacaagggaaattgggagcaactcatgctatcgcttttgatatcagtgctgcgtgctcaggatttgtttatgcgttaagcatggctgaaaaaatgatccgctgcggctcaactaagggactggtgattggtggtgaaacactatctaagctaatcgattggtctgatcgtacgactgctgtgttgtttggcgatggagcaggtgggattctcttagaagcgaatccacagaaaaaattgctgaaagaaaaattagcagctgacggtaccagaagtagttcattgaccgctggctaccagcaaaataaaaatccgttctattcagaagattcagaaggttcgtattatttgcaaatgactggcagagatatttttgattttgccgtacgagacgttgcaaacaatatccaagaagtcatgaaagacaaaccagttgattatctgcttttgcatcaggcaaacctcagaattattgagaaaattgcccgaaaagtaaagatgccgcaagaaaagttcctgaccaatatggataaatatgggaatacatctgctgcaagcatccctatcttattggatgaagcagtttctagtggaaagatcaccttgggaaaacagcagaaagtaatatttacaggctatggcggaggtttaacatggggaagtattctcatggagttgtagactgttaaattataaaaataaaaagcaaacaatatcggaggaatatattattatggtattcgaaaaaattcaagaaatcatcgcagaagaattaggaaaagaaactgaagaaatcaaattgactactgacatccaagaagacttagaagctgacagcttggatttattccaaatcatcaatgaaattgaagatgaatttgacgtgaaaatcgaaacagaagacggaatcaaaacggttcaagatttagtgacttacgtagaaaaacaaactgcataatcattaaaattaggttgggggctgggacatttcctgaaataggaatgtctcggcctttttgaataggaagaatcaaacatatattctggatatattggagaaaaacatgaaaacagcattcttatttagtggccaaggtgcacaatatcaaggtatgggaaaagatttatatgaagaagccgttgtaaagcagacatttgatgaagcaagtgagattctcggctacgatatggctgaactttgctttacagaaaatgaacgtttggatcagacacaatatacacagccagctattctaacagtcagcatcgcgtattatcgcttattgaaggagcatggaatcatcccagatgcagctttaggactgagtttaggagaatattcggcattagtagctagtaatgcgctatccttcactgaagcagttgcgttagtagcaaaaagaggcgcttatatgacagaagctgccccagctggaagcgggaaaatggttgcagtgatgaatgcgccgattgaaacgatcgaggaaagctgtcatgaagctagcaagtacggcatcgtatctcctgcaaattataatacacctcagcagatcgtgattggtggcgaagaaaaagcagtagacgaagctgttttactattaaaagaaaaagggttcaaaagaatgatccctctaaatgtcagcgggccttttcatacagctattttagaaccggcagcaaaaaaactggcgaaggacctaagtcagattcaattctctgaaccttcttttcctatcataagcaacacaacaacggaaataatgaagaaagaaacaatcgcgggactacttgaacagcaagtcatgcaacctgttcgtttctatgagagtatccataagttaaaaacaatcggcatcgaacaagtcatcgaagtcggccccggaaaagtattaagcggatttatgaaaaaaatcgataaaacaataccagttctgcgtgttgagaataagcagacatttgatgaaacaatagcaatactataaggaggaacgttatggatgtaaaaggaaaaaatgtatttatcacaggtagtacaagaggaatcggcaaagcgatggccttagcttttgcaaaagctggagcaaatatcattttgaatggtcgcggagagattccaaaagaaaagatagaagaaatcgaagcattcggtgtaaaatgcgtaggagtttccggtgacatctctgattatgagaaagcgggacaaatgatcaaagaagcagaagaaaagcttggatcgatccatgtgttagtaaacaatgccggaatcacaaatgacaaacttgtgatgcgaatggatgcagaagatttcaaaaaatgtcttgatatcaatttgattggaaccttcaatatgacgcagcacgtattgaaaaaaatgatgaagcagcgagaaggggccatcattaatctctctagtgtatctgggttgattggaaatattggtcaagcaaattatgcagctagtaaagctggcgtagtaggattaacaaaatctgtggcacgagaagctgcaactagaggcattacatgtaatgccattgcgccaggattcatcacaactgatatgacggaagttttagcagacaaagtcaaggaacaagcggaaaagcaaattccgatgcagcgtttcggacaagtagaagatattgcacaaacagcagttttcttagcacaaaatccatatatcaccggacaagtcatcaatgtcgatggcggattggtcatgcacggataagaaaaggagagcaaacaaatgaatcgagtggtaattactggctatggagtcacttcacctattggaaatgacgcagacagctttttgaatagcttaaaagaggggacgaatggcatcgcaccgatcactaaatttgatgcttcagaaacagggattaccttagcaggtgaagtcaaagatttcccttacgataaatattttattaaaaaagatagcaaacgaatggatatgttttcgatctatggaatctacgctgctttagaagcaatggagatgagcggtttagataaagaaaaaatgaatcaagaccggtttggcgtcatcatcggatctggaatcggtggtcttccaacaatcgaaaaccaagttattcgtctacatgaaaaaggtgcaaaacgagtttctccaatgttcgtaccaatggcgattgccaacatggcagctggaaatattgctttgcgcgtaggtgcaaaaggtatttgtacagctatcgtaacagcttgtgctagcggaacgaattcaattggggaagcattccgtaacatcaaacatggctattctgatgtcattcttgctggaggaacagaagcaacgatttgtgagatggggattgctggatttgcagctttaacagcactctcagaatcaactgatcctaatcgtggttcgattccgtttgacgaaaatcggaatggttttgtgatgggtgaaggagcaggcgttctagttcttgaatctttagaacatgcacaagctcgcggtgccaaaatctatggagaaatcgttggatacggtgcaaactgtgacgcttaccatatgacagctcctactccagatggttctggtgcatctaaagcaatgaagcttgcgatggaagaagctggtgtacagccggaacaagtcggatatatcaatgctcacggaacaagtacaccagccaatgaccaggcagaagcaaaagcaatccaaatcgcattaggtgaaaatttcagagatacttacgtcagcagcacgaaatcgatgactggacatttattgggagcagccggcgggatcgaagccttggcaactttgctggcattagaacatcaatttatcccacctacgatcaatgtagaaaaacaagatcctgagattgacttgacagttgtcaaaaacgaaagcaaacctgcaagttttacttatgcaatgagtaattcattagggtttggcggacataatgcggttctgtgcatgaaacgctgggaggaataattttggatatcaatgaaatcagagaattagtcagtcaatttgatcaatcctcgctaacggaattcgatttgcgtgaaggtcaatttgaattgtatatgaataaaaataaaacaagtcgaggcatgaatatggttcaaacaaacgaaacgttgccagtttcggagccagtcaatgtcatacctgaacaagcaacaactgctccagaaacaatgaaagaaaaagaatcggcagtatttgatggaatcgaggttgtttcgccaatcgtgggaatcgtttatctgcaaccggcgcccgacaaaccagctttcaaaaaagtaggtgatcaagttgccaaaggagaagttatctgcattattgaagcgatgaaactgatgaatgagataactagtgaggccgacggagtgatcacagaaatccttgtagaaaacgagtcagttgtcgaatatggacagccactctttaggattcagcaaaaataagcaaagcaggaaagagggaaatcaatgaacatacaagaaataaaagaaatcattccacatcgttatccaatgcttttgattgatcgagtggaagaaatggttgaaggagaacggatcgttgctaagaaaaatgtaacgatcaatgagcccttttttcaaggacattttccagaagaacctgttatgccaggggtattgattgttgaagcaatggctcaagcaggagcagttgcattactttctcttgaacaattcaagggaaagacggcttatttcggcggattggacaaagcaaaattccgtaagaaagttacaccgggagataccttataccttgaagttgagatattgaaagtgaaagcttcagccggaataggcaaaggaatcgctaaagtagacggtaaaaaagtagccgaagcggaattaacctttatgattggataggtgaaatatgttttctaaagtattgatagctaaccgcggtgaaatcgctgtacgtatcattcgtgcatgccgcgaactagggatccaaaccgtagcgatatattcagaagcagatgccgaagcacttcatacacagttagcagatgaagcaatctgcattggcccggcaaaagccgttgattcatatctgaatgttcaggaagtactgagcgctgcaatcgtgacaaaagccgaagcaattcatccaggatttggttttttatctgaaaatagccgatttgcctccatgtgtgaagagtgcaatatcacatttattggtcctaaaagtgcaacgatcgatgcaatgggaaataagatcaatgcgcgtcaattgatgcaagaagcaaatgtcccagtcattccaggaagtactggtgtattatctacagtagaagaagcattggaaatagcagacagaattggttatccagtgatgctgaaagcagctgcaggtggtggcgggaaaggcattcggaaagttcaatcaaaagaagagctcccacagcatttttcttcagctcagcaagaagcagcagcggcatttggaaatgatgatatgtatttggaaaaaatcatttatcctgctcgccatatagaagttcagattttaggtgatcattttggcaatgtcattcatttaggagaacgagattgttctttgcaacgtaataatcaaaaagtactggaagaatctccttctgtagtgatctcacaaacaaaaagagaagcactaggagacgctgctgttcgagcagctaaagcagtcaattatgaaaatgccggaacgatcgagtttctgatggatgaagaaggcgatttttatttcatggaaatgaatactcgaatccaagtggaacatccagtaacagaaatggtcacaggaatcgatttagtaaaaaaacaggtggagatagcagccggtgagcctttgaatgtgtgtcaagaagaagtagtattccaaggacacgcaatcgaatgccggattaatgcagaaaatcctgctttccattttgctccttctccagggaagatccaaaacttactgcttccagcaggtgggatgggactgcgagtagacagtgcagtttacccgggatatacgatcccgccatattatgattcaatgattgcaaaaataatcgtccatggaaatacgcgttttgaagcattaatgaagatgcagcgagccttaagtgaatttatcacagaaggaatcatcacgaacgcagaatttcagatggatttgattagtcatcctgcagtcatagcaggtgattacagcacagcatttttacaagaagaatttttaccgaattggacaccagaaacggagataggaggcgcatagatggctctgtttaagaaaaagaaatatattcggatcaatcctaatagagagagcaaacctgctaactcgccatctgttcctgataacatgtgggcaaagtgtccaaattgcaaacatatcctttatacgaaagacatcggtgaagaaaaagtatgccctcattgcggatacgcttttcgaatcggtgcatggcagcgtctagctttgattattgatgaaaaaagttttgaagaatgggatacggatcttgtaaccaaagatccgctagcatttcccgaatatacggaaaaaattaaaaaaatgcaagataaaacaggacttcatgaagcagtcctcactggtaaagcaaccattcaggggattcccttcattattggagtgatggatcctaattttatcatgggaagtatgggaacgattgtcggagaaaagatcaccagattattcgaacgagcaacaaaggaaagtcttccagtcgtcttgttcacagcttcaggtggcgcacggatgcaagaaggaatcttttctctaatgcagatggcaaaaatctctgctgctgtcaaacggcatagcaatgaaggtcttttttatctaactgttttaacggacccgacgaccggaggagtaactgccagttttgcaatggaaggcgatatcattctagcagaaccccaaagcttgatcggttttgctggaagacgcgtcatcgaacagacgatcaagcaggaacttccagaagatttccaaaaggctgaattcttattatctcatggttttgtcgatcagattgttccccgcatggaattgaagcagaaaatccatacgcttcttgaattgcatacacagaaaggatggatagatcgtggataagacagcacatgatgtcgttcagttagcaagagctaaagaacgatggacaagcttggatttttttgaagagatcttcgattctttcgaggaatgccatggtgatcgtttgtttgcagatgacgaagcgattgttggtggaatcgctcgattagatggcaaaccggtaacagtgatcggtattcaaaaaggacgggatctgcaggaaaatatccgcagaaattttggttctccccatcctgaaggctatcgaaaagctttacgactgatgaaacaagcggaaaagttcaatagaccggtgattaccttgatcaatacagcaggtgcatattgcggtgtaggagcagaagagcgcggcgaaggagaggctattgccagaaatctgctcgaaatgtctgatttaaaggtaccgatcatcgccatcatcattggtgaaggtggaagtggcggtgcccttgctctaggtttagcggatgaagtctggatgctggaagaaacgatttatgctgtgctttctccagaaggatttgcgtcgattttgtggaaagacggtagtcgcgccgcagaagcagctgagttgatgaaaattactgcgccagaactacgcgagttaggaatcgttgatcgagttattcctgaaacgttcaacggcgagcagttgccacgatataaagtcgcacacattatgaaaaaagcgttgattgaaagattgacggaacttgttcgattcgaccagcatgaattactggaaaaacgatacaagaggttccgccaatattaggtgtttaacaactaagcaaagagtaaagaatggttcttgctcgcttagttgttttttgtttctaaatttttctgtgatcaatctttatttttggtcattttgtaaagaaatgctttttctgaaagacgaacgagtatagaggtagttttttttgctgatatgcagtataatacggggttgaggagtactttatgtgctccttcattttttgcagatgaggagacagcatgttttcaaattacaaaccaacatggatggtagaagccatctatcagattacacctgcccaattaaagaatctaggcatcaaagcagtattgaccgatttagacaatacgttgattgcatggaataatccagatggaacagaagagttgcttacttggattttagaaatgaaaaatgcaggaatccctgttgttgttgtttcaaacaataattcaaaacgtgtcgcgcgagcgattgaaaaatttgatcttttgtatgttgcacgagcaatgaaacctttagcaagagggatcaacatagcaaagaaacaattggatttagcagatgatgagatagtaatggtaggcgatcagattatgactgatatacgtggagccaatcgtgcagggatacgtagcatccttgtaaaacccattatcgcaacagatagttggaagacacaatttaatcgtttttgggaaaaaagaattatggcctatctattagcaaaacaccctgatatgggctggcgaggtggaatcgaatgacagaagaattacaatgtatcggctgtggtgccgttatacaaacaaacaaacccggtgaattaggatacacgccgcaaacggctttggaaaaaggtttagcttccggggaagtctattgtcagcgttgtttcagattacgccattataatgagatccaagatgtctcattgacggatgacgactttttgcgcttactgaatgaattagggcaaaaagatgcattgatcgtcaatgtggtggatatttttgacttcaatggttcactaatcccaggactacaccgttttgtcggtgacaatccagtacttttagttgggaacaaagtggatatattacctaaatcattgaaaaaaactaaattaacacaatggatgaaggaacgtgcttacgaagcaggaattcgtccagtagatgtattattaactagtgctaagaaatctcatgagatgacggaactattagaaaaaatcgaagaataccgcgatggacgggatgtctatatcgtcggagtaacaaatgtcggaaaatcgacgcttatcaatcaaatcatcaaaaatacagcgggagtacaagatgtaatcacaacttcgcagtttccaggaacgaccttggataaaatcgagattcctttagatgacgggcattttttgattgatacaccgggaattatccatcgccatcaaatggcgcactacttaggtaaaaaagatttgcggatcattgcaccgttaaaagaaatcaaacctaaagtttatcagctgaatgaagggcaaacacttttcttgggcggacttgcaagatttgattttatcagcggcaatcgtgcttcatttattgcttatgtgtcaaatgatgtaaatattcatcgaacgaaactggaaaaagcagacgaattttatcaaaaacatgtaggtggattattacagcctcctcgtcctgatgaagtcgaggcatttccggagcttgttcgttttgagttttctgtgaaagaaaaaacagacatcgtttttgccggtctaggctggatcactgtaacagcgccagcagtaattgcgggctgggcgccaaagggtgtagatgtattgaaacgcaaagcattgatttaaggaagaaggaaaattatgagtttaagaggaaaacaaaagcgttttttacgtagcaaagcgcatcatcttcagccgatttttcaaatcggaaaaggtgggatcaattcagcaatgatcgttcaaattgaagaagctttagaaaaaagagaactgatcaaagtatcgttacttcaaaatacagatgagattgcagaagaagcagctcaagtattagaaaaagaaatagattgcgaaatcgtccaaatcattggacgtgttattgtattatacaaaccttccacaaaagaaaagtatcaaaggctatcaaaagaagtaaaagcaatataaggagtgaccatgatgaatacgcaagctaagacatttgttcgttcacaattatttcctgaagaaatgcctcaattcttagagaagaaaaagcaagtagggatcttgggcggaacattcaatcccgttcaccttgcacatttagtgatggctgaacaagctggccggaatttaggtcttgaccgcgtatttttgatgccttcttatcagccacctcatgttgatgagaaacagacgattgatgcaaaacatcgactcaacatgttggaattagctgtggaagacaatccttttttgcagattgaaacgattgaattagctcgtggtgggaaaagttacacctatgatactatgaaggaattgacgcaaaacaatccggatacagattattactttattatcggtggggatatggtagaatatttgccaaaatggtataaaatcgatgagctgacttctatggtcaactttgtgggtatacgtcgaccaggatacacaacggatactccatatcctgtaatttgggtagatgtacctgagatcgacatcagttccacgaaaatacgtcaaaagatcaaagaaggctgttctatccgctaccttgttccagataaagtaattgattatattcaaaatgaagggttgtatgaatatggactatagtaatgaatatactgcttattctagagaaaacctgatgcaaaaaatacagatgagaatgagcgaacaacgcttcaagcatgtgcttggagtagaagaaacagccgtggctcttgccaaaaaatacggtgcttctcctgaaaaagctagtattgctgcattgacacatgattatgcaaaagaacgaccagatgaggagttcaaaatggtaatcgtaagagacggttttgatccagagttattgaattataataatgcaatctggcatggtcttgttggcgcttcgtttgtagagcgggaattaggaatcaccgatgcagagattcttcatgcaatccgggtgcatacgactggggctgctaagatgagtctccttgacaaaatcatttatgtagcagactatattgaaccaggtcgagattttcctggggtacaagatgcacgagccattgcatgggctgatctagacgaagctgtagcatttgaaacaaaacatacattggcccatttgcttgcgcaagaacaacagatttatccaaaaacaatcgaaacatataattactgggtagcaaaaaaataagctgctcatattaggaggaaatcatcatagatagtaaagaacaattaaaaattgcggttgaagcagcagattcaaaacgggcagaagacattatcgctttagacgttcgaaatgtttccttgttggcagattatttcatgatctgttcagcaaatagcgaacgtcaaatcaacgcaattacagaagaaatcattgataaagaagaagaaaacaaatatgaagtaaaacgtattgaaggaaaagaaggcggaaaatgggtattgatcgatcttggagatgtgatcgtacatgttttccatgcgccagaacgaagtttctataatctggaaaaactatggtcagatgctccgctagtcgatcttagtgaatggttggattaacatatggcttatgaaacatttgctttcatttacgatgaagtgatggacgaaacactttatcagcaatggctagctttttcgaaacgtcatttacaagaagacacaaaaaatattttggaactggcatgcggtactggagcattagcggttgcctttgcaaaagatggatataaagtgacagggttagacctttcagaagagatgttgatgattgccagccagcgagcatatgaagaagacgcatcgatccaatttgtggaaggtaatatgctcgatttatcagaaatcggacaatatcaggcaattacctgtttttctgattcgctgtgctatatgaaaaatagacaagaggtacagcaagtgtttgatgaagtctatcaagcgttagaagaaaatggccgatttttatttgacgtacactccacctatcaagtagatgaagtttttccagaatatagctatcattatcaaggggataattttgcttttttgtgggatagttatccaggaagcgagaaacacagcatcgaacattttcttacctttttcgttgaagaacaagaagggtctggtcgatttattcgtgaagatgaactacatcaagagcgtacctatccattggaaagttatctaagaatgctggaaaacagcggcttttcgaaagtcgaagcattttctgattttacagacgaagcagcatcagagaaatcaaagcgctggttctttgtagcatacaaagactagcggttttgcctgctcgagttaacaagaaaagaataaatcttcaacataaattatatatccgaacgatataggcattgctcttgcagtgcagcttttcgtcgcagaagtattgtgtttgcgagaatagtttatatagttcgggtattttttccgatttttgcctttttttacttgtctctatttcttttttatcgataactatgaaggaggatgcgcatgaaaagctgcgggattatcgtagagtacaatccttttcacaatggacatcgctatcatgtggaaatggcacgaaaaacaacaggagcagaggtcgtcattgctgtaatgagcgggaattttttgcaacgaggcgaaccggctatcatcgataaatggcatcgcgcgaatgaagctttacaaaatggtgtggatttagtagtggagcttcccgtcgaatgggcggttcagtcagctgactattttgctaaaggtgcagtaaaaatcttgcaaacactggactgtgacagtttgtgttttggaacagaagaagagacttcgtttgattacagcagtttcggacgctttgtccaagagaatcaagataggatagaagaggcatttcaagaactgtctgatcaaacgtatagttatccgcaaaaaatgactgaggtttttcgcagtctgtatcccgatattacgcttgatttttcttcgccaaatcatatcttgggattaagttatgcaaaggaaaatgccaagtatgtccaccctatggaattacatccgatccgacgtaaaagtgcaggctatcatgaaaaaatcatcacagatcagaggatagccagtgcaacagccattcgccatgcgttagaagaaggaaaaaggatagctggacttgtgccgcctcagacagaagaagatctttcaacttgttcgctgcagacttgggaatcttattggccgtatttgcgttatcggttgttatcttctactttgctggaactgacagatatctatcagatgaccgaaggaatagaatcgcgcatgaaaatagcagctgcaactgctgatagttttgaggattttgtgtcaaaggtaaaaacaaaaagatatacatggacacggatccaacgattatcttgttatgtcttgctgaatatcaaaaagcaagagattcctgtccaacaaaataaaaattatcttcgactacttggatttaccgatgctggaagaagattcttaaaagaaaaaaaagagatttctatttattcccgaatcggaaaaaaagaggcacaagaagcggaactgttagttagaagtgatcaaatctatcaattgggaggcaatattccggaacagaatttcgggcaaattccaatccgagtatagataattgactaaaaatgagaagaatgaaggaagaaagaaaaaaagcttcacagaatcgtgattcacaagtataatggaacaggacgtttttgcgttatgaaactatcaaatcagaaagcgaagtgaaaatatgggacgtaaatgggcaaatatcgtagcaaagaaaactgctaaagatgctaataatagccggatttatgcaaaatttgggattgaaatctacgcggcagcaaaatcaggtgatcctgatccgcatgcaaaccaaaaactacgtttcgtcattgatcgcgctaaaacttataatgtaccaaaacatattattgaccgagcaatcgaaaaagcaaaaggtgcaggagatgaaacatactctgaattgcgctatgaaggatttggaccaagcggctcaatggtgattgttgatacattgacgaacaatgtgaatcgaacagcagcagacgtacgggcagcatttgggaaaaatggcgggaacatgggtgtttccggagcggtttcttacatgtttgacaatacagcaatctttgcttttgcaggagaagacgctgacgagatccttgaatacctaatggaaaaagacatcgatgttcgcgatgtaatggaagaagaaggacaaatcatcgtttacggtgaagtagcggatttccatagtatacaagaagcattaaaagaaaaaggaatcactgatttttcaatcgctgagatccaaatgatccctcaaaacgaggtaacactatctccagaagatcaagaaacatttgaaaaaatgattgatgcactggaagatctagaagatgtacagcatgtgttccataatgtggcattagaagactaagcaaccagtttttaacgaaaagtattcagtctttttcgaaaagcaagacaatctcactaacagattgtcttgcttttttgtgtgatttattttcttttctaattcaacctgtggtatgatgagagcataagtatcatgtgaaatgatatgaagtatgtggaagatggacggggaagaatatggaagcaaaaatcactttagaaccttttgaacgtatcttaagcggttaccgcaaagtagaagagttagctgtgaacgtaactgattgttcaaaattagcgcaaaaatacgcaagattcggcgttgaaggctatcgattaggaaactatgtcggtacagggtatctgaaccgttatttagagtgtatggtggaccgcgcaccaatgctgatttatagacaaaaatatttgattccgctgctttttcgtcgttctgattcagcctttcggttatttgaagaagagtatcggatggaggctttctttctactattagagtggagcttgaagcatcgtcctgaaaaaattcttatcgaaagaaatgagaagatagacacgaaaaaaaataaagtgatcgatagtgcatacctagcatttcgtgtatcagagattttggattgtggcggctatccaatcagcaatttccaatcaattgaccagttcattgaatggaatcgaatttaccgattgatcgacaatggcgggattggccgtcatagcaaggtatttgacccagaatatccagaaaacatggaagaactgaaaatgattatttcgcttgtcaaattaaaatatcctgaaacagatttggatttatatatagaataaatgaccttaaatgattgaattactttttctgcaattattattgtaaataaaaagacaactgctaacattaatgatagcagttgtctttttacttacagtacttttttctcataagatgaaatatccatattgtttaacaaaggactttcattattggaggtaaaaagggtcaattcatgcatcgcacgtgtacacatggtgtaaaggatcaatttgtcttgctgagaagaaaaatgttctgcatctacatcccacaagaaaactcggtcaaactccagaccttttgctaaaaaggctggaagtaaaataatggaacgtttcataaagtcactctcatttaaaatcagctggacttgttgtttcaactcgtctggcagttgagcataaagagcttcgcattcttcttgtgttttagctatgattgctgtacgccaataccgggcttttccctgagtcgttcgaatggtatctgctaaccaattcaatttgatatcatctgttgttccttggatgagcaaaggaaggtctccttttcttgctgttgtttctacttgatgttctttcacaataaaatgattagcaaaatcagtgatttcttttgtggagcgatagcttgtcgttaattggaaacgagtgacttcacggtccacgaaaaggtcttccaatgatccaacgatcgtttcatttccaaagacattttgatttagatctccacagaaagtcaaatttgcttttgggaacaaggcttgcagcaatgccacttgtgatggtgcgaaatcctgcatttcatcaataaagatatagcgagctttgtgtgtaaccgtcactggatatgttcggcgcatcagtaaaaagaatagtacagcatcctcttgacgcaattctctttgacgcaagtgtgtacgaacagttgtcaaatgttcctgccacctggtctcgctgattttatgtcgtgttagaagagaaagtggcacagtttgtagaaagtggagatattgtttcgttatattgacaaattgataattcatgatccctcgatggattcgacggaatcttttacgtacgatttggttggccagttttttacgtaatgaacgctccttttgttctgtatattcaagatttggatctgttgcgtatagttcttggagctgttcttccgccagatctttgacccattgctgacgtgtttcgtctttttgcagaccgcctaattttttcaggagcttcgtttgtaatagagagagtctatgatgtaaaggtaattgttcatttgtttctttataccattggcgaatcgattcctttgataggatcgtacggccatttattttcatatcacggaacaagggaccgtagtttgtgatgccttggatatagcgatcaatctgatcgactaaggtcaatccgcttttcatcacttgtatcggatctttttcccctagcaaaaaaccactttcttgttgctgttcatctagtaaagaaaactctggcagcagctgcaccaaataatttttgaatgtctgtgtaggcacgccgctttcacctaatgaaggcaatacagtcgagatgtaatcagaaaacaaatggttgggtgaaaatagaagaacgttttcagcctcgagccacttgcgattatgatacaacagaaaagcaatacgttgaagcaaagcggatgtctttccacttccggcgattccttcaatcagcattactttacttgttgtgtcccgaatgattgcattttgtgctttttgtatcgtagagacgatgtttttcatatggttgcttgatgattcatccaatatctctagcaaaaagtcatcattgattacttccgacgtatctaccatagataaaatacgtccttcttggattttaaattgtcgtttcaactgcagatcgacatctattctatctgtttcagtttcataaaatgcgggaccaatctcaccttcataataaagattggcaattggtgcgcgccagtcaataacgattgtttcttctgccagatctcttaaagaagcgatacctagatataatgtttctgtttcacggtcttctttaaagtcgatacgggcaaaataaggactatctttcatgacagacaacgtttgcaggcgtttttgctgtgcttcaagagtatggtatttcaaaagcaattcctgctcatgttggcgatattcaacagcagattcataaaaagcttcattggaaccagctcgaatcttgtgattagctgtgtcttttgtcgaatgattcatttcctgagtcaattcttgttgttttgtatccagcatattttgttcgatctggattagttcgatcgtttcatccacgtgcgtttgttctagttgtttctcattcatcgcatgtttgctccttccgccgtaaataacgaattaaaagtatagcatagtttttcgaaaaaaggtactttttaactgatgaatcgaaaaagtcatccttgctgaatatttttgtttgtagaactgatgaattttggaaacgctgatagtgatagttgttttcaattaaggcctattgttttaaaaagtgctagtcaaggactatgcttaagatgaaagaggcagctggaaatttattactaacctctctaagtcacataaaagaggagaaaaaacaatgacacatttcaaaaaatttttacttactttgcttattggtgggatagctttattaagtgaatttgtttttcaccagccggcccttgcatttgcgattgtcgcatttactggagggattctcgccttcttgatgtttttggaaatgatcaagacgttacgttcaggaagatatggcgtagatgtattagcgattaccgcaatccttgcaacattagccgtcaaagaatactgggctagtttgatgatattgatcatgcttacgggcggagatagtctagaggattacgcgaataaacgagcgggtaaagaactgcagtctttgttagataacaccccaagaattgcccatcgattcaaagaaggaaaattgcaggatatagtaatcgatgaaataaatattgatgaccagttactagtcaagcctggcgaacttgtacccgcagatggtcgagtgaccaaaggagaatcttcggtcgatgaatcttctttgacaggtgagtcccgcccggaaaccaagaaacctggagatcagattatgtcagggtctttaaatggagacggatcgatccaaatgatcgctgaaaaacgtgccgcagacagccagtatcaaatgattattaaactagtcgaagaatcaaaagaaaagcctgcccgatttgtccgtttagctgatcgttatgcagtccctttcacgttgattgcttatttgatcggtggtatttcttggtggttctcaaaagaccctttacgatttgctgaggtactggtagtggcatcaccttgtccactgattctagctgcgcccattgctttagttgcaggaatgagccgttcaagtaaaaacgggatcgttgtaaaaactggaacaacgattgaaaagctcgcacgtacaaaaacgattgcttttgataaaacaggaacgcttaccaaagggatattggaagtagaggcgattcagccagtcaatggaataaaaaaagaagagctacttctgtatgcagctagtgcagaacaggaatctagccatatcttagctcgttcgttagtgaacaacgtgaaaaacagccaactgtatcctgttagtcaactgaaagaagtgaccggtcaaggaatccaagcagtagtcaataatcatgaagtaaagattggacgtgcctcttttgtttcagctgaagaaatagaaacgtccaatacagcaatctatgtaacaattgatcgatcttttgcaggaacgatcctattttcggatcagattcgcccagaagcagcaaagacaatcaaggagctaagaaaacttgatgtgaaaaatttgatgatgatcaccggggatggatctgccattgctcaaacgattacagaaaaagtccaattagattctgtacatgcccgttgcttgcctcaagataaactgaccattttagaaagtatccctaaagatcaaagacctgttgcgatggtaggagacggcgtgaatgacgcaccagcacttgctgctgcagatatcggcattgcaatgggagctcatggttctacagctgctagtgaaagtgcagatgcggtcatcttgaaagatgatcttttacgtgtagcaaaagcagtagtgatctcaaaagatacgatgagaatagcgaaacaatctgtactgattggcatctttatttgtatttttttgatgttaattgcaagtacgggactaatccccgcattattcggagctgttttgcaagaagtcgtggatacggtctctattttgagtgccttgagagcaaaaaaagatccagccatttttcctgattcagtacccaagacaaacatagtatgatagaatcgagttgaaaaaagaacgatcagaaagaggagagagcattatgccattcgtacatgtcgaattagtagaaggtcgcagtccggaacaattagaaaatatgatgaaagatatcacggaagctgttcataaaaacacgcaggcaccaaaagaacacatccatgtcatcatcaatgagatgaaaaaaggaacatacggtgtaaatggggaatggaaaaaataagtttagtttcccacttgatttttctatttattagtggttaaataaacacataattgattgatgagaaagccaactgaatttgagagtcttcgataagagaggaaaagctaggctgaaacttttccaggagaaaaccaaaggatgaccactttcgaaacccttgttgaagcaagggcggtcggaccgttacaacgcttgaggaacgcatttgcgtttgaacattaggtggaaccacgaacttttcgtcctagtatctcttttcaagagatgctaggatttttttgtttttcagcttgatgatctgatcaatcaaaacatttcaaggaggaaactattatgataaaaattacttttccagatggtgcagtcaaagaatttgagtctggaacaacaacattggcaattgctgaaagcatttcaaaaagcttagcaaaaaaagctttagctggtaaagtgaacggaaaactcgttgatttgactcgtccaatcgaggaagatgcaagtattgagatcatcacaccagaccatgaagatgcacttggcttagtccgtcattcagcagctcatttgatggcccaagccatgcgtcgcctctatccaaatatccactttggcgttggaccagctatcgattcagggttttactacgatacagataatggacaaaaccaagtaactgcagaagatttgccggcaatcgaagcagaaatgatgaaaatcgtcaaagaaaatctgccaatcgaacgccgtgttctttcaaaacaggaagcattagaaatttttgcaagtgatccgtacaaagtagaactgattagtgaattgccagaagaagaagtgattactgcttatcaacaaggcgaattcatcgatttgtgtcgtggaccacatgttccatccactggccgtatacaagtatttaaattattatcagtggcaggtgcttattggcgtggaaactcaaacaatcaaatgatgcaacgtgtatacgggacagccttttttgacaagaaagctttgaaagaatatatccgtctccgtgaagaagcaaaagaaagagaccatcgtaaactaggaaaagaacttgacttgttcatggtttccccagaagtaggttctggtttgccattctggcttccaaaaggggcaacaatccgacgcacgatcgaacgttatatcgtagacaaagaagttagtctaggttaccaacatgtatatacaccaatcatgggagatgttgagttgtacaaaacatctggacactgggatcattatcaagaagacatgttcccgccaatggatatgggagatggcgaaatgcttgttcttcgtccaatgaactgccctcatcacatgatggtctacaaaaacacgatccattcttatcgtgaattaccaattcgtatcgctgaattaggaatgatgcatcgctatgaaaaatcaggtgctttgtcaggtttacaacgtgtacgagaaatgacgttgaatgatggtcatacatttgttcgtcctgatcaaatcaaagatgaatttaaacgtacgcttgaattgatggtggcagtatatgctgactttaatattacagattatcgtttccgcttgagctatcgcgatccaaacaatacagataaatattttgatgatgacgcaatgtgggaaaaagcccaagcaatgctgaaagccgctatggatgaattagaactagattactttgaagcagaaggcgaggcagccttttacggaccaaaactagatgttcaagtcaaaacagctcttggtacagaagaaacattatcaactatacaattagacttcttattgccagagcgctttgatttgacatatgttggagaagacggggaaaatacgcatcgtccagtagttatccaccgcggaatcgtttctacaatggaacgttttgttgcttatttaacagaagtatacaaaggcgcttttccaacatggttggcacctatacaagcaacaatcatccctgtttctgttgatgcacatggcgattatgcttatgaaatcaaagaacgtttgcaaatgaaggggttgcgtgtagaagttgatgatcgtaatgaaaaaatgggctataagatacgtgcctctcaaacacaaaagatcccttaccaattggttgttggagacaaggaattggaagatgcaacagtgaacgtacgtcgttatggaagtaaagaaacagctgtagaagatttgaatatctttattgatgctatggaagcagaagtcaaaaattacagcagagaaaactaataggtaaatttcctgtaaaaaagtagtagatagaaaacaatccgaacaatagataacaggtattcctcaaagacacagatgctcaatagaatctgtgggattgataggataagatattctgttgggcggattgttttttttgtttttttatccagtatacgaccgtgaataagggtctgatatggtatacttacatagactatcattaaaagggtggaggaacttatgagcgtaattagtcgtattgaaagtatgatggaagattattcttcagcagaaaaaaagttggccaactacattatcggtaatattgagaaggtccctacaatgacagctaatgaattagcagaagcttccgggttgagtgcgccgacagttgtacgtttttccaaaaaaatcggttttcaaagtctgacggacttcaaaatcacgatttcaacagaactacagactggaattgatgaaggttttagtgatatagaagcaaatgagtccttttactctatcaaaaacaaacttggtaacaatgcacaagtagcgataaaagaaacagtagatattctagaagaagaaacgatccaaaaagtcgtagagtgtttggaatcggcagagactgtttttttatatggggttggcgcctcttctttagtagtagaagatattctgcaaaaatggtctcgtgtcggtaagccaatcatttttgaaaaagatatccacgtcttgctcccgcaacttgtcagcaatgagaaaaagaaagtgctttggcttgtttcaaactcaggtagaagtgcagatgtagtcgcattagccgagctggcgaaaagcatgaatatcgaaatcattgcgttgacgcaatttggaaataacccgcttagcaagatagccgatgtactcgtacaaacatctagaccaaaagaaatcacgaatcgaagtgcggcaactaattcacttttggcccaatttgctacgatcgatatcattttttatttctatatggctaaaaacgaaaagcttagcgaaaaagtgaaaaaaacacgagaagcaatccaagaatattttatggattcgaaataaaaaccttactattttttatataagttttttagaataacaaaacgtagttttccacaaataaatgatccatcaaagtgtttcacgacttaagaaaacataattttcaaaaataagtttattttttaatgaaaaaaatagttggatatgtaactttaagtgattgctgtgaaacaaaaagttgattttatcttgaaattaggtaaagaatttcttgctccgcccattttttcttttttattaagaagtttttgggtacaatgaagcatgaatgtaaataggcggaaggataggaaatgatgaaagattttatgaaaaaaatattaaatacttcttggttagaaaaaataagaaaaggtgcacaagaacctaagaacaaaacgtttcgccggtcccatgttccttttcgcttaaattttctttttttcattatatttacgttatttgttgcgttgattgctagattgggttatttgcagatcgtgaacggcgaagagatggaggcgcgagtgaagtctacttctacgattacggtccaagaaagtactcctcgcggaatgatctacgactccacaggaaaagctttagttacgaataaagcgaatcaggccatcacatatacgagaggaacacaagttacggctaaagatttgcttgaaatcgcaacgaagctgaactcgctgatcgatgttccggtagatgaaaatctgacagatagagataaaaaagatttttggctggctgatcccaaacatttgaaagaagccacaaaaagactttcggcaaaagaaaagcaattagggaacagcgaacaatatagtgcgatggtcaataaagtcacagctgatgagattaatttaaacgaggagcaattaaaaattgctaccatctttaaacggatgaatagtgcatatgaattaaacactgtctatatcaaaaactctggtgttactgatcaagagttagctgttgtggcagaacgcgcttctgaacttccaggagtttcgactggcacagactggacacgagaatataatgcagcaagttcactgaaaagtattcttggcagtgtgacgactgaaaagcaaggacttccagcagatgaagcagagaaatacctagcaaaaggttattctcggaatgaccgtgtaggacaaagttatttggaaaaacaatatgaagatgtcctgcaaggaaccaaaacccaatatgaagtttcccttgataatgaaggaaatgtttcgaatcaaaaagaaatcttctctggggaaaaaggttctaatttaatgttatctatgaatgcagaattccaatcaaaagtagaagaaattttgaaaaggaattatcaaacattgatcaacaacggcaaagcacagtattcgcctggtgcttatgcagtggctatgaatcctcagacaggagaagtgctagcaatgactggtttcagtcatgaacaaggttccaaagaaatcaccgagaatgctttaggcacgattactagcgcctttgctccagggtctgtagtcaaggctggtactttgacagcaggctgggcaagtaacgcgatcagcggaaatcaagttttgattgatgagccgattcgtctgcaaggtgcttcagaaaaaagctctgtctttaatcgaagcggacaagttgctcttgatgcagtcaaagcattggaattgtcttctaatacgtatatgatcaaagtggcgttaaagatgttaggactagactatacacctggaatgggactacctagtttagatgaagaagctaaagcttatcagcaattgagagactctttcaaagagtttggtcttggtacaacgactgggatcgatttgccgaatgaatctcctgggatctcacgttctgttgattatatgaagaagttcaatgcggataatggcaaagaatggtatactccaggtaactttaccgatttggcatttggacagtttgacacatatacaccaatccaattagctcaatatgcttcaacagtcgctaatggcgggaaacgagtacagccgcacctagtcaaagcgatctatggcaatgacgaaaatggaaacttgggtgaagtgaagaaagaaattggcacaacagtagaaaatacggtcaatatttctgcagaaaatatggcgatcctccgtgagggattccaccaagttgtccatggtaccgatccttacacaacagccaaaccattagccagtgcgaaaatggacctttccgcaaaaacagggactgcagaaacggttgcggaaggtcatccagatattacgacagtcaatagtaatatcgtggcatacggaccaacagacaatccggaaattgccatcagtgttgtcttgccgaacttattagacgaacaagaccacatgaacttgacgattgctaaagaaataatggacgcgtattatgatatgttcatggcaaaataaaaaagaggtcgtgaaaaagccgcttagtttcgagtatgaagaaaaattttgtgaaaatagcttctcacatttttgcttaaatttgacttcataccgagaaactggcttttgaacaccgtttactcggcaaaaaaggttgtgacaaaaattgtcacaacctcttttttgtggaatctaattctctattatagtttaagtagtttttccagataaacagctaaaccgtcttcctgattgctcaaaggagtgacatcatttgcaatgcctttgagttgatcagtaccgttagccatagctactccccaacctgcataatccaacaattccaaatcattatgctcgtcaccaaaggcaatgacgtctttttgatcgatagacaggtagttagcaatctcttgcacgccttttgctttttggattccttttgaaacaatctctaagatggcagtaggtccaccccatgtccgaacatcgacataactgccaaattgacgtgttaattcagcagatacagctcctgcaaaacgtttgtctgttcggacaagcaaagatgtaggatttgtcgtcaaatttttaggagaaagcaaattcttctctcctggacgagaagaagcaaaaattttttcatcaaagaaatcaaaactgtcaataaaaaaagtatcacgattttcagcagcgataaaatctaaatttagctgctttttttgcgataagatttcaaaagcgatttcacgattgatcaacgtttctctttcaccatcccagtgctgattagggatgtgtactaatgcgccgttaaaattaaccatcggtgttgttaattctaattgttggtaaaactgatggctcattcggaatgggcgtcctgtagcaatactgacatgatgaccggcattgattgcttttttcagagtctcttttgttttagatgtaatcatcgaatcttgattgagggtagttccgtccagatcgatggcaattaattttttattcaataagggtccttccttcctcaactagcatttgttttagtctagcatattttaggtaattaacaagagcaatcagctattcctaacaaaaactacagttatggctatataaatagctaaacataagctaaacacgaacgttaagtattattttcgctttttttgttaaaaaaacgttgaaaagcgaatgaaacgtctatataatttgaaattgttcgatggatttgccctattttacttattttttattattatagttttccatcagaaaaaaattcagggagtggaactttttatggaaaagtttttcggtttaaagaaaaacaatacaaatgtatcaactgaaataatggcgggagtaacgacattctttgccatgagttatatcttattcgtaaatccgacgattttgtcagcatcaggtatgcccttccaagcagtatttctagcgacaatcattgcatcgattattggtacgctggtaatgggattgttcgcaaatgtaccatatgctcaggcacctggtatgggattgaacgcatttttcacttttacggtcgtttttgggcttggttattcttggcaacaagccttggcaatggtgtttatttgcggattaatcaatatttttattactgtcacaaatattcgaaaaatgattattcgggcgattcccgaaagtcttcaacatgcgattggtggcgggatcggtattttcgttgcgtatgtcggaatcaaaaatgcaggattcttatctttttcagcagaccagtcagctatttcgagctctgtcgttgaaggcggaaaagcgacaaatgttacgataaatggtggaatcgtccctgcgttagccaactttgacaacgctcctatcttattggctgtgattggtttggtactgacatccattttagttgtaaaaaatgtccgtggggctattcttatcggtatcgtagcgaccacagtccttggtatttttatgggtgttgttgatttaagttccattgattggcaaacgaattcgttaggtaattcatttaaagaattaggaacaactttcggtgcagcatttggttctgaaggcatgcaatctttattcagtgattcttccaagattcctcaagtattgatgacgatcatcgcattcagtttatctgatactttcgatacgatcggaacatttatcggtacaggacgccgcacaggcattttctcaaaagaagacgagatcgcgttggaagatggtcgtgggttcaaaacaaaaatggataaagcactatttgccgatgcgatcgctacttctgtgggggctatctttggtacatcgaatacaacaacttatgtcgaatctgcagctgggatcggggccggtggacgtactggtttgacttcagtagtagtggcagtgctattcgcattaagtagtttactctctccactgatcgccattgtaccaaatcaagcaactgcgccagcattgattttagttggagtaatgatgatggcttcttttgcagacatcaaatggctagatatggaagaagctttaccggccttctttgcatcgatctttatgggattgtgctatagcatttcctatgggattgcagcaggatttattttctatacaattgtgaaagtaatcaaaggaaaatacaatgaagtttctgttgctttgtggatcgttgatattttattcattatcaacttcatcattctagcaacaatttaactaaagagaagggattggaacagtatttgttccgatctctttttgttttacataaaaagaacgttacatataaaatgatctttgcgggatttttctctttttactggcgagatcgttgcttgtttattcgaaaataggtatgataaaagagacgaaagagggatgatagatggagattaattggagaaaaaatttagtgattgcgtggattggctgttttttcactggtgcaagtattagtttagttatgccattcataccagtttatgttgagcaactaggaacaccaaaagatcaaatcgaattgttttcgggactagcaatctctgtgactgcttttgcatctgccgtggttgcaccaatttggggaaatctagctgatcgaaaaggccgaaaactcatgatgatccgtgcagcagcagggatgacattaacaatgggatctttggcttttgtaccgaacgcgtattggcttttgatcatgcggttttggaatgggattttgtctggatatattccaaatgccacagcgatgattgcttcacaggcacctagagaaaagagcggatgggcgttaggaacattgtctaccggagcgattgctggaaatctgatcggaccttcaatgggcggtgcactggctcagtggtttggtatggaaaatgtattcttgatcacaggggctttgttgatgatcacaacggtgctgaccatcttcttagtcaaagaagatttccatccaatcgagaaaaaagatctgataagcaccaaagaaattttttcaaaaatggatcatctctctattttgatcggtctcttcattacgaccttgattttacagataggaatcactacgatcagccctattttgaccttatatattcgtgaattgagcggaagtacagaaaatatcctttttgtcagcggcttgattgtttcgatagctggtgtttccgctgtcttttcttcaccgaaactaggaaaactaggggataagattgggaatcaaaaagttctaattggaggactcattttatcattttgctgttatttacctatggcattcgtcactacaccgctccaattaggtatacttcgctttattttaggcttttcaactggcgctttgatgccttctgtcaatacactgatcagtaagattacgcctcaagaaggagtcagccgaatctatagctacaatcagatgtttagcaactttggacaagttttaggtcccatgctaggatcgacagtcgcgcatgcttataattacagtgctgtttttattgtgacaagtttgtttgttctgtcaaatattcttctttctttattcaactttcgtaaagttcttcgcagcagattataatggtggtgaggagtagaaaataaaaaagagcttgagatatctcaagctcttggctgtttttttacgaatgggcagaggtttcttttcttggcgcaactgcaccaatcaaaaggataatgacacccgcaatgaatgaaatgattgttgtcaaagtaaaatcatatgttccgcttgttaatgcagcaccaatataaccgactacttgacctagaacgacagcccagaataatgtaacgatatatcgcataaagaacacctcttttctatcttaattttaccagattttctttgaatgtaaagaaacgagaccaaatctcaataaaatttgagttcttgcgaaagaactcattcctacagattacaagcaagcaaatgaagtggaataatcaacttcagcgcctgctatcttaatgaaagtaaaaggatcaaaccttttaacgctagtgaattttaacgaaaaaaaaggcggaatgcaagatgtttttcccacaactttatacaattacttcttattctcttttacaaagtacgatacgtattcgagaatatgtacaagaagcaaaaaaacaaggctacacttcattagccataacggataaagatgtcttatacggtgcacctgaattctatcgtatttgtgtagaagaaggagtacagccaatcattggattacatcttagttatacttatgaagaaaaaaattatggcttgcttgcgtacgcaaaagatgaaataggttatcagcagctgatgaaactttccagccgaaaaatgatccaagaaaaattggaacttgcagaaatgacagaaaccgaccatctagcgtttgttgttccggcaaatcattctgtttctgaggctttcaataaagaggataactttttcggtcattggcagtttttacttgaaaatgtttttactagaaatttttatatcggcttgacagaaaacacgcctgatcaattgcctgaatggtatcagtatgtgataaaagaaaattattcgctttgtgcattacatcccatcgctagtttacaacaagaagaactttttgcacttgaagtgatgaaacatatcaaagatggaagccaaatacctttagaaaatttatctgcatctttaccactaacagcaaatggctatcttctttcagaacaagaaatgatcaaacgattcgaaaaagcgggtctttcccaagctgtaaaaggcgcccagcgtttagctgaatcgatttcatttgaattccagttccatcagaaattacttccgcattatccagttcctaatggaaaacaagctggagaatatttaagagagttatgctattcgcaagtggaacgccgaatcactgattatacaaaggaataccaagaacgtttggactacgagttatctgtcatccatcaaatgggattcgatgattatttcttgatcgtatgggatgtaatggcttttgctcatagaaacaaaatcgttaccggtgcaggtcgtggttctgctgcgggttcattagtagcctatgtgttagaaatcacagatgtggatccattagaatatgatttgctgttcgaacgctttttaaaccccgaacgctttacgatgccagatatcgatttggatattcctgacaatcgacgtgaagaagtattgaattatgttcgagaaaagtatggacaatatcatatggcacaaatcgcaacatttggcacaatggcagcaaaaatggttcttagagatgcagctagagtgtttggtttatcgcaaagtgaagcaaaccgctggtcaaaagcaatacccaatcaattgaaaatcacattgacccaagcttataaaacttcgcatcaattagtagaattagttcaggcaagcgaaaaaaaccaacttttattcaaaactgcagtgattttagaaggattgccaagacatgtttcgactcacgcagcaggtgtagttatcagcgataagaatctacttgaactagttccgctccaacgcggttctgatgaagcttttctgacccagtatacgatgaatgaggtagaagcaatcggtcttttgaaaatggactttttaggactacgcaacttatcgattattgattttactttgaaagctgttaagcgagtagaagggtatgagatccgattaaaagagatcccgctaaatgatgcaaaaacgctgctcttgtttcaacgaggcgaaacctcaggagtatttcaatttgaatctgctggtatccggaacgttttacgaagattaggtccagaaaacatcgaagatattgccgcagtcaatgcattgtatcgaccaggccctatgcaaaatatagataccttcattgccaggaagaaaggaaaagaagccattcgctacccagatgattcactgatcccgattttgaaaaacacatatggagtgatcgtctatcaggaacaaatcatgcagatcgcctcgactatggctggatttacattagggcagtcagatattctgcgacgggcagtgagtaaaaagaaaaaagacgtattagatgaagaaaagtcgcattttgtatcaggagcattacaacagggatattcggaaaaaacagcagcgaccgtatatgaatatatcgaaaaatttgcaaactatggattcaatcggtcacatgcatttgcttattcattcgtaggattccaaatggcgtatctaaaagcccatcatccaggtgctttctttaccagcctgatgaattctgttcggcataacacatcaaaattgaaagaatatattgcagaagcacgtaaaaataaactcaaactttcctcgccgtccattaatcaaagtaattccagttttgagttggtcaataaggaagaaatcagattcggactgacagcgataaaaggtattcggcgtgattttgtagaagatatattaaacgaaagaaaacaaaatggcccgttccagtcagtggatcaattcctcatacggatcgataagcgttggctgaaattagagttactgcaatcactgacagcagtaggcgtttttgatgaattatctcctaacaggaaacaattgatgcttgatctcgaaggaaaaatccaaaatatcgtttacagtggtggaagtcttgacttgctgggaatcatggcattaaaagaagaagaagtcgctgactatacactagaagaacgcttgaagctggaagaggagtacttaggtatttatttgtcaggtcatcctgcagaagggtttgatcgtcttcgtttagctaaacaagttcagctgattacagatatcgtccctaatcaaccagtcaatttattagtgatgatcaaggaagttagagaaattcggacaaaaaaaggagaactgatggcctttgttgaaggaaccgacagtagtggagaaatttctgtcacagtttttccaactctttatcgtaaatatcgtaatttgtttgccgttgatcgagtgatctttgttcaagggcggagcgaaatcagcaaatataatcaggaactgcaactaattggagaaagctttgctgatcctaaccagttagaagcccagtatccttcacaaacttgctatttgcgtattacagaagaacgggaagatcccgagataatgaaacaattacaagtgatttttcagaaacacccaggatatataccagtagttatgtatcacgaaaaaacgcaacgaaaagtagttctgtcagatgcttattgggtggatgacagcaagagtataaaggggcaacttatttatctgcttggcgaagataatgtggttttcaaataacttacggtaaaaaatactacttgctttcattttttttcatttttttatccgtaaatcaagacaagtgagaaaaataatgttagaatgttagtcgtggttaacgcaaaaatggttgtaaacctaagtcatacttaggataaagtattttaatgaggtgaatgtttattatgaaacgcatcggaattttgaccagtggcggagacgcacctggaatgaatgcagctgttcgtgccgttgttcgtaaaggtatttacgaaggactggaagtatacgggatcaattatggttttgccggtttagttgctggagatattcgtcgtcttgatgtggcagatgtaggtgacaagatccaacgtggtggtacattcttgtattctgcacgttatccagaatttgcaactgaagaaggtcaattaaaaggaatcgaacaattgaaaaaattcggaatcgaaggtctagtggttatcggaggagacggctcttatcatggcgcaatggctttgacaaaacgcggtttcccagcagtaggtattcctggaacaatcgataatgatattcctgggactgatttcacaatcggttttgatacagcaatcaatacagtactagaatcaattgaccgtattcgtgacacagcgacttctcatgttcgtacattcgttatcgaagtaatgggacgcaatgcaggagacatcgctttatggtcaggtgtggctggcggagcggatgaaatcatcatcccagaacatgattttgatatggcttcagttgctaaaaaaatccaagaaggccgcgatcgcgggaagaaacattgcttgatcatcttggctgaaggtgtaatgggcggaaatgaattcgctgagaaactttcagaatttggcgactatcatacacgtgtatctatcttgggacacgttgtccgtggtggagcaccaagcgcacgcgaccgcgtgttggcaagtaaattcggtgcttacgctgtcgaattgcttcaagaaggaaaaggtggattatgtgtcggtatccatgacaacgaaatcgttgcgtctgacatcattgatacacttgaaaacaacaaacataaaccagacttatcactatatgatctaaataattcactttcattttaagagtgaaagaaaccaagctatttaagctgtgtacagctttaaataaacaaaattgaatgggagagttttttaaatgaaaaaaaccaaaatcgttagtacattaggaccagcaagtaactcagtagaaattatttctcaattgattgaatctggggcaaatgtcttccgctttaacttttctcatggtgaccatgaagaacaattatcacgtatgactatggtccgtgaagcagttaaaaagacaggaaaagatgtcggtattcttttagatacaaaaggagctgaaatccgtacaactgttcaaggcacaacagaagctgattttggtcgtgcaggatacatcaaatttgaagtaggagatcaaacacgcatctctatggatcctgaacatgtaggttcaaaagaaaaaatcgcggttacttacccaggattatttgacgatgttcacgttggcggacacattttatttgatgatggtttgatcgatatgcaaatcattgaaaaagacgaagcaaaccgtgaattagtcgtagaagttaaaaatgcaggtatgctaggatcacgtaaaggggtaaatgcaccaggcgtttctattagtttgccaggtattactccaaaagatgctgacgatattcgttttggtttagacaacgatatcgactttatcgctgcaagttttgtacgtaaagcacaagacgttctagatatccgcgaaatcttagaagaaaaagacatgactcatgttcaaatcttccctaaaatcgaatctcaagaaggtatcgacaacattgacgaaatcatcaaagtttctgacggtgttatgattgcccgcggagatatgggtgttgaaatcccagctgaactagtaccaatggttcaaaaacgcattatcaaaaaatgtaatgctgctggtatcccagttatcactgctacacaaatgttagaatcaatgcaagaaaacccacgtccaacacgtgcggaagcttctgacgttgctaacgctgtatttgatggcacagatgcaacaatgctatctggtgaatctgcaaacggggactacccagttgaagctgtttcaacaatggcacgtatcgaccaagaagctgaaaatgcattatcagaattaggtacattccaattgaacgaattcgataaaacagatgtaactgaaacaatcggtttatctgtagctcgtgctgcaaaaaatctaggcgtgaaaacaatcgttgctgcaactgaatcaggatacactgcaaaaatgatttcaaaatatcgtccagatgcagatatcttggctgttacttttgacgaacgcacaaaacgtggtttgatgttaaactggggcgtttacccaacagttgctgaaaaaccatcaacaactgatgaaatgtttgaactagcagctaaaaaagctgttgaattaggtttcgcatcagaaggcgatttaatcttgatcactgctggtgtaccagttggtgaacgcggaacaactaacgtgatgaaaattcaaatgattggttctaaattattagaagctcaaggcgttggacaaaaatctgtcgttgcaaatgcagttattgcttcatctgctgaagaagctgtaaaaaaagcaaaagacggaatggttctagttgtaccatcaactgacaaagaatatatgcctgcaatcgaaaaagcagctgctgttatcgttgaagaaggcggattgacttctcacgctgcagttgtaggaattgcacaagatattcctgtaatcgttggtgctaaaggcgcaacaacaacaattacagaaggtgaattgattaccgttgattcacgtcgcggcatcgtttaccgtggcgaaacaacagctatctaatttagcttaataaaaaataaaaacagctcttcttttacgaagagctgtttttttgtgctgtaacgaattcatggataacttggactacttgttcttgaagaggcgtgacgatctgctgtgttcgttttgccaatgaaatcaagaagcgaggctgaacttcatctgaaagagggaggcaaactaaatgatcttcaggatggacagcaatctctgccaaaaaaccgatacccacattttctcggaccatactctttaaaatcgtcaagtcattgctttgataaacaacttttggatgagtatgtgtttgtttagaaagcttagtgaatgctgcggggtggacataatgttcgttcaatagtacaaactgttcatctgctatatctttgaaagagacagtatcctgcttggaaagaggatgtgtaggtggcacgacgatcatgaaacgtttgtccaaaagtaactctgtttctaaatattgatccacgattggctgtgttgagcctaatacagctaaatcgatcctcccttgtcggatcatcccgtataagtcccgagagcctccatcggtaatctcaatttgattcatcaattcatgcttgataaagtaacttgacagtttaggaaagtattcattgccgataataggaggcatgccaaaacgaagctttttcttttgcaactgagtgatttcagctcttgcagtagaaatctcttggagaatggtttgtgcatggagaaacagctgctttccagaaggcgtgacgattaattcgtgatgcgatcgatctcttgtaataagtacggtgtcaaactctttttcaagacgttgtaatgcatatgtaatagtaggttggctcacacggaaataattagccactttcgtaaaatttttttgtttgacgatttggacatagtattcgatatctttcgtgttcatgaagatcatccgctcctttaatggaataatgattattgtaaatgattctgaggatgatagcaaacagaggctttctaataaagatttttctgtttttttatgaactgcaaggtgtcaagaaaatttcattgacaacatgctttttgccctgtataattgcttttgttgcttaggagtgatgaaaaatgaaatggtctttattggaattgagaaaataccaggagacaccgttaacttttcatgagacgctcgacttgaaagccgctctcatgaagcgagacaatttaatacttgatgttgcgccagtggaagtcgaaggtttggtctcagttgataagaaaggctatatcgttcattacactgtgcagacgactttgacagttccttcaacacgttcactagaacctgttgaactgcccatggatttttctgtagacgaagtattcatgacagaagaacaattccaaagtagagatgaacaaatgtctgcggatgagattttgctaattgaaggtccattattgaatttagcagagtcgattgaagacaacatcttattggcgattccaatgcgggtattgacaaaagaagaggaagcagcaacagaacttccaaaaggcaatgattgggaagttgtttccgaagaagaataccagcgcagaaaaatggaagaagccgagaataaaattgatcctcgtcttgcaaaactatctgaactttttgattctaaatcaaaagacgacgataacaagtaagattggaatatattgtgtctaatttagatacaagactttacaaggaggtgtagcaaaatggcagtaccagctagaagaacatcaaaagctaaaaaagcaaaacgtcgtacacactacaaattgacaatcaaagggttaaacgaatgtccaaactgtggtgaaatgaaaaaaagccatcacgtatgtgcaaattgtggttactatgatggtaaggacgtaatgtcaaaagaagcttaatacattttaattagaaaatgtaaaacctcaaggctaaccatggagccttgaggtttatttttttgtagtcggtaaataaaaaatatgttgttctttagtttgcaatgtagccgtgttaagctataatgtaagagattagggagaaatcccgtatgtaggaggagttcatatgtcaaaacaacaaatcggcgttgtcggtatggccgttatgggtaaaaatctagccttgaacatagaaagccgcggctattcagtggctttattcaatcgtacaggggctaaaacaaccgctgtagtagaagaacacccagataaaaatttcaaagcaacatatacaatcgaagaatttgtagaatctatcgagaaaccacgtcggatcttgctaatggtcaaagcaggaccggcaacagatgcaacaatccaagagttacttcctcaccttgataaaggcgatattttgattgacggaggaaatacattctttaaagatacgatgcgtcgtaatgaagaattagccaactctggcattaactttatcggtacaggcgtttctggtggtgaagaaggagctttaaaaggaccttcaatcatgcctggtggacaaaaagaagcctatgcgctagttgcaccaatcttagagcaaatttctgcaaaagcagaagacggagcaccatgtgtcacatatattggcccaaatggagccggacattatgtgaaaatggtacacaacggtattgagtatggagatatgcaactgattgctgaatcttatgacttaatgaagaatattttaaacctttcagtagaagaaatggctgatatctttaaagaatggaatcaaggcgaattagacagctatttgatagaaatcactgctgacattctgacacgtaaagacgatgaaggaacaggtaaaccagtagtagatgtgatccttgatgcagctgggaataaaggaacaggtaaatggacaagccaaagcgcgcttgacttaggtgtgccacttccattgatcactgaatctgtatttgcccgctatatttctgcttataaagaagaacgcgtacaagcaagtaaaattttgtctcgtacgaacgattttgagttcacgggagacaaaaaagaattggtcgaaaaaatccgagaagcgttgtatttcagtaaaatcatgagttatgcccaaggatttgctcaattacgtgtcgcttcaaaagaatttgattgggacttgccatttggtgaaatcgcaaaaatctggcgcgctggatgtatcatccgagctcgattcttgcaaaaaattacggatgcctatgacaaaaatcctgagatcgaaaatttattgctagatgattacttcgttgaaatcacgaaaaaatatcagcaatcagtcagagacgtcgttgccttggctgtccaagctggcgtacctgtaccgactttctcatcagccatcgcttacttcgattcatacagagcagaacgtctgcctgcaaatataatccaagcccaacgcgattactttggcgcacatacctatgaacgtgtcgacaaagaaggaatcttccattactcatggtaccatgaagaataatagtctttcggctgttaggaaatgagaaaataaaaagaggacgaaagagctgaagtcgattgttatgagtagacttcagctcttttttaaaattgctatccatgataaaatgactatagatttttaagcatattatcggtataatgatagagtttttaaaaagccagtagaatagaaaggataaaataataaatgagcaatattctaatcattgaagatgaaaagaacttggcacgatttgtcgagctagagttgaagcatgaagggtataatgcagaagtccactacaacggccgaactggtttagatgcggcattaaataatgagtgggatgccatattgttggatctgatgctcccagaattgaacggtttagaagtctgcagacgtgtacgccaagtcaaaaatacaccaatcattatgatgactgcaagagattctgtgatcgatcgtgtatctggacttgaccacggagcagatgactacatcgtcaaaccatttgctatcgaagaattattagcacgtcttcgtgcattgttgcgtcgaatcgatattgaaggcgataaaaatgtggctaaacaaactactattacttatcgcgatttgactatcgaaaaagaaaaccgtgtcgtacgtcgcggaaatgaagtaattgaactaacaaaaagagaatacgagttgctgcttactttaatggaaaacgtgaacgtggtattagcacgtgacgttttactaaataaagtgtggggatacgaaacagaagttgaaacaaacgtagtggacgtatatattcgttatcttcgcaacaaaattgacgttcccggggaggaaagctatatccaaactgtacgcggaacaggttatgtgatgcgctcgtgataaagccgaaaaaatcggaaaaaagagaactgaaagggccctccttgacaatcaagtgggcctttgcgagttctttcttcatattcgttgtgtttacaattttcgctgtcattacctataaatcatctatcaatctgattgtggcaaaagaaagaaacaatgtagagcgtacgatttcagaagtagcttctcgtttggctaactcggatgaagaactgacattagtaaatacgtatcgtaatctgacgaaagcgacaaatgacggagatgaggtcgtagatcatacttcactggtcgaaggaaacttaatgaagatcgattcctttatagctgagctagggcagccatcaatggatctttatgtttatgatttggacgagaacttgatttttaaaacccatgaaaacagtcgaaacctgattcagactacacgtaaagttccaacgatcgttacactagaaggaaaaactggctttttatctatccagcctatatattctaaaggtacaagagaaaagatcggctatgcgcaaagcttctatgaattatcttctttctatgatattcgaaataagctattattgactcttattgttttagaagttgtttctttgatcttaagtagtattttaggtttctttttatcttcttatttcttaaaaccactcaaggtactcagagatacaatggatactatacgtaaagatccgcaatcagatatccacatgcctgaaatcgacacaaatgatgaattggcagatttagctgaaatattcaatgagatgcttgaccgtatgcgtttgtatattgaacaacaagagcaattcgtggaagacgtatctcatgagttaaggacacctgttgcaattattgaagggcatcttagtctgctaaatcgttgggggaaagatgatcctgagatattagaagaatcattaagcgccagcatgcaagaaatcagccgtatgaaaagcttagttcaagagatgctagacttatcaagagcagaacaagtagatgttcattatgcgaatgaaacaactaaaggaaaagaagtcacctatcaagtttataataatttcaagatattatatccagactatgtgatcactttagatgatgatttgacaaaagaagtgaccctgcaaatttatcgtaatcactttgaacaattaatcattatcatattggataacgcagtaaagtattcaactacacgaaaagaagtccatatctctatttcttccactctgaatgaatttgagatcgcgattcaggactttggcgaaggaatacccaaagaagaccttaataagatcttcaatcgtttttatcgagtggataaagcaagagctagaacgaagggtggaaatggtctggggttgtctatcgctaaacaactggttgaaaactataaaggacgtatcttagcagaaagtgtagtagggcaagggacaatttttagaatctttattcctatcgcaaaggcagaagacaagtaaagcatgtgctttacttgttttttatatatccaacaaagaataaggtacaaaatacaagcaagtgagaaattcagggatgtcattataaaaaaactagcgaacaattaaatagaataacatccgttaattaaatgtaagtagcttttagatgaacgaaaaaacaataaaatgctgtaatattcgtgtttaaaaataataaataaaaatagggaattttctattgcaattttataaagagattgctatattattatttgttctaaatgattcctttaaggtgtcactaaaaattataaaaaatagtgttgacgcacttttgatgtcatgttataataacgaagtcgtttggatgagatagctaataaagcttgattttatcgaaaaaaacttcgaaaaagttattgacaaataacaataaagatgatataataatcaagtcgctgctaatgagtgacaaagacgtttagaaaaaataaacaaagaagttgttgacattctcttctgaatctgataagattaaagagttgttgaaacaaaaagatattgattattttagaaaaaaagaaaaacatttctggcgcttgtttgttctatattatgaagcagtgatttttttctttgttagtttgacacccgtccatgagcatcccgcattagtaacgattttgattgcttttactgcatcgatccagtgggtagcttttgataaaatcaacgggcgtgcctacactaatttatttacaactggaaatttaaaaggggtagcaacgaacttatatgattattgtatttctaaagaaaaagcagattttgatcgatttttccactatctaagtgtcgttcttgcctttatcgcaggagctattgtccttgttttctgtcatcatctgtttggcgcccattcgattttgatcgtttccattttatttttgatcatggccctcactcagacatttcatttatggcaattttatcatacgaatcggttcactatttgatctcaatgaatcaaaaaaactaagcaagatgctgctcacagagaaatatctgcgagtgagcaatttgcttagtttttatattatttagttgtaaagattccctttgctttcgggttatttgtagtgtagcggatcgactgggcatctgcctcttctgtcattttctttgcccgcatcttgatttcttgtacgatttgttctccacatgccggatcggctacgaaatcatatttgtccccatcgatcactattttgggacatatatcaaactgttcataccactcttcgtatcgtcgattgagttctttatagtaggaatagagttcaggatcttgttctagctgttcatattcccggcctctttttttgattctcgctaacatagtttcaaaggatacacgaatataaaccagtagatctggtttcttttgtggcgaaatttcttctaactccttcagcatcgtttctaaaagaccttcatactgctttacttctacttcagaaacacgccctaaatctgcattcaaatgaaacagcatactatcttcgtagatggagcggtctagtacgttgtcatcatggctgaaagcatctttgattgccaaaaagcgtttgttcaaaaagaaaatctgtaataaaaaagtatacttttctggattagaataaaatagtggcaatacttcattatcttccacgttctcataaaaaggttttgtttctaaatcttgggcaagcatttcagtcagtgtgcttttccctgcaccgatcgttcctgcaacaatgatcacaattatcggcatccttcctgtaataaaatctgttcttcattttactacttcatttatagaaataaaagccttgactttatctgctccttaaaagctacttctctaaaagtagccaaaagtaactcctattcgtgaaaataaaggctgtgacaaaagtcttgtcgcagcccttttttcaaataaacagtattctcctgccaacacctcggtcacaagtggcaatattcataaaacatgaaaagctgttttttaacattattccttgtaactcagagctaaacgggagactcacaacctctttatgctctcaacattttatctgtttttattcttctattgtacttgatttgcgtacaactaactgccagtgcagattatgagcggtatcattgtcttctactgcgcatttcatgacacgtatcatcacactattttcatagattttttctatttttccttttattggtgattcaaataaatcagatttaaatgcatatgtttcgccgacttcaaacaattgttcattttccataagaatccctccatcaccttttataaggtcagtattttttttaacataaatcactcgaaaaagcacaaacttgtcataaaaagtacttttcgtatcaaaactgtcactttttttggtaaggttcttggaaaacgaagattttttaggaaatcatgacggttttgatgtcaaaaccactttttatgaaacaaaagacgttttttattttttttagcataaaatttgtggtggaggtacgtatgagatgaaagataaagttgtgaacaaattattagaagccttattcagcggagacaaatcggaagaagatatggtgtatgtccaagtaaaatttgccttagaagttttattgaataatcttggaaaactagcggtcgttctagtcttttctctggtgacaggctcatgggcggaaacaggaatcacctttctttcttatatctgcatccgcagatatgcttatggattgcattccgactctgaattcgtttgtctgctgtggacactactttatttatggggcgttcccttggtgatgaaacatctgcaattgactatctccttcccaatgatggtctttttgttaatcagctgctttttgttactgcttcgctatggatcaagaggtacagcaatcaatcccattgaacccgagaaacgtcccccattattaaagaaggcgatcagcatgtttctaattttttctctcattactttatttttctcagcttcttacttttctacctatttgctacttgggattgttttagaaatagctacgttgcttcctattacaaactacttgatgaattttggaggaatctttcatgaaaaaaacaatcattaaacaattaactaacttatctgacttttttgtatctggctgctgctttggtatgagttctgaattcaaaatccctgaaaaattaaaaaaataatacgctaattgtgctataatttggtaaaaatcaatgggagctgtactttatgtttttatggtccatagcgttgcaatatttgatttacacaatttgtatcttattgattgaccatcacatccgatacaaatatctgtttgcgggagtcattctgatttcttgtattttgattggatgggtctattcgattttagggatttttactgctctaattgctataggaatgctgatgcttacttttttcttcttttcgacttcgcgtcaacaattggtttacgcgcttccttttgggttattgacgtcgcttttaggagatcacttaacaagcatcggcgatttttttgttttgaaatcttcggttattgaaccaggagattcattgcagtattttcacattgccttatccgcttttttatctgctttattagctttttgttttaaaaaatcattagagacttggtttcacactgtggaccgccgtatgatcggtacgatcgggacattgatattatttacatactatatcattattttttatacccgtttttctggtgaaacacctgatgtcttagctttgaatacgagttttttcattctatatctgtgtgttggcctgatcatcttggtttattattggaaaatctctaataagaaattagctgatcagttattagagcaacaagtcaggatgcaacaggattatatcaaagatctagaaaaaaactatcaagacttgagagaattcaaacatgattaccaaaatctgcttttttctcttcacagctatatttcagaaggcgacttagaaggattacggtcttattatgatcaaacgatattacctacacgccagatgatgaacctttttccggccaatctaagtatgttggataatatgaaagttcctgagatccgtagtttactgtcattaaaactcatgatggcacaggaaaaagggttggtcgtccagcttcattttcctgagccaatcgaactggatacgaaacatacggtaaaccttgtacgtatgcttggtattatcttggacaatgcgattgaaggagctagtgctgcaaagaagaaaaaaatcgaattgaccatactcaagaagaatcattccgtgatgattcgtgtgatcaatacaacaacaaatacattgccgttaaaccagttgaaacaaaaagggttctcaacaaaaacaaatccaaaaaacgaaggccttggcttgtttatcttggatgaattgacaaagaccaatccttatcttttccttgaaacatcaattgaaaaccagcgtttttctcaaacgatttatatacaaataaaataaaggagtaatgatatgattcccatttatatttgtgaagacgatccaaaacaattagaagttttatcaacggtgatcaaaaatagaatcatgattgaaaacttagacagttatgtccatatttctacctctgatccggaagaacttcttaatgcagccaagatcagaacttcttcttttggtatttactttttagatatcgaactagaagacagtgaaatggatggtgtagcgatcggtaaattgatccgtgaattagatcctttaggaaaaataatctatgtgacttcccatacggaaatgtcgatgaaaatcttaaaaagcaacatcgaaccgactgattatatcgtcaaagaagatctttatgatttaaaagaaaatgtcgagcatatcctgagcaaaattttcgaagattttcaaatgtcccagatccaaaaagatatcttcaaaatagagtttaatgatgagatcaaatttttaccgatcaaagacatccaatatttttctacttcgctaggagcaccacacaaactggaagtccatttgactcatgcccaattacaattctatgagaagatcaaagaaatcgagaaaatgcatcggaattttatccgttgtcataaatcctatgttatcaatacacaaaatgtgcggtcgattaataaaaaaaccagagaagtcacgttggcaaacggcgagactatcccagcctctatccgtggattaaagaaattgatttcataaaaagaaccgaatagtttggaccgactaaatgaccagccgattcaaacccttcggttcttttttgcctatcagtgcaaaagcatttcctgtgcaatttcacgtccatccattgtatctggataaaatgttggccaattctccatttctttcagcaatgcttcttgactttcatttcctgcatataaatgaaaatgttcggagttagccggtgcaatcgtgtgatcactgaattgaatatatctaaacgctccactttccttatcttctgcttcgaatagataccttaccccacggtttcctgcctcgtaggtcaagatttctttccctacataacgataatttgaacgtttcgttgttccatccttaaacgtaaatgccatctctttctcactgatcttgattgaagcaatatctgtttgatagcccttcgtataatattctttatattcttgtgctgtcttatcctgattcaatttttctttatattcaaaaacaggatcaaatgtcccatcttctacatacgcatctactgtctgccaagttccttcccaatctgaaagagagcgatcttgtacatcctcgtcttcgaaataaccgttatagacgctcttttcttttttgggggtcaaagtatcttctaacgggttttctgtctctgtcgtttttttcaacgcttcgaggtttgattccatgatagaaagatagttttctccattttctatttgttcattcgtcaatccttccaaaggattcaatacttctaaagatacacctgcttcgtttgctaacgttctggcaatactatctttggcgttttcttcaaaataaatatagttgattccatgttctttaacaaagtgtttcagttcagcaattctcgccgcagacggttcttcactagaagaaagaccagcaatcgatacttgattcaatccatattctaacgctagatagttgaatgcagcatgttgcgtgacaaaagatctttgttttgcttgcttaaaggtttcttgataaagctgatggagtgcttgaagtttctcggtataggctgctgcattttttgtccatacttcctgtttttctgggtaagcttcaatcagctgatcacgtatgtttgctacctgcttgattgctaaacttggagctagccatacatgtggatctagctcatgtgtatggccttcttccccgtgttcatggtcatggtcatgtccttcttcacttcccggaagtaaaagcataccttctgtcgcttttatcgtatggacgttgccttcttgtaatgttttttggattgcggggacccatgtttccatgttttcatcattataaacaaagatatctgtatcttggatctttgccatgtctttagcagaaggttcataatcgtgggaatcagtccctgctggaatcaataactctacttctccttcatccccgacgattgcttttgtaaaatcatacatgggataaaaggtcgtcatcacgctcaatttttctttactgtcctcggctttcccacttgccccgcaagcagttaacatacctgctaaaaccagcatggccaatatacctatcaatcgtttcatttatgacactcctcttctcatcttctttcatttgaatgttccgattcgcctttcacaaaccgtaatagttacgttttagcaacaggatttaatttatcatatggttaaaagaactgtcaagcgttttcttattttaattgatgagaaagtttatatgaatgattgacgatatttttgcaatcaacctctatcattttccttttatacccgcttttgtctataatgaagttatagataaaggaggaaaaagagtgaaaaaagaaacagatacaacgaatcgtttgatccgctttttaggaggaaaaacctcttactatgttttaggaatagttatcttacttgcgctgatcatttattttttccatcagatcttgtttatattcaagcctgtcggaatcattatcgctactatcttgcccccattattgtttgcactgatcttgtattatcttttggaaccagtcatcaaacgtttgagcaagcacctttcgaggaacttgtcagtcattatcgtttatgtgattattttatttttattggggcttggaagcgtatggcttgttccttttcttgaagaacaggcaaagacattgatcagtagtttgccagatttgtttcaagattttcaagagagtctccgacaatttttggagaaaacaccttttgccgattcatttaatcaatttttcgcttctattgacgacgtgacgtctgatatagctggatttattggaaattattgggaaagtggcgcacaacggatcagcaacattttttcaactgttacagctatttttattactttatttactggtccaattgtcgcttttttccttttgagagatcctcaaaaattttatcagtcagttttagcgattgtcccaccagcatttcgtacagattttaaaaatttgacaaagattgctaatcaacaattgggttcatttctaaaggggcaaatcattgcttcatttatccttggagcagtctactgggtttgtttcttactgatcggattagaatttgctagtgttttagctatttctgctgggttgttatgtatcattccatatattgggccgtttatcgccttctttccaggtttgatcattgcattccaagactctacttttatggctgtcaaatttgtcattgtctggtttgccgtacaacttctccacggtgacttggtgattcctcgagtaatgggtgatcgtttacagatccatccgattacgatcttaatcgttttacttgtcatgggtgatctaatgggaattgtgggcgttatttttggtattcctatctatacgttagtcaaattactcgttacttttattttccgtaaattcaaacaacgctacaataaattttatggcgataaaggagagtatgaaaactcttcattttctgaagaagattattttaaataaaacacaaaacgtcgatcttacgagaatagctcgtaggaacgacgctttgtgtttttgttttaatttttcagcaaagcaattgcctggtatggttttagctccagactttgatgaagaacagtatcggaataattatcgataagaatattggcttctgtgaatccttctgggatggcgatccttgtatctttatcatagaaatttgttaatacaagtagctgctgtccttcaaattggcgaagaaagccataaacttccggatgatttgcttcataagcatgataatctccttgtgcaacgattggatatgtttttctcagccgaatcaatttcttgtaataggacaaaatagaatcttcagaagatagttctttttctacattaatctcttctagcttgcctccaacttttaaccaaggtttccctgtagtaaatcctgcttgttctgtgtctgaccattgcatgggtgttcgagagttatcgcgagattttgctttgatccgacgaaacgcttctttttctgtgaatccttgttcaaggagtaacttataagcattcaaactttctacgtcaatatagtcggaaatcgatgaatagtctgggtcgatcatgccgacttcttctcccatataaatatagggcgtcccacggttcaaatggatcatggttgctagcatctctgctccttgttttcgatactgatcgatagctacaaatcgattgagcgcacgtggctgatcatgattattaaaaaatagagcattccagccgttaccctcactcatcttttctccccatgtatgaaatagtcgctttaattctgcaaaatcaaatggaggagtagaccatttattcccattttcataatcgactttcaaatgatggaaattaaagaccattgataattcttctctactaggttctgtatacaagatacaattttcgatcgtcgtagagctcatttcaccgactgtgatgatagtggaatccgtcccaaacgttgcttggttcaattcttttagatacgtatgggtgattggtttgtccgtatattcaggtttgccatcattttctttattatttttcaattgttcgtctttaccgataacattgataacatcgaaacggaatccttttacccctttttccatccaaaaacgaacaactttgaatagttcctctcttactgcttggttccgccagttcaagtcagcttgtgtccgatcatataagtgcaaataatatttccccgtatctccaaatggcgaccaagcacttccaccaaattttgatacccaatccgttggctcttctcttaaaatgaagaagtcctgataatgctggtcccctgctagtgcttttttgaaccattcatgttctgtcgaaacgtgattcagcaccatatcgagcatgatttctatccggtatttctttgcttcggctattagctgttcgaattcctccatcgtaccaaagataggatcgatggctgtgtaatcagagatatcataaccgttgtctttttgagggcttggataaatagggtttagccaaatcatgtcgatgcctagatcattcagatacgggagtttttctttgattccttttaaatctccaattccatcaccattactgtctttgtaagatttgggatagatttggtaaatgactttgtctttaaatgtcatggatatttacctccattcaactgatttattacctaccacaacttatatatacaagttatcatttattattataactgaaccgaaagcgtttgtaaaatttatctttatacattctaagaggtctgttgcccaataaaaaacaagagatcagacatgtatttgtctatcctcttgtttaaaatagcaaaatattcttgtttcttctataaatggtgctcaaaagcttttatctacggcaatcagtcttctcaaatgtaaaacatgaggagctaattttatttgagtattctttttgctcgatgcaggacggcttttttacaacctctgattcatgatgttcaattagcagctgaccctcggtattagctcaaaacgctgatttcacaacctctgtttttattcattcgatttcaacgcatcaatcatatcgatatgctttaatttgaaatgggtaacaatcatcacaataaccgtaaatacgatagttaatcctgctgataagacataagcccaccatgtgatcactaatggaaagatgacattctccatagacgcttgttgcaagatgaagtcagtcaatatatatcctacaccaaatcctccgatgattcctaaaagagtaaagatgatattttctcgaacaatgtacatcgtgacttctttatcaaaaaatccaaggacttttattgtagataattcgcgtacacgctcggaaatattgatattagttagattatacaagacgataaaagccagcagtcctgataatacgacaaagattaagacaaccgagtctaagttcgccattgattcttcttgcgtttcgatttgtttggacatgaaagacgtatttgtcacagcgtctgtggcaagcagtttctcggaaagcatttcttcttcttttgttgtcatcttatctgtacgcagcaaaaatgcattatccatcatcgattgatcagtaactgaagcataatattcaggggacatataaataaagctacctagatagtttttcacgatttcttttacttcgactttccattctttttgatcttcatcataaagcgaaatatgatctcctgtagataagtcaaatagttctgctgctttttgcgtaatagcgattcctgttttaggcaaggagcgtgggttctcttcaagatcagttaaatggataaaacgatccaaatcagctgttttacttggtacgatcactgtcagactttgcgaagcatgtcctttttttctcaattctacggtttgagtatgaatagctaggatctcatttactttttcttgcttctgcagcatatccgctgctttttgacgactatcttccgtggatgaatccaatgtaacgattgcttgatagtcaatgatcggtccaaattgtttggctgaaacagaacttagagaatctttcaatcccacgcctgcaaccatcagcccggcacatccagcaattccgataatcgccataagcattcttgacttatatcggaagagatttcggtaactgattttttgattaaagctaaggcgtgaccacagcggagtgatgtattcaagaaaaatgcgtttccctggcttcggtgctttcggttgaagcaatgcagcaggccgttctcttaaatctttgaataaaacgatcattgcagcgccaaatgcggcaatgaagaatgcggcagctgcttgtaaaatcggcggccagtcataaaaaataagcgcactcccaatatcataccgctcgttagacagctcaaaaatgatccttggcaaaagattcgttcctaatatcgttcctaaaacaatgcctatccctgaggctagacttgcatagattgcatatttttttgcgatttcaactttcgtataacctaacgcctttaatgtcccgatttccctacggttttcttctaccatacgtgtcattgtcgtaaaggtgatcaatgcagcaataaagaaaaagaaaacaggaaaaacattggcaatcgcagcgatacgatcagacagatcaccaaattcttgaaaaccgacattttctgaacgttcattgtataggtatgatggtttagttaaattttcaattttttctgcatttcgattcaattcttcctctgcagaggccagttcacgttctttctcaactaattgcctttcttgttcagcaagttgagcttcttgttgagataatgtttgaacagcgattgttcgttgcgcttcaggaagctgctggatagctgctgactgttgcgctaactgttttttagcatcttctaactgtgttcttccctgtgctatttgtgctttgccttctgttattttttgctgtgctggttctaattcttcgttggccgattttttcagctcttctaagcgttcttcgggtcgatcttgtaaatacttttctgccttttcttgattgtgttccattttatctttgtaagctttgctgtacgtattcaaattctttacgtttgtaaaatcaagatataagacagaataaatatctgttttaaaaacggattcaggtaaatagacaaaataatcaacgctaccatttccgacgttcgcgtatcctctctccaaattgttgatgaacaatggagaacggacaaagcccgtgatggtatactctttttctttcaattcatctgaatcaatctgataaatatcaccgattttatacccttcatcttccgctttttcatccaatacaagctggtttggtttttccgggagttttccatcagttaattgtagcttgttctgcttgttatttttgttataagaaaatatttgaatcacttcgtttttgccagtattggaataatagatctgttttcctgtttctacttttgcatctgggatcttttctgcttgagcaatatctttttgtgtcaagccaccagtagaaacgatttgcaaatcagaaagtcctgctgtaccaacatagtgatccatcgttttttgcatgacaggtccagcagttttgacacctacaaataaaagtgttcctagcatgacaataaggatgattgcaatgaatcgtcctttagattgccgaatttcgcgaaaacctgctttaagatatgttcttgttttcataaaatccccctaccatacaatctcatcaatggatgaaggatgatcatttaattcaacagaccttactttagcatcattaatgtgaatgactctatcagcgatgggcgctaaagcagaattatgtgtaatgatcaaaacggtattgccgtgttgtctgctagcgttttgcaataatttcaatacttgcttgcccgtttcaaaatccagcgcgcctgtcggttcatcacataaaagaagtttgggatttttagctagtgcacgagcaattgaaaccctttgctgttcgcctcctgataattgggacggaaagttattcaatcgatgagctaggcccacttgcctcaatacctctacaggatcaagcgcatcaggagaaacttccgttgccaattccacattttcttttgctgttagattaggaacgagattgtagaattggaaaacgaaccctacatctgttcgtcggtaagcagtaagctgtttatctgaaaattgcgcaatatctgtgtcatcaataatgatctgaccttcatcaggtgtatccatcccacctaaaatattaagaatcgttgactttcctgctccacttggaccaagtataatcactaattcgcctttttcaattgaaaaagaaatatcgtcatttgctgtaatggtcgtttctcccattttgtatcgtttgtattcattttttacttcgacatacttcactctgattcctccattttcacgatatttctcgctatatctatgcatcgaatgcgttttctcacacttatttattttaccactgaatttccctagactaaagaaaggaatcctttatttagttgacaaataaacgatttatgatttacttacataaaaaacattgttatttgaaagaaggaacatcatgaatgatttaaaggaaaatatgatttttgatttatcaaaaactgcttttgtcgcgatcgacatgcaaaaagggatcgtaaataacggtacactctctccacacactgcagcatctattctgacaaacaatgatttgttagtaagaacattgaaacgtactgctgccttgaaagttttagtgaacgtagacatctccactttcccttatttgagtcaacaaactgatatgggtggaatgactgcttctgtacctccagaattcactgacttgttgttgaaggattccttgaaagatacaaacaatatgttgactatcacaaaatacaatccaagtgccttttttggtacttctcttgatcttcaacttcgccggcgtggaatcgaaactatcattttaagcggtgtagcgacaacaaacggtgtatatgctactgcattagatgcctttcaacatgggtatcatgtcgtacttgctgaagatgcttgcagtgatcgtgacaaagaatcccatcaattgttcataaaaaagatatttccgaaaactgcacgagtacgctcaacgaaacaaataatcgaagctatccaacaaagcaaataagtactggcacacgtgattttcatttacttctttttgatttcatgggaaaataaccacaggatttagataggagtatgaacatggtgaaaaaaaagatcacaatcaaagaagtcgctaaactttccggcgtttcaatcacaactgtctccttgatattaaatggaaatacggagaaattcagtccgaaaactgttcagaaagttttagctgccaaagaagaattaggctatcagcctgactattttgctagacaaatgattaccaaggaaacgaaaacaattggtgtactcgttcctgatatcacgaatccattcttcagtacactgatgcgaggaattgaggatatcttgtataagcagaatttcgtcacgatattatgtaatgctgattctgatcatcaaaaagaaatcgaatatctagccgagctcacacgtcgaggtgtggatggattcattatcgcgacttctgctgtctctacagatgcaatcaacgaaaatttgaaaaaacaaggccggcccttcattgttttggatcagaaaaaatctgaaggatttagtgatgccgtacgaacagacgattttcgcggtggttacctagcgggcatgcacttgcttagtctaggacatcaaacgatcgcccttgtctatccagaaaatccgccggaaaatgtccacgctcggattgaggggtttaaatctgctcttgatgtttaccaaatccctcacgaccaactgatcctcttacctacacagttctcaaaacaaggtggctaccaaatcacagcagaacttcttgattctgctgcaactggtgtgtttgctttaaatgatgaattagcttttggattatatcgcggattagaggaatctggaaaaagcatccctgaagactacagcattattggctatgataatatagatatgtgcgagtatatcaagccgaaactgacaacgatcgcacaaccaatcttcgaattgggacaaacatctgccaaattattgttagatcggatccaattcccagaaaaagaatgggaagaaaaaagattacctgtacgattagaaaaaagattttcaactgcacccttgaaatagctttcaaggtgtgctatatttttatcgaactattaaaacgttttactaaaacgttttaaaaaataatttttcccatcaaaataaatgagatagttggaggtttgtaaaatgaacacggttacagtaattggaagtattaatatggacactacccttcgtttaaccaacatgcccaagccaggcgaaacaatgcatgcgcatgagatttttcacgctggcggaggtaaaggtgccaatcaagcagtggcagccaaacgttcaggcgcacggacatcttttattggaggcgttggggctgacagcgaaggacaacagttattagatctactgacaaaagaaaacatcgatacatctgggatagctgaaatccaaggcgccacaaccggacaagcaatgattatggtagacgcagcaggagaaaatagtatcttgatccatgcaggtgcaaataatgctttccatgaacaagaagtcctaaaaaacaagcaactgattacaaacagtgactttattattgctcagtttgaaagtagcttagatgcgacgatcctagctttttctattgcaaaagacgcaggaaaaacaacgatcctgaatcctgcaccagctcgtgaaacgatccctactgaactacttgaaaaaacagatatcattataccaaatgaaacagaaacagaaatcattacaggaatcagagtgacagatcataacagtttggtcgcagcagccgaaaaactccatgaattaggtattggaacagtaatcattacactaggcagtgccggcgctttctatcatacagaaaaagaacacggtatcgtccctgcttttaaagtggatgccgttgacacaacagccgcaggtgatacatttattggcgcattaagcagcacacttcagccagaccttagtaacttgaaagaagcgatcctttatggaaatctagcctcttctgttgctgtgcagtcttatggtgcgcaaccttctatcccttaccgcgaagctttagaacaatcagcagtctaaaattaacaatgagaggaagaaacaaacatgaaaaaaggaaaagtaatcaattcagatatttcacgagtaatcgcacaaatggggcactttgataaattaagtatcggggatgcaggcatgcctgtcccctttggtactgaaaaaatagatttggctgtctcaaacggtcttccaagctttttatctgttttagaaaacgttttagaagaacttgaggtacaatcgattgaattggcggaagaaataaagacaatgaacccggaaatattggaaaaaatcaaattattgttaccagatacaccgattagctttatcccacatgaagaaatgaaaaaagagttgaataactgtcatgcatttattcgtacaggcgaaatgacaccttacgccaatattatattagtgagtggagtggtcttctaatggaaacgacaatgaatcctgaacagatggtactgtccgagcagattcatatgctgattgaacagttgggaggaaaagacaatattgattctgtccttccatgtgcgactcggcttcgtatcaaattgaaaaaacagccagtagccaatgcagaaaaattaaaacagcaaatcccttccattaagtatttcattttactcgatagatatgcagaaataatcatggatcagggattggctcctgcttacaaggaattaacgcgtcaaatcgatcattcagctcctaaagaaaagctaaatccgatcgaaaaactatttggtttgatatcggaaatctttacgccgatcattccgctgtttgccggttctggtatattaaaaggtctggttgttttagcgactacgattggctggcttagtgaaacaagcggaacttatcatattttgtctgctgcgtcgaatgccgtcttttattttctgccaatctttcttgctttttctgccgccaaaacgtttaaagtgaatggatatattgcggctgtcattgctgcagcactgattgaaccgaatctgacctctttactttcagacagtggcaaagcagctactgattttctggggattcctgtagtactgatgcagtatacgtctactgtcatgccggcgattttaggtattttcttttattcttttgttgaaaaattcctcaaaaaatatattcgcgataatatgcaattagtatttgtacctttactttcattagttatcacggttcctttgacgttaatggtattcgggcctgcgggtgtttaccttggcgaaggtttagctgccgcaattacttggatgatggatattaacggaccgatcagcggcgcaatcatcgctggtggttggaatattttggtaatatttggtatccaatgggctgtaaaccctgtcatgatcagtaatatctctgcttatgggttcgaccgaatcgttccgttgacaggagcagccaattttggaatggctggtgcagctttaggtgtatttctacgaagtaaacgttcaaaaactcgttcgatctccggttctgcttttgcttcgattttacttgcgggagtgaccgaaccaactgtttacggaattgcgatcccattgaaaaaaccatttgttgctgcttgcattggtgcagctgctggtggagctgtaatgggatttgcccaagtgaaagcgatcgcttttgtatttggtagtctgaccacattgcctgcattcatttccggtacttttttctggtacttagcaggactggctgttagtctagtcgtagcaatgattactactctcgttagcgggtttgatgaagacctaatgtcttatgaatagttaatgaaaaagactgaagtatgagatgtttatcacatatttcagtctttttctttttaggatcattatttttataaatttttgtgatactttccaaactttggtataatttacatatgcataaccatttttatccccacttgtttatccccaaacaaaggtggtctatgcaataaaatgaacgtcaatgaaaaacgaatgaatgctcgttgcttatttacaaattgttttatttagaatatacagacagatttatgaaaagaaaaagcttttcgacacgattatctgttccaaaaaatgtctaatgaatgctgaataagacagaaaatcaatgaaaggaaaaggactagtttattatgaaaaataaaaaaacgatacgtttgctagctgctacttggctgattgctccgtctgttttgtcgaccaataccgtatttgccgtagataatcaaacagctgatcaaacagtcacaacagatacgactacatccagctcagctactagtgaaacaacggattcttttacagaagacccaactggaacaactaactcaacaacaggatcgaccgagccaactgaaattgatccggctgatccatcagaaaatgaaaagccagccgagacatattcccttacaattgctccttctttgattggtaagatccaactgactgcttcgacagcggattcccctgaacagcaacctttggatattacggaaagtggaacggtagaaggtttattagcggaaacgaaggtaacttacactattacgccagctgaaggtgaacaaattgcttcagtcgctgttaatggtgccaaagaagtaaattatgatgcaaagaccttcacagtaggtacgaacaatttatctattactgcagaatttgaacctgtaccggatacttcaacagagaaaccaactgatcctagtgaagaagtccctagtacaccagatccggaaacgccaaacaaaccagatgtgggtaataacaataataacaacaataataatggttcaaataattcaaacaataataacaataattcgaacagcgggaattcttcgaatcaaacaaacccatctggatcgaataacaatggaaatactcagagagaaccaaaccatccaaacaatggttcatcgaatggcggaacgaacaatgcttcatctcgtccaaatacagcaaatcaaagcggtatagagaatccatcttctgcttcttctgattttgttgtaaaatcaccaattgatgctgtattgcctacaaatacaacgaatgtccaacaagcaatcgttcgagaagcattcaagcatcttggaaaaccatatgtatggggagcaaaaggtccaaatacttttgactgttctggtttgacttattacgtatatatgaaagcaaccggtcattatatcggtggctggacaggcgaacagcaatatgcaggtacgcagattccagtaagtcaggcccagcctggtgatctcgtcttctggggaccttcttctggtgttacccaccacgtaggtatctatattgggaacggacaatttatccatgcgccccaaccaggagataaagttcgagtaacttctatttcagatttcacgcctgattttgctgtccgagtaaacttagcaggtttacctgctgcttcaggctcgctaactggttcatctattttagatggattagatggctcgttccatttcagtcaaaaccaaacaactgatcagttcttgaaaaagattgcagatgatgcacaggaaatcgggcaaaaagaaggaatctacgcatcagtcatgatggctcaagctatccttgaaagtggatctggaaacagcttattatcaagcgaaccaaatcataacctttttggtatcaaaggatcatataaaggaagcagcgtgaccttcaatacacttgaacaagatagttccggacaaagctaccaaatccgcgcacaattccgtaaatatccttcttacaaggaaagtttggaagactatgccgacttgatcaaaaatggactgactggtaatcctgatttctacaaaccatcttggaagtcggaaacaaaagactacagagaagcaaccaaatatttggaaggacgttatgctacagatcgccaatattcacaaaaattgaacgcgatcatcgaagcgtacgacctgacaaaatatgatgaaccaaaaaaagaagcagcaacaactgaagaagcaaacgctgaaatcctcaatatgtctaagcgattcgatgtgccaatcaaatggacaacagatggcgtgccaatcacaggattagaattttcaacgataaaacgcgtcaacaacgcttcttccatcttccgtgtcgcttcaatctgggatttgtggaacaattttacggcaagacagataccagaaacaactactcgtacagttaaagctgcaactgttcctgtactaaccttgttaagtttagacaaatcattctggcttgatctgcctttaaagaaatagaataaattaaaaaggggatgtgacactgtcacactccctttttaatttattctatttctttatatttattttgtattccgttacaaactcgcgtacttggttaggttccagagtgacatctccaaaactttcaagtcgctccgctcctggcagttcttgagtctcaaatgtgataccgccatgatttactaatttattcccgcgcatttccggtccatcttctccaaaatttgctgtaaaaatcacgattcctgaagcatctgtttttacttggatcgatactttttcatctgggcttgtcaattccgcagcatttagtaaaccagattgttttttcaacaaaaatggatgatcgataccgcccactatcattgattggcgaaaatcactggcaaagacctcacctaattttttaggacgttggaagtcaaatgctgtgccacttactgaaactacttcttctgtaggcgttgtatctttattgagcgtagcaaataatcggctattcaaccaaagtatatgttcgtcgattgactgtgctggatcaccggttaaattgaaatagacatgatttgtaggattgaatactgttttgcggtcactgatcccttggaccgtcactcgccatgtatcatcgttcgtcagcgtataccgtacttctacatctaaagttccaggaaatccgttttccatgtctgggctagtctgatagaaaatgaccgatgcttcgttttcaccattgatgactgtataatgccactgcttggcttcaaagctaggtgcaccaccatgtaaacaatgaccagtgtccgggtctgtttttacttcgaacgtttcatcatctaatttgaatgtgccattcgtaatccgtccagccatacgtccgattgaagcaccgatataagggtctttttctagatattcttttgcttcatcaaaacctaagatcaactctcgtttttcattatcgattattgtttgaaaatgaacaacccgtgccccaagatcactgacagacaaagatgtcccattttgattcgtgatcgtaatcaagtgatagttttcgccaaaattttgttcattgatttccatgttccttgcaccctcttttctttcatttgcactgattccagtatacatggaaaccgttttcttaacagcttattccgtgagtaacgagaaaaaatttactatattctaataaaagaccgtgaaaaaaaggttgtgacaaaaatattgtcacaacctctttttccgaacaaacggtgttcaaaagcttgcatccgcggtaataagcccaaccaaacgaaaaatatgaggagctatttttgcttggctgttcttattacttgatgcaggacagctttttcacaatctctttttcaatacgattccagtatataaccatgtcgtcagtacatagtagatgaaatacaatacgaagaagatcgtaaacggaacccaaatatctttgtatggattttgcatgaatagatcaaacatttgtaatccgaataagacatggactacacctaagattcctggtgctaagaataacacgcctacttctctacggatcgattgtttaagcaacccgcgtcgtgttcctatcttttcaagcatttcataacgagcaatgtcactcttgcttcctgacaagatcttgaacatcaaacagctagcaagcatggtcaagaaagctaaacctaggaagaatcccataaattcaaaaccagagaatagaccattatacacttcatacatttcatatttctggttgctgtactctactttttgcaaagatggattgttcattttattttgagcaacaagtgtttcgattggtttcaggtttgcttggaagtcttttacctgaactagctgtaaagtggattgtggcaagttcagttgatcaaattctgattgactgactaccttgatttctttttcttgctgttccggcaattcatagcttcgaagttcctcttgtacagtcagttcattcattttttcagcaggaactttttctttcgtgatcttcggcggtgttccatcttcatgttttatcatgatcaatggttgagccgcaaattcacttgcattatagtaaatcgttcccgcatcttctttttgagtataagaagcagaaagtgttggtgaaagttctttgattttttgctgatcttctgcccgaggattattcatcactagatcatatccagaattgttttctgtcaagtctgcaatttcatttttaaaacctaatcctaccgtcaaagcgcccagtgccaaggcaaacagcatagcgaccattgagagcatttgtgtatattcacgaatacgaaagtttaactgtgacaatgtgaaattgttcaattttttcaatgaaatctgttctgatttctttagtaatgataaaaagaaaatgatcacagaatggaaaatgaaataagttcctaatacgatcgtaactaaggctactcctataccaaagacttgataggtccccacgtgtttcatcatatagtaaccgcagcctagaaaagcaattcccagtactacttcaaggaaaaacaagaatttatgctgcttgattcttgttggtgtctgatccgcacgaatcaatgctaatatcggttttttgacaatcgaaaaagcattgacaacagcagctaataaaaacaaaacagcaaaaaacaaaacagtgatcaacaacccgtgaatactaaaaggtgtaaaatgcgaaatattgagatctaactgatccactaataatcggtggacgatacttgtcaatcctacaccgacagctgaacccactaaagtagctgcgatccctactaagaatgtttcagaaaaaatcatctgtgcgatttttctgccttttgctcctagcatcataaacattgcatagtctttttgccgcatcgtcatcaaaaaggaatttgcatataaaatataaacgaatgtgatgatccctagtaaaacagaaccgaatcggaaaatgataactgtagccgcaacgatcgtattacttttcaaaaaagcttcgttgcttgccattgattcaaacatgtaaaaaatagcagatgccataactaatcctgagaataacaccaagtagtctcttaaacggctcttgatcccagtaagtgataatttccaaagcatagtcaatctccccctactgttccaagtttccaagaatagatagtatttctcgatagaaggaatcacggctttgatctccacgtttcacttcttgatggataccgccatccttgatgaataaaatacgttggcaataacttgcagaaaacggatcatgcgtcacaagaagaatcgatacatgatcttttgtattcaattcatccatcgtatctaaaagatcccgggcacttttggaatccagcgcacctgtaggctcatcccctaatagaatcgttggttgtgtgatcaatgcacgtgcggcggcgacccgttgtttttgtccaccggaaatctcagaaggatagctttccaaaatatgagagatggataaacgttctgcaattttttggacacgttgcttgatttcttttggtctgacgccttgtaaagaaagaggaacagcgatattttcttgtgctgtcaagctttctaataaattgaaatcttggaaaataaagccaatctcattcgcacgaaaatctgctagttgatttccttttaatgtggtcacatctttttgattgattcggatatgcccatctgttggtttatctaatgtggataaaatattcaaaagtgtcgatttaccagaaccagaagcgcccatgatcccaataaattcgcctttttctacatcgaagctgatgccgcttaatgcttgcgtctttttctcattgttttttccgtatacttttgttacattctgtacttcgactattttgttcatttctttccctaccctttaattagtttttccagtgctgttttcggcacgtcttttttttcgacttcttcatacgaagtgacacctttatttttgttccaggtgatttttaaatatgctcctttacgaagcggtcgagtcaattgtcccttgaagtccagttctttttccttaccctctttcgtatagccaggcaggatatatctatagttgactgtttcttgtccagagtctgactttgaaactgtttttgtaccatctgtcgtaatttgtacatagtattcttctccacccataactacgtaatctgagattttcacccctgcaagtaccacaacgatgaaaacaagtagaccgatcagaagttttttcactttttccccttctctcttactttatatactgattatagaaaaaagcgaacaattctgccttcgaatcaactatcattcttctttcaattttgtcattttctttaaaacaactaaaaaaagagttcaagacaataatccgtcctaaactccttcttcctatcttacaaaaagtatgtcacttacggtctttcatgtcgcctgtattgataacaggttgcgttcctttgtctgtaatgattgagacaagtaaattattgatcaattggactttccgatcatcggtgaaattgatttcttgtccatcttcgatttgctctaaggccatttgagtgattgtgacagctccttcaacaatggtttgtcgagcagacaaaatggcttttgcttgttgacgttggagcatggcactagcgatttctgttgcataggctaaatggttcaagcgtgtttcgattacttcgacacctgctactgctaaacgctcttgcagctctttttgcaactcgtcagacactgccgtcgtgtttcctcgaagcgtcaaatcattctcattgaatgtatcatacgggtattggctagcgatatgccgaatggctgtctcactttggatttctacaaaatcttgataatacgctacatcgaataatgcctttgctgtatcaacgactttaaagactactactgctgagatttcgatggggtttccatccaaatcattgacttttaaaacagaactattgaaattccgaactttcaacgaaacagtcattttttgtgccaaaggtatcgtaaggaaaaagccattttctcgaatcgtacctaaatattgtccaaaaaacaaaattacttttgcttgattaggactgactacagttgccgaacttaacaacaataacgtgatcaaccaaagaaaaatacttaaaaaaagtgcccaaactttcgcttgccacatgcctaaatagaagaaaaacaatccaactaaagctaatacgaccaatccgacaatccctgcatagccattgatataaaatgctcttttttctctcatgctacttcctgcgctcctttatccttcaataaatatctaatgttacttttttaatttttttttcgaatacgcgccattacaccttctagttctaactctttgtcttcagtgatgtaccaaccgcttgcctgtgtccctccggctgcctgcggtaaataatccaattttgttcgaacccagtgcttttcttctgtaaaatagtcttctaccaagatctctagatccatccctgctgaaagaggcaaatcttcccgaacagatttaaagataaatcgttccttcttcccatcatacttcaatattcctgtatcgataatcggtaaagaataataatccagctctttcttcaccgtcaataaatgtttgaaaacttcatggtatacttgctctaattgacgaccttctgaattgttcgggtaattaaccatcactttttctttgtctggatcatagaaggtttggcttagttgagtgatataagtatgtaatctttccatttctgtctttaacttttctctttgaccttcttctaccttcatatactctttcaccctgttttctttttagatattttctttcttattttactatagttatgtgcgttaagcgatgaaaaacagcaaagattggaaggatctttgctgttttttcttaaaatatccagttgagtacaggatcaatctgtttcattgtcctcttgatccgtcgtaatattgatcgatgtgtctttagcagtgatctttagctttttctgtccttgttctaacaaagtatttgttattggctggtagtctttttcaatataagattcaccagacgtttggatagtatagccactgttttccatctcatgcaaagataaattaccaccgtttaggatgacttttccttctttgctgatcaaactgtcttctagatggaagttgctgttttcacctgtgacgatcaagttatccacattggcctcatctagtcgaagtgagcctaattcatctttcgcagttattgttcctcctgtaaattcattgaacgatacccagccatcatgtgtcttagtattcacttttttgattgatacttcgttgatatcaattgcactattattcccttcgattgtcaattcagataattcatgatctgcagggacaacaatagtgatttgtgcacttgtgtcttctaaactaatgattgcacctgttgattttttgactgcattcacagtcaacacgccatttttctcctttatttctggcttttctgtcttatcataagtcgtttttatctcaaaatccaatccgcgtatgaccgaaactgtttgattttctgcatggatgacgattttgtttgcatccttgattttttttgtctcagtaaccatatcgatcaaccgaggaccattatcccaagtcagacttttttgagcgcctaatgtataagttgcacctgctaggaggccaccagtaagcatcagaccaataccggtaatcaaaaaatgtttcaatctcaatttatgtgtcctccttcaaacgcccgctgaatgcagttctctttttgtaataaaacgtcgtcccatccatttaacaaagttcatcatgacataaaaaagcccttttgttcctttcagcaacagtggcgaaataaatactgcgcttcctgtggcgaacagaccgacaccgataaagaataatccactcagaatcgattgtccaaacacacttattcctgatatgatcatgaataggccaacacctaagatactgatacataaaacatagatactaaaaatgagcgctagtaaagcaaccaatagtcccccaataaccaatataaaccccagtgctagtggaatgaggacaggagaagcaaataaaccgataatgattaaccaaatcaggcgaatttgtctttttggatttttcactaactcgttttctgcttgttcttcttctgaaaagtaactgatttttaattttaaggcaaactgctttggtgtaccatattcatcaatgatctgatctaatgtttttccagaatctaaaaaatattcctcataatactggatcaaatcaaaacgatcgtcttcaggaatttcttgaagatgatccacaacttcattcaaatattcattcatttgtgctctcctccaataaccggtctaaagaatctcgaaaaacaatccattcatcaataatttcttctaaatgacgacttcccattggtgtcaacgagtaatatcgacggtttctgccttcaaaaggttcatcataggtctcaagatatccttcttttttcaatcttctcaaaaccggatatagtgtagattcactgacagagagactttcttgtacgatttttgttaaggcatacccatacatatcttccttgcttaatgctgctagcacagtaccatcaagaagaacagttggaatctggatgtgcattacgtcaccttctattctcaagtgtaatatttcatttcaatctatattatacaacatataatatagtttcaaaatcagtttgtcaaatacaaaaaaactgactaaaagatttgatcctttttagtcagcaaaaaaatggcttctctttgatttttattataacagtggcataatccaatttgtccacatccagctcagtggcatgataacgatcattgcaggtatcatgtcagctactgggaacattttcacgttgatcattctaaaaccggtagtgaccatcaagaatccgccgcaagctttaaaatctaagatcatgtctggtgtagtcaatggataaataaattttgccaataagaacaaaatataaaaaataatgaattggggaattgctatcacagaaacgacataccctaaattacacgcaaaaatagctgctgtgaaaaaatcaaggacagatttagaaatcaaaatcgtactgtctcctgtcatcccagaatctaaacttccatagatccccgtaccacttgcacaaaatagaacaatgaccgtcactaatgtactgataaattcatcgtgggtcataccaagcttttcactagggaagattttagaaataggtacttgcatcagcgcagcccccttatttatcccattacctaaatgaacaatcagaccaatcgctgttcctatcactaaagcaaaaataacagccggcatatttttcatcggcgcaatggaatagattcccatccccatcgaacacacaccaaaaaccatcgtcagctgtgctttaaaatgttcacttaatttatttcctactaatccgccaattagtccgccaagcaaaacggaacctacattgatcaaaactccagttggcatcaaaaaactcctctctttttctacgaagcgaaaaaaatcagaaaaatttctgtaattattgctttcgctgcaagaaagattgtaccagacagagtaggttacaccaattcattttttgtgttaaagtattctttattggaataagtaggaggaatatgatggatatccataaatttgaagtttttcttgatttagccgaaacaatgaatttcaccaaaactgctgaacgacaattcaccacccaaggaaacatttctaaacagattctttcgttagaaacagaactagacgtcaaattattcgaacgtgcccatagaaaaatcgagttgaccgaagctggaagcttgttgctcccttatgtaaaaaatgtcgtagaacaataccatgccatgcaagaagtgcttgaaacctatacgcaagaaaacaatctttcattaaatatcttaacgataccaaccatgatcaattaccaaggcttttccaaaattaccgaatttttgaaacgccatcctgaatttacagtccagttgaaagaagtggaaagtgtcgaattaacttacaatgacgccaatgaacatagtgacacgatccactttgccagaagctttcaggccccgccgagttcgattgagtggttgcctactgaaacagacgattttgtagcagttctacctaaaaatcatcctttagctagtaaaaagaaattggatctaagcgaactgaaaaaggagaactttttgctccttggccccactacgaacttgtatcaacctgtgctggacttgtgtcgcgaagctggatttgaaccgagaatctcttataaaggatcaaggatcgacttgatcatcaatatgattgcaaatgacatggggattgctattgttatggaaaaaacagtcaaaaatctgttaaaagaaaatactgtgatcctccccatctctccaacaaaagaaagttatctcgcatttacgcgtaaaatcggtgaacattctttggcttcagacacattttgggagtatttgagacaagaagagaactaagcccttcattttctatctatccatcaaaaaagagagcgactcatgactttcgctctctttcttgcatcatgtccttgtttcaatgacacctctaacatttctcgtagttcaataagaaagcagcgatttttatgccaaaagaaccgtaagaacatttccctaatcacaaaaaaacgactaaaaacccctaaaaaccttcaatagaatttttaggggttttattctttttcctattgtttacttaaccgtatcattgctgtcgttcctactccttcgatactactataatcaatacgtccatcatgcagttctagaatttttttaaccagtgaaagtcctagcccattcccagaaatttgacgacttgtatctccttgataaaatttttcaaacattcgatctctggtctcttcattcattcctacacctgaatcggtcacttccagtacaatctctgtggctgtctcaaatagtttgatatgaatctgtccattgatttgattgtactttatggcgttatccatgatattcaaccacacttggtacaaaaactcttcattgcctgtgtaatttactgcagcaagttcgatatccaattctagctgttctttctcccatttaggctgcaaaaaaacgattacttctcgaatttgttctcatctaatcggtactctttcttttccagttggatacgctggttttccagtttgttcaattttaagatgttctctgttaattgtgaaagctgcgtgatactttcgataatccgatataaaaatatttggcgttcttcgtcagagagatttggggcttgtaacaattgtacatatccttggatcgttgctaatggtgtttgaattcatgggatacactggacacaaaatcattcctcaatgtttcgatactattgagttcttggaccataacattgaaatctttatacagttgctgtacttctgctactttctgctgttcatccattcgaatcgaaaaatctcccgttgctaccagactcatatttgtccctagcgcactgattggatgcaggatacgccgcccaacaaaaatcgatattcctgtacccacgaccatactgaaccccgcaaagacgaataacgggtataacgttggttttccagccgattcagcaggcgagatagaatgtcgagacaataagaaaataaaaccaagaaaacacagcagtgttactaagatcgaaataaatacgatactagcaaaatagatccataattgtgaaaatagcttctttttcatctttaaataaccgccttatagcctagtccccgtactgtgatgatttgaaaatcttctgtcttttcaaaacgggtccttaaacgtttgatatgtacatcgatcgttcgttcttctgtattcgtgtctaatccccaaatatcgtccatcaactgctggcgagtgaaaatcttgtttggataagacagtaatttatacagaagcagaaattctttttgaggcagaataaaagaatgctgattttgtaccacagtataagtatccagctctaattttgtttgcccaatcgtcaagatactgctgtaattgatttttgaacgtcgaagcaatgcttccacacgcaggatcatttcattgacatcgatgggttttgtcatataatcatctgcacctaatttgaacccacgtttcttgtcctcgaaatcagcctttgctgtaatcatcagaactggcatgtcgaatctggcgttacgtaatgatcctaccaagtcatagccatccatttcaggcatcatgacatctgtaatgatcaattctatatgtgtcgcttctagttttttcagcgcatcctctccattcagtgcggtgatgactgaaaagcccgctcgttccaacacagaacggtaaagcaactgtaattgcggatcatcttctactactaaaatacgattcattgatctccctctgttttttgaaaaatttctagattttttcttgtagttcatcttcagttaatatttatttcgtatactacgatcattgttctgatatacttattagtataccgaatatttcaatacgggagaagggtgattatgcttcaattaaaagatataaaaaaatattataaagtcggcgaaaccaccaccaaagcattggatggtgtgtctgtcgctttcagacaaaaagaattcgtagcaattttaggtcctagtggttctggtaaaacgactatgctgaatgtgattggtggactagataattatgattccggtgatatggtaatcaacggaaagtctactaaagactttaaggacagtgactgggatgcctaccgaaacaactctatcggtttcatttttcaaagttacaacttgattggtcatctaggcattattgaaaacgttgaacttgggatgacattaagtggtgtttctaaagacgaaaaacgaaaacgggcagaagatgcattgcaccgggtcggcttgacagatcatatgcataaaaagccaaatcagttatctggtggacaaatgcagcgagtggccatcgctcgagcactagccaatgacccagatatccttttgtgcgatgaaccaaccggagcgttagatacagaaacaagtatccagatcatggaatttatccaagagttatcgaaagaaaaattagtgatcatggtcacacataatcctgaattggcccatcaatacgcagatcggatcattgaattttctgatggtaagatcttaacagattcccatcctcacatcgaacgaccaaaagatgatcaatttaacttacgcagaacaaagatgagtttttggacagcgttgaagctttccttcaacaatatccgaacaaaaaaaggacgtactttcttgacctcctttgcttccagtattgggatcatcggaatcgcgatcgttctgtccctttcttctggattccaaaaacaaatcgataacacgcaagctgaaacgatggcgaaatttccgattactatttctaaggtaacgactaaccagactcgtgacgatgccggattgggtgcaagcaaagcggattatccagacagcaaaacgattactgcaaaagtcagcgaagaagataaagcacagcacacgaataagattgatcaaacatacgtcgattacgtaacagacatcgatcctaacttaagtaataatatcggatttacccgtactacaggaatcaatcttttacgtgatgtaaatggcaaagtacagcctgtcagcttctcgaatcaaaatcctgatacggaatctctttctttatctagtacgatgtcagcaatgacaggtgtgggagtgtcaagtttccctacacagcttgacactagcaaagaaaactttttaaaagacaattattctttacttgccggaagttatccagcctcagcaacagatgtcgtgctgatcgtagacggcaataataatactaatatcaacgcattgaagaatcttggatttgatgtgaaagaagacgaaaaacttgattttgatgatatcgttggtacaacattcaaattagtaaacaacaatacttactatacaaaacttccaactgggaattttatccctaatacagattatgatgcgatgtatcagaatgcttctgatgaattgaagatctcggggatcctacgcgtgaaatcttcttctacaatgaatctcttatctccaggaatcgcttatagcgatcaattaacgactcaaatcgtcaacgaaaacaaagaatcagaaatcgtcaaagctcaaagagacagtgatgtaaatgtcttaactactgaaaaagttgacgaaaatgccaaacaaacattgcttagttatttaggtggagacagcttgccttcaagtatcatgatttatccgaacaattttgaagacaaagaaaagatcttggattatctagatgattacaataaaggcaaatcagatgaagataaaatcatttatactgatttagctggaacgatgactgaactgactggcggattgatggatgctatcacttatgtccttattgcttttgcagggatctctttagtaacaagtatgatcatgatcagtatcattacttatacatctgtgattgaacggacaaaagaaatcggtgtactaaaagctttaggtgcacgtaaaaaagacatcactcgcgtatttgacgcagaaacgtgtattttaggtatttcttctgggatattaggtgtgtttattgcatggctagctacgttccctatcaatagcatcttatacaacatgacggatctaaaaaatgttgctcaactaaatcctgtccatgcgattattctagtgatcgtctctactatattgacgatgcttggcggtcatcttcctgcacgaatggcagcgaaaaaagacgccgctatcgctttgcgtgcagaataaggttgtgacaaccacatttagatttgagtcataagagcgctgaaatagtagaaaacagcaagaaacgaggaagtaatatgttccttgtttcgcgctgttttttttaattattttttataattctggtatacttttctttcctttgtaccacaactcttctggcgtatacctgtcttttccatttatgaatactgttccatctgcttcaatcgttacttcagtcccaatccacatattacgagaaagtgcgagaagattttttctttttcctcttcctttttttccaaattgcaaggtatcggttatctcttctgtccaatgagatttcacgtattttacttctccgttttcaaatgtaactttcaaaatattcgctatattttccacttttactgctttaggaaatgactcctccatttttttcactttccttcctccaacactaagtatgcgctttcttttagtgataagtatatcatagtttattctattatcaaaaaaacgcatccattccattgtagaatactttaccgaacaagttgaattgttttcctctttttcaccttttactatagataggtaaagacaactaaggaggaatctctcatgacagatcaaccgtatgatttaagaaaagtcatcgaagaactaaaaacacttccaggtcaatatcacgaaacagatattgaaatcgatcctgaagcagaattatctggtgtttaccgttatatcggtgctggcggtacagtaaaacgtccgactcaagaaggaccagctatgactttcaacaatatcaaaggtttccccggcacacgtgtgaacatcggaacaatggctagtcgtaaacgtgtaggtgaaattttgcaccatgattatcgaacgcttggtcgtttcttgaaagacgctgtagaaaatccaatcaaacctgtgaaagtagacaaagcagacgctccagcacaagaagtcgttcatctagctaccgatgcagacttcgatattcgcaacattttgcctgcacctacaaatactcctgaagatgctggtccatacatcacaatgggtgtagtcttaggatcagatccagaaaaaacaatgagcgatgtaacgatccatcgtatggttctagaagataaagatacgatcggtatgtacatcatgcctggcggacgccacattggtcacttccaaaaacaattcgaagccttgaataaaccaatgcctatcactatcaatattggtttagatccagcaattgccattggcacgactttcgaaccacctaccactccacttggctacaatgaactatggtgtgcaggagctttgcgtaacgaacctattcaaatcgttgatggtatagcagtcgatgaagtgggtattgctcgtgctgaattcatcattgaagcagaaatcatgccaaatgaaacaatgcaagaagatatcaacacgaactcaggaaaagcaatgccagaatttcctggctatactggggatgctaatccagctgtacaagtagtgaaagtcaaagcagttactcaccgaaaagacaatccaatcatgcaaacaacgattggtcccagtgaagaacacgtatctatggccggtattcctacagaagcaagtattcttgccttggtcgataaagctattccaggaaaagtagtaaatgtctacaatcctcctgcaggtggtggtaaattgatgaccatcatgcaaatccgtaaagaaaacgaagcggatgaaggtattcagcgtcaagcagctattcttgctttatcagccttcaaagaattgaagacagtcattttagtcgatgaagatgttgatattttcgacatgaacgatgtagtttggactttcaacactcgtttccaaggagataaagatatcatcgtgatcccaggaatgaggaaccatccattggacccatcagaattaccagaatataatcctggctctattcgtttccgtgggatgagtgcaaaaactatctttgacggtacagttcctttcgatatgaaagaacattttgtacgtgcaaaattccaagaagtagaagattgggaaaaatatttgaaataatgaatgatctgcaactgttttgacatcataaaaaggagtgcggaaaatggaacaattggcacaacggaagaaaaaaatcgtgattggtgtaagtggcgcttcaggcaccatttatgccatcaacctagtgaagaaactaaaagaatatccgatgatagaaacacacggaatcatcagtccatgggcaaaacagaacttaaagctggaatccgacttatcactaactgaattcgaaagcctgtttgattaccattattcaaacaaagatttaggtgctgctgtcgccagcggatcatttttgaccgatggaatgatcatcgtaccggcaagtatgaaaacagtcgcaggtatctctgttggtttaggcgacaacctgattgcacgtgctgctgatgtaacaatgaaggagcaacgaaagttagtcattgttcctcgtgaaacgccattaaatgccattcacttggaaaacttgactaaattagcacgactaggtgtgcaaatcataccaccaattcctgctttttataatcagcctcaaacgatccaagatcttgttaatcaccatacaatgaaacttttggatcaatttggaattgtaaatgagcattcaaaacgttggcagggtgattaatatggaaaaagaaacgatagttgaagtaaccaaactaggtttcacgatccaagctgctgttaaagtaatcggtaaagacttattgatcactttaacaggcggagatacaccacatatcggaacagtcactacattttctcgtgatacagagatgcaaactgtacgtttccctagccacgatggtcggttccataaagacgatgtcttagccgaaaaaatagctgtgatcatcaaaactgccgttccgggaagttgtacgatcacttccggtatccatgttgaccatatctccaatgcacaaatcaacgcctcttttccgatgtcagaagagttaggttacaagattttagattggttggaaaaaatagatttccatatcaaagaaccagtttattataaagatggtgaaaaaccattatgaaagaagaggttgtgaaatcagcgttatgacctgagtatgagagaaaaaaatggaaaaatagcttctcatattttgccgtttttgagctaataccgagggacagctgattgaacgccgtttatcaagaggttgtgataaagccgcttcgtttcgagtagtaagaaaaattttgtaaacatgggtttccacatttttgcataaatttgacttactaccgagaaactggcttttgaacaccgtttatcaagaggttgtgacacgtcttttgtcacaacctcttttatttttgcttcactgtaactgctacaatatcaccgatttcttttccgatgtttttacgaatatcttttcgtagtccaaggatgtagcagactgaaccatctggatttttcacgcccatattcacgatactgccttcatacggcacattgtcaaaagttgcttggactttaactcttccagcaccgaattcttttcttatatcatacggaaaaataatatatgccccgcccttgccgacttcggaagcatagatttttgattcaaaagaataaatttccctcattttatttctcctattttttacatctagtatagcatagcaaaaaaaagaaggaactgtgacaaaagtcttgtcgcagttccttttttcgaataaacggtgttctcctgccaactcctcggtcacaagtcacaatagtcaacaaacatgagaagctgttttttgaaattgctccttgtgactcagagttaaacggcaggctcataacctcttccttaaacggtgttcaaaagcttgcatctacggcactaagcccaatcagatgaaaaatatggagtgctatttttatctgattgttcttactgcttgatgcagagcagctttttcataacctcctacatggtgttcaaaatattattcgccttttgcttctttcactaattttgcgaatgcttgttgttggaattcagcagctaaggctttcgtacgttgttcttgctctgctttgctcatttttggattttcagtcattgcttttaccataccgtcttgaacataagcttttgcttcactttccatcgtactttgctgtttcttcactaattcagctaacttggctgcttggtccgtacttaattctacccatgtctctgggattttgaatgtattcactcggctgtcatattcgtgattgttatcagcaatattgaaccagaatttatacatgtcgtttttgtattcccaataagtagttttcgtcactttttcagcatcgccgtctgtcttttctactttatttgtttcgttatccgtaccagttgcttttggtttttcttgtttttcatttgttcggtaaagatacactttttcttttccattccctaaagctttatacaaaagcatatctgctccttgggaatcagcactggaaacaattttttctgtttttgtttccgttactttttccattccaaagtgattggacaaattagcgacgatcaaacttagtgaagcgacgaagattagtccgaaaatcaaagataaaaaggtttgccatgtttttttagcgaacacgttcgttaaagcaaaagcaagcaagctgacaatcaaaactccaataatcatgcattatcccccgctttcgttagaacaggttcttttttcttcaataaaaaggcaataataaagccaaggatcccaaagatgatcgctacgataaacgcggcatggtaacctgacagtgtggcattgattgcctgatctttataagctaatggtgtattatccaatacagatttgcttgggatatttgcttttgtcacattcgtcaacacactgatcaaaatagctgtaccaatcgagcttgcgatttgacggaatgtattatttaccgctgtcccgtgactgatcaagttatttggcaatgcattcataccagaagtcgttaccggcatcatgaccatggagatcccaaacatacggatcgcataaaggatcacgatatataaaactggagtcgtttttgtcaagaaagcaaatggtgcagttgccgctgtcaaaatgaacatccctgtgatggctaaacgtttcgcgccatatttatcgaaaatcgcacccgtaacaggcatcatagcccccatgatcaatgcacccggcaacaacatcaagccagaatggaatgctgattctccacgaatattttgaatatacaatggtacgaccatttctgcccctaccatcgccatatttgttacaccagctaaaacagcggcaatcgtgaatgtagatgatttgaatacgcgaagttccaagaatggatgttccaaatgtaattgacgccatgagaacaaggcgatgaaaatcacaccaacaactaagaaaccaattactttcaagcttccccagccgtcatctcctacactagaaaatccgtaaagtaaactaccgaatccaatcgttgataaaatagcggataaaatatcaatgctaggatttgacaatggaataacacttttcattaggaagaatgctaaaaccaagacaagaacaacgattggcagtaccataccaaacaagtcacgccaatggtagttatcaatgatataaccagataatgtagggcctaaagcaggagcaagtccaataacgatccctgacatccccattgctgatcctcttttttctggcgggaaaatagatagcatgatattttgcaataatggcatcgatactcccacaccgcaagcttggatcaagcgaccgattagtaatgtactaaaattaggtgctgtaaagcaagtaattgttccgatcaaaaagatcgtcatggcagaaagatataaatttcttgaactgaatttattgatcagccatgctgttattgggatcatgatcccgttgactagcaagaaaccagtcgttaaccattgcacatcagacgctgaaatatcgaaagctttcatcaatgtaggaaaagctgtcgtcaataaggtctgattcaaaacggtacaaaatgtaccaattaataagacaacaactaaaagtgtccgattatatggttttccgtaaatatctacgggttggttgttactcatatttctccttctttctgaattttttctgaaactactagaatactttagtcctaaattcgctatttgtcaacctacttgacacataagttaatacggatataattaagggaagcaagaggacaaaaggagtgacaaaaatggttggggcttcccttaaacgtttgttggaaaatgatcaattggttgttggcatcagtgaattaagtgatatcgtaggtgtgtctccacgtcaattaaggtattgggaacaaaagggattcattcgttcgatcgaagctgatgcgaattgtcctagaaaatatcgtttacctacagtcataaaagtagaactgatcaaaaaatatttagatgacggatttactttgtcaaaagctgcagaaaaggcagaaatccgccaaaagaaaatgcaccatgtccgtaaagttttttcaaaagcaatcaaagatatcgaattgatcgacgaacgctatacgattttacaaatcggtaacttcaaagaagagaatgctaagatgtacatcattcatgacaacgagacagacgaattaacttacaagctccttcctgtcgatgaaaaagctgactacgaacagttgttaaaagaactctaaacgccactaatctcctaagtaccaagctttttaataagtagatgctacataaatacttgaaaaaaggcctgtttgaacataagaatatccgaacggtgatctgcgtttctttcatatagaaaggaattctccatcactgttcggatatttttttatttttttcggttactttcttctaatacatctgttagccaatttgcatattctgtttcccgattgatcgcatgcgctaaaatcaggtagtgtccgtaattttcatgtttttctttttcagtaggaaagatcgttttttttcgctctaatagatgaagtcgtttttcttcatgaaggtcacgctgctgctgaataatttctactaatgccggatcattcacgtctttgacgaaatacaatttcagaacaaattcgtctcgattaaccggtagttcattggtgggtgtatgaatccactctgccaattgttccttcccttcttctgttaattcataaactttcttttccaatttttcacctgtgatctctacttgatgctgaatgattccttgctcttccatttttgcaagttcaggataaatctgactatgttttgcttgccaaaattctcctatttcatttttgaacgattgattcaattcatatcctgtcatcttcttcttacttaataaccctaacaaaatatatcgaagtgtattttttcttgccatcagttttccctccttgacaaatctttaaatccattctatcataaatgagtaatcgaaaacatgtagtttattacatgttttaatttataaggagatgcttaaacatgaaagaatttaaagaattggaagattttattggaactcactttatctatacgtatgacaatggttgggaatatgaatggtatgccaaaaatgaccatactgttgattaccgtatccatggcggaatggtcaaaggccgttgggtaaaagaccaagaagctgatatcgttaaattgacggacggcgtattcaaaatcacttggacagagccaacagggacagacgtggcattggactttatgccaaatgaaaagaaacttcacggaatgatctttttccctaaatgggttgaagaacatccagaaatcactgttactttccaaaacgaacatatcgcagaaatggaagcagctcgtgaaaaatatgaaacttatccaaaattacttgttcctgaatttgctacgatcacttatatgggtgatgcaggtatagacaatgaagatgttattagcgaagaaccatacgatggaatgccagatgatatccgtagcggaaaatacttcgatgaaaattataaacgagtaaaataaggttgtgaaagagaggttgtgaaatcagcgttctgacctgagtattagagaaagaaacggaaaaatagttcctcatgttttgccgttttttgagctaataccgagggtcagctgattgaacaccgtttaagaaagaggttgtgacagaagtggtcagcttcaagaaataagaaggaatttacggaaattgcttctcaaatttttgtaaaatttcggcttatttccgaagaagctacttttggaacaccgtgaatcagaggttgtgaaaaagctgttctgcatcaagtaataagaacagccaaataaaaatagctcctcatattttttgtttggttgggcttattaccgcagatgcaagcttttgaacactgtttatcaagaggttgtgaaatcagcgttctgacctgagtagtagagaaagaaacggaaaaatagttcctcatgttttgccgttttttgagctaataccgagggtcagctgattgaacaccgtttatcaaaggtcgtaacaactgcatattcacacagttaaattagtgacttcaaaatgaaataatgctcccagcaaaaatcagcgttttgattccatttcatcacaagttcctcctcatttactgcttcatctttttgctgtgtttgaattgtaaaaccttgtgaaagatagaaatgaatagctgattgatttttttgatagactgtcaaagtcagtgttttattggtttcttttatttttttcattagttgcgtaccgattctttgttgtcggtattcccttttcacaaagattcctgcgataaactgatcaatcaccccagcaaaaccaataatttcttgatctatttctgctaagtaaatcactgcatctggtaaagctttcctaacagattctacttgattctcccaataagttgatggaatgaattcatgagaatccaagttagcatgtagccaaatcgatagaacagattccagttctttggcagacaattttgttgttgtgcggatcattttttctctccttacttattcattgattttaaaataaaaaccatttttttgaagctcttttacaagttttcgcccctcaaaaaagtatatcttctcttgttttacttttctaataccaaaagaaacagcaactttaggatcatcagctgaaacgattcgataagttccaccaggcaattgatccagcttgactttcccatgatggtcgctttgtactgaaaacggcacaccatttctagtaagtgtttttttcttatgtttcaaaatgaatgaactaccatttaccggtttccctgacgaatcactaataataaatgaaaaatcaagcacttttttacttaatctatactgatagattagtcgtccgataaacactaacagtatgactacagctattatcgttcctgcaagaataaaccattgccgcatggttctttcctgatttccttttccttcttctttttttaccgattcgttataaggaatccgatgtcctgtcactagcaaacgatgcgtgttgatcatatacggcgtacatgtaagcaaggtaactaagtcttctccttctgaaatcgttagaacagacgtgtcatctggcagtaccacttgtatatttttaacttgataagccaatttctcccccaaaacagtcaaaataaacgtgtctccgttttctaaacgatctaattcggtaaataaccgtcgattaggtaaaccgctgtgagcagagatcactgaatgcgtcgaatttccaccaagcgggaaagaggttccttgcaagacgcctgctccattttcaaggatcctaccattgagccgatcataaagtgaaatatttaattggatcttaggtatattgatacttccgatcagccattcctctaattggctggatgttgtactttcatttctgttcttttcattgaaaggatcagtaccaggattgaatccttggtcagttaatcgttggtttttctcctccattttctttcgctgcacttcaatttcagctgcggtccgtttttgtacttgttcgatacgtttttgatcaataaaactatttaaagaatccacataaaatggatataaagcgatcagtaaccctacgacgatacatattaataaaaacaaacgaaacaaaagtcgacgagactgtttttgcttactctgcttcacatgtgtcctcccttgcaagtttttttgttctttcttttattatatgggttcaggaaaaaaatagaaaatgaaagccgatgaggttgtgaaaaagctgtcctgcatcaagtaataagtacagccaaaaaaaatagctactcatattttttgtttggttgggcttattaccgcagatgcaagcttttgaacaccgtttaaggaagaggttgtgaaaactgcgttatgctttgagtaataagagcgctagtcagaaattagcttctcatattttctaggctagtgagcttattaccgagaagcagctgattgaacaccgtttaccgaaaggtcatgaaaaagctactttgtttcgagtattaagaaaaattctgtttcaaaacaaggagatgcaacaaaacttatgtcgcatcctctctccttagaactttcacttatgtttttcttgtaaaattcataaatattttcatgaattttctaatttcttgcctacctctcgcataggatatatgatgaatttatctaaagtttgcaaaggagttcgacaattgaaaaaatatggcccatttttagcaatttttttcattgctttggcatttctcatgcctcatttattcacacataaactaattttgggtgctgatgccccattccattacaatcggttctatgatgccgcgcaacaaattaaatatggggatttccattattttccttccctttatggattccagcaaagtggcaggatcgtgaatgccgtttacggcccatttttcgcttatttacaaggattgatcgtgttgcttgcaggtagctggtttcattatcagattctttcaaatttcattctttatcttatttcaggattttctatgctgattttactgagatatgtcaatgttcgaaattgggtaagtgtaccagtagccgttttattcatgagtacgtattctattcaatactggtctatcaaccaaggattcactagctgggggacttgtttttatcctttatgtatgatccctattgctgatttcgtccttcataaaaagttccctgttatcaaagtcgctgtctcagtgggacttatgacacagatccatttactgtcttcgatcatgttagctttgatgtatatccctttttatctttattacttttttaaccagactgaaaaaggaaaagcactgcttcaactaattaagtcggtcttgctttattttgttctgacagcaaatatttgggcaggattagctattgtttacagtgggaataagattcttcctccctttgttaacagagaaatgagtcaaaaggcgatagatctggatggcagttattggctccattaccctaaggcctttcctatattgatattatcaggttttttgctttttattttctttcaacaaaagaacaccttattccaaaaaattgtgttgtacacaagtcttgttttcttttttctttctactagcttgattccatggacgacattgatcgaaaaaaatgtgccttttattagtttgatccagtttccatttcgatttttcgtgccatttacgctattgcttctactttaccttgccctttcactgaaccagtggtctgaacaaaagtggttccgtcttttaagtatatttggcattcttattttttcagcacagacgatccagaacttataccagcatctggaaaagtgggaaaatgaaacatttgtcagtcgacatacttatctattcgatacgccggaagaagcaaggaaaacattcttcagcaaagatatgtctaccagcttgttcgttttccaaaaaaccacacctgactatctgccaatctataaggagacaaaagacaataaatacgaccggtataacgaagaaatactagaaaacgaaacaacttttataaaaacacatccaggcggtcttttgacaatcaagtggaaaaacactggggacaaaactgttcatatccctgttatcgtctacgatcggactgtgctacagcaaaatggaaaaacattgactgattatgaagtaacagatatcgggaccccaatcgtgaagcagcaaaaaggaatcaacgagctcacgcttcattatcaaacgccaatctatttctatttcattctttctcttactttgattggctggtttaccttgctatgtttatttatttatcatagatacaagcatttacgtgcttaggcaaaagggataaatgcatccgatcaaaaaaaactctccaaacggtataatcgtttggagagttttattttaatcagtttttttatgttatatgttatattttttattcgttcacatctaattcgatttccaccccgtagtgatcactgatgattggactatcgatcccatcaaaaatccgttgatattttttaacctgcattccttcagagacgaaaataaaatctatacgcaatttttctgtattttgttcccaaccatcgattttcttttccacagtagctgcttttcctttttcattcgcgacaacatacgaatcttgaagaagaaggcaactttctcttacagtataataaccttgagagtctgctggattattgaaatcacctaggaaaaaaagtggtacgcgagtttccaaaaagtagttttccaagtttttccactcaaaataaaagccactttttttatctgtccaccaagaaaagtggcagctcgagacaaaaatgtcctgatcatctatctttgttttcccaatcaagatcttgcgtgtctgataatcttctttcttttgagattgggagacggtaaggacctgactttccaatgtttttttcgcaagcagtgcatttccttcttcatatttatcataaccgatgtggctcatttcccaactccaaaaatactcttttccgtgttcctttaaaagctgaactaaacggtaggcaaaattatctttacggataggtacttgattctttaccggacagaacttcattagcttcgcaggttctacttcttcagattccagtaattggttgatttcttgtaaagcaatcacttcataatcttctaacaggatcttatctgctaattcttgcaattttttctctggttctggctcaagccagctatgcgtgttgagtgtcatgaatttcattggttttctccttgtcttcatttcgaaacaaaagggttgtgacaaaatttttgtcacaacctctccggcaaatagtgttctcctgctaactcctcagtaataagctcaatggaccaggagctattttttgtttggctgtttttatcacttggtgcagggcagctttttcacgacctctccactaaacagtattcaaactgctgcttctcggtaataagctcactagcctagaaaatatgaaaagctattttctgactagcgctcttattactcaatgcataacgcagttttcacaacctctcgataaatggtgttcaatcagctgagcttaggtattagttcaaaaaacggcaaaatacgaggagctgttttttcgttttgtttctctaatactcaggtcaggacaatgatttcacaacctctccttacattttaatggagccgatcactttaccagctgtcactgtacctaattgcttgatcactacttcttctactttatcgtttgtaaatacgatcatgatcgttgaatctttttcttcgttttggatcacctcaagatccatctcagctaatttcgttcctgttcctatttcttggccttctttgacagcaatctcaaaagctggctgattcatttggactgtatcgattcccatatggatcaaaacttcgataccatctttcgtttccagcccaattgcatgtttgcttgggaaaatacttgtcacttttccagcgatcggcgcaacaacttctcttgatgttggaataacagcaaagccgtcacccatcattttttgtgagaataccggatcttttacttcagataaaggaatcacttctccagaagctgcggaaactagttcttgttctatacctaagtattgcttactatctgcttgtctatttcctgtagaaaccatttctggctctggaatctctgctcctgattgcagcagatcttcgatatctgatttcaagacatctgcttttggtccataaactgcttggactccattgtctttgacgatcaatcccatcgcccctgctcgtttccaggcttcttcagtccctactttttctcgatcatttacacttacgcgtaaccgagtcatacaagcatcgacatctttgatattttcttttcctcccagcaaatgaatgatctggaccacttgctgatctgctgttcctgttccgctgttagatacaacggtttcttcactgtcattgtcgtaatttccgttacgtcccggtgtagcaaagttgaattttttgatcaagaaatttgctaagaaatacgtaacaacaccaaaagcgatcacacacaacacgaagttgataagatctccacctaaacccgctttgatagctaacggtgtccgagtcagcaattcgatattcccaaatgaatggacccgcaatggcaagatatctgccatcgcaaatgcagccccttggatcactgaataaatgacatataatggcacagcagcaaacataaacatgaactccaatggttctgttacacctgttagaaagacagccaacgctgctgaaaaatacattgatttatatcttgctttcttatcaggatcgacattacgatacatcgcaaaagccattcccatcaagatacctgaagaaccaatcatttgtcctactttgaaacgagccggcgtccagttatgcaacacaaactcatattgcgacatatcccctgcacctttaagattcactaaatcagtggcccaagccaaccataacggatcttgcccaaatacttgtgtccccgcctgtgcgcctgataaaatctcataagatccgccaagctgtgtatagttgataggaatcgtcagcatatgatgcaatccaaatggcaatagtaaacgttctaatgttccaaataaaaacggtgctagaatcggtgcgctttcttgtgattctgcgatccataaaccaaaattattgattccagcctgtacgtttggccacaccacagcaagaatcaatgccacgattgttgaccataagataacaacaaacggaacaaagcgctttccattgaaaaatgacaaagcatccggcaattttctataattatagtacttattataagccattgccccgacaaatccagcgatgatccctacgaatactcccatattcaaagctggtgcttccaatacacttgtaaaaaatcctttaaccatgatcttcgtaccgaacagagtgtgggtaaatgcatcttcattcgcaagcatgtcacttgtgacaccaaagatagccccagtgatccgattgatcaaaataaatgagatcccagctgcaaatgctccgcctgctctttcttttgcccaacttcctcctattgctaaagcaaataaaatatgaagattaccaataattgcccaaccaatattttcaattactccgcccgttgtgacaagcggcgtccaatcaggattgatcaagggaattgatttccctatactgatcatcaacccagctgccggcataactgctaccacaaccattaaagcctttccaaatttttgccaaaactcaaaactaaatatctttttcattccgtttagctcctttacgcaatcggtttcgttaaacgtattatagcgtgcgttttcttttttgtaaatgctttattttttatttttctgtctataccattctataaaacctataatacgtgtgttcccttctataattttctcctaaaaatttatttttttatgcttttttctatgaaatattttcttttgtctattgacttgtgcaatcggttgcgtttattatgaacgtataaaacagctcattaggaggagaaaaatgaaacagatcaaacgactatttgctattgatccatggaaaatcagcacgacacaattagataaaaaaaatcttcgactgcaagaatctttaacaagtattggaaacggttatatggggatgcgcgggaactttgaagaaacttactcaggggaccaccatcaaggtacttatttggcgggtgtctggtatcccgataagacacgtgtcggctggtggaaaaatggttatccagaatactttggaaaagtgatcaacgccttgaactttatcgcgatagatatttcgatcaacgatcagctgatcgacttggcttctttggaaccagaagacttttactgggaattagatatgaaaaatggtgtattatctcgtacattcacaatcactacttctactaataaagtacgcatttccttcgaacgttttctgagcattgtcaaaaaagaatcagcttatatctatttaactatagaaatgcttgaaggtagcggaacagtcaaactcgtatcaaaattggatggaaatgtccaaaacgaagacagcaactatgatgaacatttttggaatgagattgatcgtggaactatagaagaaatcggctatttgacgactaaaactattccaaacaactttgggattgaacaatttactgttactgcagcaatgcgccatttcgttaatggaaaatcagtcatccctgactatcacgaagatactttagcattacatggttgcttgtctgcagaattatctcaaggtgagacatggtcagtggaaaaagaaattatcgttcttactagtagagatattccagaagcgcagcaagcagaaaaagctgtctcagaattaacgaaccagacaaacaattatatccaagcaaaagaagagcaaacagcggcttgggcagaacgatggaagcttgccgatgtggtcatcgaaggagacgaagaagcacaacaaggcattcgattcaatttgttccaactattctctacttactacggcgaagatgaacgattgaatatcggccccaaaggattcacaggagaaaaatacggcggagccacttactgggatacagaagcgtatgctgtccctctttatcttgctttagccaaacctgaagtaactaagaatctgctgaaatatcggcataatcaactgccgcaagcaatccacaacgctcagcaacaaggattaaaaggcgcgctttatcctatggtcaccttcactggtgtcgaatgccataacgagtgggaaatcacattcgaggagattcaccgaaatggcgcgattgcctatgcaatctacaattatacgaattacaccggcgatacggaatatttgaaaaatgaaggactggaagttttagcagaaatcgcacgcttctgggcagaccgtgtccatttttcaaaacgagcaaataaatacatgatccacggtgtgaccggcccaaacgaatatgagaacaatatcaataacaattggtatacaaatacgatcgcagcttgggtcttgcgttacacgcgagaaaattatttaacttatcaaaaagaagctgctatcactatcagcgaagaagaactagccaaatggaaagatatcgcagagaacatgtacttcccagttgacgaagaattaggaatctttgtccagcatgacacattcttagataaagatctcatgcctgtatccgatattcccacaagcgatcttcctctgaatcagcattggtcttgggacaaaatccttagatcttgcttcatcaagcaggcagatgtactacaggggatttatttcttcaatgatacttttacaaaagaagaaaagcaaaaaaactttgatttctatgaaccaatgactgtccatgagtcttccctttcgccaagtatccattcgattttagcagcagaattaggaatggaaagcaaagctgtagaaatgtaccagcgaacagctcgcttggatttggataattacaataacgacacagaagacggcttgcacatcacttccatgactggtagctggttgtcgattgtccaaggatttgctcaaatgaaaactgcccatgatcagttgagattcgcaccatttctgccaaaaacttggaaagcttattctttccatatcaattatcgcggacgtttattgttcatctcagtcacagatgaacaagttactttcgagttattagaaggttctcctctagaaatttacgtctatgaacagtcttattctttagcggatcgtctagaaataacgctaagaaaggaggaagcaaatgtttaaaggggtattgtttgatttagacggtgtcattaccgatactgctgaattccattatcgtgcttggcgaaagcttggtcaggaaatcggcattacgatcgaccacacattcaacgaacagctaaaaggcgtcagccgagaagactcactctctttgcttttagcttatggcggaaaagaacactctttttcaaaggaagaatttgcagaattagcgaaaagaaaaaacgattattatttagagatgatccagacgatcgaaccaaaagatgtcttccccggggtcgtgcctttactggattctttaaaagaagaaaaaatcaagattgctcttgcttctgcaagtaaaaacgggccattcctacttgaaaaaatgggtcttacaccttactttgatgctattgccgacccggcagaagcaacaaacggaaaacctgcgccagatatcttcctccttgcagcaaaagctgtcggactaaaagcagaagaatgtatcgggatcgaagacgcgcaagccggtatccaagccatcctctcaagtggcgctcaaccaattggcgtgggacgtgctgaagaccttggagaggagatcccgcttgtccctgatacgacttttcttacgatcgattacttgaaagaaaagtggcatgaccatggataatccagagatctccgtcgtaccagttccagaaactgaaataaagaaaatcacattgaagaacgactacttagaagtcgttcttctcaattacggtgcccgcctgcaccaaatcttcgcaccagacaaagaaggaaaatcagaaaatgttttattgtcttacgatcgtttcgaagatgttctaacagacaaaagcttttttggagcaactgtcggacctgtagccggaaggatccgggatgcttcttggggtgagcatagattggagaaaaactgcggatcacaccatatccacggtggcacgaaaggctggtctttccaattttgggaagtagaagttttcaaaactccatcatcaataggtgtggtcttttacttaaaagatgaattttctacctatccaggaccaatcactgctacgatcacttaccgtttaacaaaaaacgaattagagatgacaacctctgctagtagccttgttgaaaccatctgcaatccgaccaaccatgcctacttcaacctttcaggaaatggaacaagagacatctatgaacatcagttaacggtctttttagatggtgtgcttgaattagatcaagaaaaactgcctactggaaattggacaaaaaaagaaaaactgccaatcgactttagaaaatccccaacactgcaagagatccttgcatgttatccagatggactagatgatgtatttcttttgcatcatcctaggctttccaaaacttccttacaattattcgagaagcattctggtcgccaaatgactatagcaacttctaataaaagtatggtattattttctacgactggattcgaagctgatttctctgtcaatggaaaacagatgcattcaaactacggattagcaatcgaaccgcaagaaatccctgatatcgttcatttccccaaatttggatcgatcaacctccatcctggtcaagaacggatcagtcagacgatttatcggttctctgcacaataacaagagaaaggtgtttttatcatggctattaccgtaaaagatgtggcgaaaaaagccggtgttgccacctcgaccgtctctcgtgtcatcaacgatcatcctagtatttccgagacaacaaagaagaaagtccgaaaaattatggatgaactaggttatgttcctaacatgactgcccgcaatctaggaaaacgcatttccagtgccatcggcgtaatcttaccccctcttgattcaaaagagcggatcggtaacccattttatcttgagatcatggaagcaatcaacgaagaagcgcggaattatgatatgactacagcaatcgctactgctaaaaattttgaattgctgttagagaacgtccagcgtatgcatttacaaaaacaagtagatggttttattctagtgtattcagatagtcaagatcctgtcattgattatttataccaaaaccacatccctttcactttgatcggacagccttatcatcatgagaacgaaatcgtttatgtagataatgataaccagcttctaggtaaacaagcaacagaatttttgatccagaatggacataagaatatcctgtttgtgacaaacacgactcatgaaagtttgtatttcgaacgatatttcggttatcaaaaagcaatgatgatggctggtcttcctgcgttatccagtgtagtactagagcatccggaggattatctgtcctttgagaaaacgttgaaagaaaacgaagccacagcattggtggtcattgacgatatcttcgcccttcgcacgatgcagttggcgcaaatgtacggctatgtcattccagagacactctccgtcattagcttcaacaactcgatcttctcaacattaacacacccttaccttacaagtatcgatatcgatatctccgaattaggacgtgtcgctatgcaaaagctgcgcgaattgatccatgaagaattgagcagtggcgtacgtttggtcatccctcatcgcttgatcaaaagagagacagtcgttcctttagaaaacccatactaaatagctgactcactaaatacgctgaccatttatcctatggtcagctttttatgtaaaagaagatactacttctaacacattgtttatctgtaaaaaagagcgtgggacaaaagtaaagaacacttttgtctcacgctctaaacacgtataaacggcggaagcagaagcaactccttcggaaataagctgaaattcacaaaaatttaaaaagcaattttcttgagtttcttcttatttcttggagttaaacgcttctgtcccagcctctttttccttccttcaattttttacacgtcgacgattcaataaaaaaccgcctaatattgtaaagacaggtgcaagaatcgagaaaaaggcgaatggcaagtaatgcaacgcgctaactttcatcgttcccataatgaatgtgccgctgactccccacggtacgagagaattgacggtcgcacctgaatccgctagtgttcgtgtcaaataggtttttgataagccaacgtcatcaaaagaacgcttgaatgtttctcctggaagaatgatggacagatactgttctccaacgatcagattgattccgatacagctcaaggcagtaaacccgactaaacgagaaggtcggtccatcttttcttttaattcttgaacgatggtatcaacgatcagatatttgatcagtaacccacctaatgccaatgcaagtaaaatcaaactagcagaacctaacatactcatgatcccgcctcgagaaagcagttcatctagctttggatcaggtgtatttgcgacataaccattcatcaagatgtctgctgcttttccgaccgtcaaacttttctcatggataaaagaaagaacgagagcagctgttgatcccgctagtaatgtagggatagccggaatttttttgattgcccccccaaataaaataactagtggaatcaatgtccaaggagagatccaaaagctcgctttcatgttttggatcatttcattgatactagctagatcggctgaatgactgttatgtcctaatatcgtataaaaaatcaacgaaaggacgaatgctgggaaatccgtataacgcataccagcgatatgttcgaatagattaactcctccaatacccgctgccaagttggtcgtatctgataaaggcgagcagttattccctaaaaaggcaccggaaacgactgcgcctgtagtcattgcatcattgaatccaagtaaatgaccgatccccaaaaaagcaattccaatcgtcgaaatcgttgtaaatgaactgccgacagtcactccgacaattgcacaaacaagaaatgctgtcggtaaaaagaaacgcacagaaacaagtttaaatccataaaccataatcgtagggatggttccagataaaatccatgaagcaactaagacaccaatcaaaagaaaaatcaggattggaatgatccctggagtgattcctttgatgatcccgtcatggatctcatcccatgtgaactttttaaatctgccataaaacaacaaacacatgaaagctgcaaggatcgggatatgtggcgagagctggaatccgatgatcagtactcctaggagtgccaacaacacgatcaatacagcgatactttcttttaaagaaatatttttattcatcgtcgatctcctatttcaaatgaaaaggccctgccatgaaaaaactattcacttggcaggacctcctactaaatcagcgacaaaacgtcggctgaaagacttatttttttatttttcttctaaacttttttctacctcaatcccccaagaatctttcttgaagtgattgatgatcaatggaataacgaacatgaccactgtgatagctgctactaataatgcatcactcaatgtcgctgtacctaatgtagcaaatacgacaacgatgatagagaagatcagcatgcagctgactacccaagctaatccgtttccgtttttaccaattcggtaaggacgttcgaattctggatgtttcttacgcattttaagcaatgaaacagcaatcaaaatgtacacgatacaataaataacagttgtagcatttgtaagtgtcaagaatacagcacttacgtcatccattacaccataaagcaaagcaaataatgaaataacgattgattgtgttagaacgacatttctagatacgccgtatttgttttctttatggaatccgaattttggtggaaggaatccttcacgagctacttggatgattgtttttgatggtccagtaacccaagctgataattgtaaaagcacaccaataaataccatgaagctgaagatatttccgatcacttctggtaagcctaggatttgacagtcaatcaagataggctgcgtgatatttgctaattccatttttccatctggtacgacatttgctacaagcatcgcattgatgacattcaataaaactaatccgatcaaagcgataaatacgccttttgtataattttttgttgcgtctttcaaacgaggcatgtaaacagaactcatttcgatcccaacaaaaataaatgtgataccagctaagtatttcaatgaatcaatatgttccaagtcagggaaagcttttgaccatgaaaagtcacctagatagccgtttgagactagtccgactttgaaggctgccaaaacacctaaaacgaacatgatgactactgggatatatacccctaaccatacaccgatgttcccgccgacttttgccatatcgaatttcaagttcaagatcgtgatgatccagtagataactaaaatacaacctaaaacgaaccagtgattattgccaagttctacattaccaaatgtgtttcctaacaatggtcctaaagtagaagcgaccattaccatacctgggaacatttgcacccataatagccatgcaacgacaaatccccatttgctgcccagtgctgtttttacccataactgaggaccgccttcttgaggaagcatcgttgaaagctcaccggaaaccattgatatcggaccggcaaaaaacaaaactgcaaaaattgaataaaaaatcaatgtccaaccgactgcggctaacgtaggaatactccgaaccgttgcacacagtgccattgtcagaccgataaaggtcccaagacccattttacttacttcagatttactcaccgttgacactctccttgattttttggataaaataacggtgtctttgaagtagtttcagcaataaacgaaacaattcagcgaatatttgaggggattctttgagtctattgcttgaagggtttcttcaaagacaacctcaaaacaaagggatcgaagagcttaggtctccccttgctcttcagatccaaacatgcgtcagaaacagttagtattcaagctgttttctaacatgattaccttgcttattttgcttcgcttgccaataattggtctgcgtagattttttccaatttttcttgaagagctgctttgattttttcagcatattcttcaaagtgttcttctttgttcatgtatggtgtcattacgctggcacgcaatacagttacttttccggcacggttccattcttcatctgagaatcctagttggttcacaaattgtaatgggctgttgccatagtctgggatagcaaagtcagtatgtgaagttaagaactcattaccgtaaatgcttcctttcacgtatgaagaataatcatatacgtcatggttcaatttattcattgcaactaagtcatcgttgcctttttctttgaatacatagtctaccatattgaaatctggataagttaatggatgaacttcgatttctttgtctcctactttaaatgacaagtcattcaagaagttgtagaaacgatgtgcaccttcgattgatgcacccattaatttaccatatcctgtgacattcaaaggtaagacatggtgtgctgcccaaacgctggctgctgttgcccctgcttttgaaccttccaagatataagccccaagtaatgctgggatatctgcgcctttttcaaatacatatgtcgcaaagtaagagataacgtctctcatgcggatatctttgatgacgataccaccggcagaatatggaacatagcccattttatgtgggtcgatcgttacagattctgcttcttcgattgctttatatgcactgtgtacttcttctaagatataatctttgttttctgtaaagacattgtatttgtaatgaacatcttttaaatcttcaaatggaatgaagttgttgtcttcgtctaagaaaatcgcacggccgtatccgccataagcagcatctacgtgtaagtagaagtaaataccgtctttttctaatacgcgacgcaatgcaacgattttatcgataccgtcgattgctccttcttctgttgatcctacaacaccgactacacctaggattggtgttttttcagctgctagaccacgaacgattttttcaagttcgttgatgtccatgcgatagttgtggtcaactggcactggaatcacttggtctaaaccgataccgatgatgtcggcagcttttagccatgaatagtgtttagtttgtggaaccaaccattttcctaatttttctaaatgttttccgctacgtgctgagtgagctttgatttcgtcgattttttctgggacgctgtctaacagattcatgatttcttctgttgacaagttcattaattcccaatcgctttttccagcaactagttcaggtgtcacttctttcattgcaagcggcaatgatttgatgttgcgggcataccaaagtccttctaagtttgctaaagaaccatcagcaacgatgtggccccagccatctttatagctcattaattttgcaaattccattcctacttcttcttccatttggcttgttgcaggagaagattcataggcaacgttattaccattccatagcatagcaaaattgtacgctagtaaagatggcatcaatgtttcagagttcatatgaccccagtaacgtccggcattatgccaaggaacggaatgggtacgcatccgcgctgaaatttctgatagaacatcctttgttttattcacagtgtgttcaaaactagcactgcttttttcttctggcgtaataataggcatgtcttgaggcatgtagttttgacgccagcctaaatgttcatccaccaattcattcaacaaagctttatagatttggccgttctcagctttgtccccaatgaatagggcatttaggtttagatctttcgacaatgattcactcatagtgaaaccctcctaaaaaaatatttaaattttgtcgagccctacattacacctgttcttctattctgtaaactaagttttggcctgctttttaatcatattttaatatgtatcaattatccgaattgttcacacttttgaaataattaaaaaaaacgagggaatttacaaatgtaaactccctcgcaaagattgtattaacgacaaccagcgttctattttaggatgggtttcaaaattggaatgttgtaatagtatttccctttttcaaggtaaaaacttactaaattctaatcaattactttggccaaaaagtaatttttcttaccttttcgaataaccacaaacttaccatcgaattcatcggatggatttatgacaaaatttaaatcggtaacgcggtcaccgttaatacttatagctccgtttgaaacatcttcacgtgcttgacgcttagatggttcaatttttgtggaaacaagcagttccacgatattttcaggtgtgcttgaaatttcaacgttcggcattttaccgaatccttgcgcgatttcttccgcatttagttctttaatatttccagagaacaatgcttgcgttattttttgcgcttctttcaagtcttcttcactatgcacaaatcttgtaacttcttctgccaaacggcgttgtgcttcacgtttctcaggttctgtctctacttttttcgctaagtcttcgatttcttcttgagacaagaaagtaaagaatttcaagtatttcactacatcgcgatcatcttgattcaaccagaattggtagaactcaaatggtgaagttttcttcggatcaagccaaacggcaccgcctgcagtttttccgaatttcgttccatcagccttcagcatcaatgggatcgttaaaccgaacgcttctgcttctggtccttctaattttcggattaggtctaatccagctgtgatatttccccattggtctgctccaccgatttgcaattgcacatcgtatgttttatgcagatgcaaaaagtcgatagattgcaggatttggtaagtaaactctgtaaatgagattcctacttccaaacggctggcaacgatatcttttgctaacatcgtgttgatgttgaagtttttaccgtagtctctcaaaaattcaagtaaagagatttttgacaaccagtcgtagttgttcacaaatgtgatatttgcatctttaccaaacaattttctcatttgattggaaagtgcgtccacgttatgttgcacttgttccatcgtttgcaacacacgttctgttttgcggccgcttgggtcgccgatcgttcctgttccgccgccaatcagaatatatggatgatggcctgccaattggaatcttttcatcatcataaatggaatcaaatgtccgatatgcatcgaatcaccagttggatcaacgccgcaataaagtgaaatgctcttttcttcaacgagctcgcgaagtctttcttcgtttgtttgctgattaatggcgtcgcgccaagttaattcatcaataatattcattttactgacctccgtgtagtttttttatgaaagcaggaacctgctagcatgtgtaattaattatttcttcaggataggataggaaataaaaaaagtcccttggcatataagccaagggacgaaatctcgcggtaccacccaatttgtatgtctagatatccaacatacctctcgaacatttaacgctgtcgcgtggcaatcactgccaaagactcctgaaatgtaattcgctttaaagcatgtactggtttgcagcgaccaccagctttctgaaacattggctttaacaactacttcgtttcgatcttcgtcttgttattattaatatgtgtctatcatagagcgcaactttttctttgtcaacagaaaaaggatattttttttaaattcctcattttttcttttttgaatccgctctaattccgaacattttattttcaattattgttaaaagaaataactttttctgtattttttctgcaatttatcgagaagtcactttactttgcctcttattctttcttcgttacaataaggaatgggacaagtaaaaaaatgaaaaagcaagggacgaggtatatggaaaaaaagcaaaaaattattttaggagccacttctgctttaactatcgttattttaattctaagtttgttttttgtcatccgatcatctacaaaaaaagaaccaatcattcctgaaaaaaaaataacagaaaaagctaaagaaccgacagatgataagcaacaactagttactcaagcaaaaaatctggctcaaagctacgattatgaccaagcgattgcgttattggaaaaagatagtaagaacggatctactgaaacacaacagcttcttcaaacactaaaaaaggagaaagaacaactgatcgactggtctgatcctactcagatctctcatgtctttttccacagcttgatcgtggacccgcaaaaagccttccactctcaacaggcacaaggatacaaagattatatggtgactgttgaagaattcaaccgttcgatcgaacaactttatcaaaatgattttgttttagttaatttgaatgatttgatccaaaaagacgaacaaggaaatctttcctttaacgggcttgcgctacctgaaggaaaaaaaccattggttctttcacaagatgatgtcagctattatgaatatatggataattccggttttcctagccgattggtcgtatcaaataacaatgaaatcaaaaatgtctataaagagaaagataaagaagaaatcggtgactttgacatggttcctctgatcgatgcctttgtcaagaaacatcctgatttttcttatcgaggcgcaaaaggtaccttggccctgacaggttacaacggagttttaggttatcgaacatcaaaatctcaatatggagacaatgaaaaaacaaaaaaagagattaaagaagctaaaaaagtggcggaacagttgaagaaagacggctggagctttgcttcccatacatggggtcacttgaatatgactcaagcttcactagaagatgtaaaaaaagacaatgaattgtggcagcaagaagttgcacctatcctaggaaaaacaaatattctgatttatccatttggtgcagacatcagcgactggcagccttattcagcagaaaatcaaaaatttgcttacttgaagagtcaaggtttcgatattttctgtaatgtcgatgcttctacaccagcttggggacaattaggtacggatttctatcgaaatgctcggatcaatatcgatggcattcgttttcaatctgatttagacggaaaaaatcctattcttgatccattcatcaatgtccatgatgtctatgacaaagaagcacgcgaatctgcttgattttacgtcatttatgaaccaaaaaagccgaactgacattttatcgtcagtttcggcttttttatgctttatttcttcttcggtgcgattcccttgatcaggacttctgtccattctgctgtatatggaagcagttttgcgtatatctccggcttagaaattccttctaccattgcttgaaaatagaggatcaagaactcatccgaatatttcaaatccacttttccttctttccgccctcgatggaaaagatcaagcatgatactgaaactttcttgcgtatacgcatccatcgcgtcagaaaattcttttttttctttttttgtatagtatgtcatcaaatcgatataaaattgtttgttcactcgattgagataacggattttgttttcactcatggcaatcagtgtttcttcaaatggaagattttccgcaatcaacgctttcgcttcttgccctaaatcattcataaatgcaaaaaatacttcataaatcagcccttccttgctgccaaaatatttaaaaatcgtcgctttacttacctgagcgttctcagctaccttatccattgtcactccagcggttcctatgtctgtgttcatcaagtcaaaagctgcttgtaaaatctctttctttttctcttgtgctctcttttcaaaaccgttcatttgtagagcctcccgtaattttaaacttttataatatatatagttcaaatttattctgaggtttattataactatctattgagaaagtatcaagctagcaattccttgtttatgaattcattgacagaaatttataaaaagaatattatgtactaaaataataaaaaaagttttataaaaaggtataaaacctttttattaaactatttaatcttgtttagtatatatttttagaaaaaggagtggggtttttatggcagaaatcgtcaaagtcacacatttgaaaaagagctttggtcgtttcgaagctttaaaagatgtctctttcaccgtacattcaggtgaagtcgttggatttatcggaccaaatggttctggaaaatccacgacgattcggacacttttagggattataaaaaaagacggcggaacggcaacgatttttgggcaagatgtatgggaagatagtttatctatccatgaacgtctttcttatgttccaggcgatatctctttgtggggaaatttgactggaggagcgatcatcgatctcttcatgaagcttcatggaaaagggagtgctcaaaaaaaagatgaactgattcaacgtttctctcttgatcctaagaaaaaagcaaaaaactattcaaaaggaaatcgccaaaaagtgggcttgattgctgctttggctgttgattcggatctctatttatttgatgagcctacttctggtttagatcctttgatggaaacgattttccaagaagaagttgaaaaattgaaagaacagggcaaatccatcctactttcttctcatattctcagtgaagtcgagcgactagcggataaagtcgtgatcatacgcgaaggaacagtcgtagaagaaggaacactcgatgaattgcgtcatttgactcgttcgaccatcactatagaaacagaagcagagaatagtcacttagcacaattgaacggtgtccatgactttgtgcaaaaaggtcacctcgctcaatttgctgctgataacgaagctttcgatgtgattttagctgaagcgtccaaattaggtgtgaaaaaatttgaatctattccaccgactcttgaggatttattcatgagacattatgaaggatgaggaggaagcgaaatgactgataaattttcacgctggtccacccttttttctcaaaaccttagccgtgactggaaaaagatcctgatatggctagtcggtgtcactgctttttctggtggttttgtccctgcgtttgaagaattgacttccggacaaggattagctggattatacgaaaccttgcaaaacccggcaatgattgcaatggtcggaccaactccagcttcgaatgctgctgagtatactttaggagcgatgtatgcaaatgaaatgttgcttttttgcagtttgtttgctgctgtgatctctgttttacacgtggtgagccaaacgagaaaaaaagaagaacttggtctgattgaacttattcgttcctttcgagtcggacgtcaagcaaactctttagctgtcatcgctgaaagtattctgatcaatttgcttttagcaatatcgatcagctgtacgatgatttttttccaagcagattcgatcactgcagaaggtgcttggctttttgggatatctgtaggtagtatggggattttggggagtgccgttgcactgtttgctgcacaactgatgccaagttcagccagttcgaatggtctgtctttagcgtttttaggtggactttaccttctacgagcaataacagatgtagctgattcctccctttcgatgtggaatcctttaggctggtcttatttgacctatccatttacaactaacaactggattcctttgctttatttgtttttgttcagtctaatcttgataatcagttcatttgttttagaggaacatcgagatttgaacaccggctatatccccgaacgtgaaggaaaaccgtatgctaaacgttctcttttatccttgcgtggtttattattctatctaaataaagggatgacaatcagttggcttatcacttttggtttgatgggggcggcatacggctctatctacgggaatatgcaacagtttttagaaagtaacgacttaatgaaacagatgtttatccaatctggcgtctcaattgaaaaaaactttacaagcacgatcatggtcgtcttgatttgtctagctgctattttaccaattgctagcatcaatcgtttatttacagaagaaacccacggacgtatgaatcagctgttcgcaacaaaaatttctaggaaccaactttattggaccaatatgttactagctattctatttgctatattggcaatcctgattagttctggtgcactagggctttctgctttggcttcgatgaaggatgcgaaagacatggatctattgatgtttcttaaagccgggttcaatttcctgcctgccgttttagtgtttatcggaattagtggctttctattcggatggcttcctcgaatgggtaaacttgcttatatctacttagcttactcctttgcactcaattactttggcggaattttggatttaccagaatggttttccaaaacagctgtccctagctgggttccacggatgccaaacgattcttttgatctttccgtgttccttacgttatcatgtatcagccttgcactgttcgtccttggttctattggttataggcgaagagacttactagaaggataataaaaaagcatgtacaatttcatgctagcctccaaatctgggtcaaaaatccaacatttggaggtcatttttttatttacaagtcttctaactgctctttatcaatgatccagacttctcgattctttctttttacataaccattctcctctaataatttaaattttctagataaagtttcgggggtcgtaccgataaatgcagcaagttctttcattttcattggcaggaaaaagtgatccttccctgtcgctttagctaagtcaagcagatagacagcgactcgttcttctactttttccatcatcaaaaaagttgtctgctgctgtacttttgttaatttctcaacgttgattgctaaaagtttcagactaagggcgggataatgcagtaagagttccgagaaatctttttgtctcaatatgcaaatttccgttttttctagtgcttcgccaaataaagactcatttggaacgcctagcaactggctctctccctcatatccgcccggctctattactcgtaaaagctgttcctttccgctagcagataattgatacactttcatactgccggaggccacgatcactaattgaggttctccattcggcgcaagaatctgttctcctttttccacatagtgatgtttgacaagtgcgtgtactttttcttgatcttgctgtactaagtgattgaacaaaggaacaaatgaaacacataaatgatcatgactcataatctctcctccttctaaacagctatttctaataaagaaacataacttcccttattccaactgataattttcttttatcatagcataaacgtcaagcgaaccagataccagcaaatagagtggatttctttttgtcccttactttattttccttcttttgagaccttaagtaattgattcctatcaattttttaaatatttactttttgaataatcaaaaacaaaccttcactcgcaagccgagagtaaggtttgtttttcgcattgcttatttcgtgttgtctattgaaatttttccgcacctagcttttgatatagtggtgctagttcttgtaaggtttcagcggttatttgctcaacgtgttcgatttcttgcggatagaagaatagtttacccatttgaaaggttcggtctctcatcgcttttttcaactcttcttgtttctttgtatcggacaaatagtcagacaaagctaagtggtcgtcaagttcatgttctggttgcggccatatgtaataatccttgatatcgactgttttgctccactctttcagtatcgcaagcaactggttatacgctgcaatgctaccatatcgttcttcgcttttataatgttggtacatcaaatagatttggtattgtttttgattcaacaaaactgctagacaggcattctcgtcttgacgagattcgcttcggtacgcgctccaaaaatgactgcgtaaattccagccattcgtccagctttcgattttaggtttgctcatgccgtacatatcaggcaaaagtgcagctgtctggagctgaatctctttccatttttgccagtgttctttatattctttcttgatttgttcaatcttatctgttggatggctctctttgagctgtttgaatgcgtagattggtcgatcaaacaactgataatctgattttccaagttccattgtttcgcctctttccgttatcttttgtattctacctgaattttgcgatatggacaaatagaggttgtgaaaaagctgttctgcatcaagtcataagaacagccaaacaaaaaactgcgatgagcatcaccgcagttttattgaacttaaggttgattgatcacatctaaaagcgttgaaaataaaatggcactagaagcagctcctgggtcgatatgtccgattgcacgctctcctagataggaagctcgtccttttttagctaccaagactttggtgtgttcttttgcctggtcaatgatttcttttgttaaattccctgccttcaacgcctctgtgactggcagccaaacatctaacatcgttttatcgtcagcttctgcctttcctcggctttgaatacccgctgttccctgctcgatcacttcgcctaatttttcttgagaatcaatagaatcgacctcttttgtcgctttcatcatgttcatgaatgcagatccgtataacggaccagaagccccaccgactttcgatatcatcgccatagagaatactttgaatgtatcgctgattgtttcaggatgatcggcttgaaaagcttcttcataagctgaaacccctcttcccatgttatttccatggtctccatcgccaatcggggtatctagatcactgagatattgtttgttctgattgattgcctctgcaaattgcgtgagccattcttggatttcttgaacggttagtttcatattatcacccttttatcttgagattttttaccatgaaatcgtctgtacattgctttctaaagaatctttccattgtgtctccgtcaagtcgatcagtgttagagaaagaccttgcatatctagtgaggtcataaaattaccgacttttcggaaaactacattgacgcctctttcttccaacagagctaaaacatcattcatgaacacgaactgttccatcaaaggcgtcccgcccattccgttgactagtacacctgcttcttttggtaaattcgagtaatcatctaaaatcttagtaacaagttcctttgccagtactttagaaggctgcatcttttctcgacgatagcctggctcaccgtggataccaacaccatactcgatctcatcttctcctagttcgaatcctggtttccctacttctggtacagttgctgctcgaagcgctagaccgatcgtcttagttgcctgtacgaccttttctcccagttctttcaactcagctagggaagcaccgtttcttgctgcatcgcccacgattttgtgtacaaggacagtacctgcaactccgcgttttccagcagtatacgtactattttcaacggcgatatcatcatctacgatcactctttctacttcaatatcgtccatagcagctaattcctttgccatatcgaagttcaatgcatcccctgtataattcttaacgatcagcaaaactccttttccactatccgcttccttaatagccgtctgaatctgatctggagttggagaagtaaacacatcaccaagcaccgctgcacttaacatcccttcccctacaaacccggcatgggatggttcatgtccgcttcctccaccagaaaccaaaccaacttgttccgctttctgattcttggctacaacacgggaagattctacacgatgaacaagttctggatagctttttactaatccttccagcatttcttcgacaatattgcttggatcattcatgatttttttcaatttattcccatcctttctttccggcattttgtgcttctgttaagatttgctgagtatcatctgttataccggcagtgatggctgctgcaaaagctccttccactaaaggcgcatccaccagatgataacgttgctgctgctcttcttccaacatgtcttttgccagttccgagttcaataccgcgctaccgatatccgcaaaaacaaaataactagctgcatcgcttgattcattgactgcttctacgattttcatcgggtctgatccgatctcgccatttattccgccgagagaaaaaatttgcacctcttcggatttttgcatctgctcaatcatttctttaataccatctgttactttttgactatgagaaataagcaaaatactttttttcacaagaatcttcctttcttttacatagttgctaacgattggtttcgctttcattaatgaacaattcaagtatataataaatttctaattttgggaaaatatgtgtagtgcttcttgaagtttgttatactttaattaaaagagaggagtgatcgaatgattacaacaacaacgaacagtgtagagggaaaagccgtagtagcttataaagggatcgtttttggtgaggtcattactgggatccatgcatttaaagacttggaggcggggttgcgaaatatctttggcggccgctcaaaaagctatgaaaacgaactaatgggtgcaagagaagaagcacttgccgaaatggccgaacgtgcaaaagtattaggagctgatgcgatcattggcgtaaaaatggactatgaagtattaggcagcgacaatggcatgctgatggtcacatgtagtggaacagctgtctccacgagataagtaggggacatctgttttaataactaaagagagatgggacatgtagtggcactcaagaattagatttttcagtctaacttcgaggtactctaccttcccatcctctcttttttatttctttttgcggatgattccgtaagctgctgcgactaacacacccgcccctgctaaggaataactgacagaagctgttttttcatttgtttttggcaaagtctgacttgttgatttggatggctctgtcgtttgctgaactgtttctgtcgtgcttccagaggtcactgatttttctcctgccgaatgcaaaatatcttttattcgttggaaactagctgctaagtcagctttttttgcttcaaaatcattagcaactgtttgtgcttcgctgatctttccgtggattgcttgactggccactgtgatatccgcttgagtttgacttagctttccagaagctgtttgagcaacctgatttaattgctgattgaattcttttgcttgttggatcttcccgtcaagatctgtttggacagcttccgctttcgctttcgcttcggcaagctttttctcaagttgtgcacggtcatttcccactttatttttaagatcagctaaatcttgatcgattgctgcttggtcttctttcaatttgttttttgcagcttctaatgcttcttcgagttcttttcttttattttccaagtcttgcaaatgatcgatttggtcagaagaggtagaactatttattgatgtatcttctgaagatgaaatcgtttctcctgaattatctgtcggtacattggaagtcatttctgtttccgaggcaccgttttcagcaccagaagagcttatagttgttgaaggttctgtttgagcaggttcagaagtttccgcaaaagctatctgtcccaataagaaaatactggaaacagcaattggccagattaacggcttcattctttttttcatcacttttcccatccttactactttttaactaatttcttattataagcaaaaatgtttggaagaaccataaacacaacaggctgtttgtctaaaaaacggtgcatcttttatttttttgtacgttccgggcttttccatgtcccgcttccataacctaaaatcgttttgactgctggaatgaaagtcgtcacgatcgttatcgcgttcactatccagaacaaaagcatatatagtggtgcgaaaagaaggtatttcaattttcttcgtcgatcatctacaatcagcgaagctagcaactggaaaaatcctgcgaccatttcaaagcagatgaacacaaaactgaatgtaaaagtaatataaatctgttcgtagtttccttgatatacataatgcccgattaatccagcaaaaagaactacggaaatacaaaagaatattgaccagacaatactcaatgtttgatcaatgaagatgatcgttcttccaatatgtttaaaaggatggagcatcacttttttgaaattcgtcagccagacttctgttccaccttttgcccaacgttttctttgtcgatatagcatcttcaacgtcacaggtacttccatgaaaaagataatctcaggagcaaaaacagataaccagtcatttaactgatgatcccaagcaatactgatgtcttctgtcgctcgatcttgtctgaatccgcccacatcgatcaaggcttcttttcgatacatcgtatttgctccactgtacgcataaagaccaccgaaaacagctgactgtgttcgtttaatgatgcccacgatacttgagaattcaaccgtttgagattttgcaatcaatttggtacgattttggacatccatatttgcagtgaccgcagcaatatgtcttgcaccagggcgaatgaaataattcacatacctaatcagtgcatctggctccggtaccgtgtctgcatcattgcttaaaatcaatttcccttttgcaaaggcaagtccgatattaaacgcgtgggcttttcctttatttttttcgatccgaaccacacgaagattagcgtattttttcattagtctagctaatatttctggtgtttggtccgttgaaccatcgtctgtcactaatacctcatagttgtgataattcaatttcgtcatcaaatactcgattgtatcttcgatcacaatttcttcattatgggctggcaccatgatcgtgatgaacggttcgacactcaagggaacatctacccattctttttgcttatgtttgtataaaaacacataacaccagacaccaataaaccatacaaatccgcctaaaatcggataagaaacgagaaaaaaatacataatagacaaacaagtatctaagaataaattacctgtatgggtgattgagatcatttcagttccaccccattttctttatacaaatctgcaatgaatgtcgtatctagatttttctcttcggagacagaataaaaacggaccgtttctctctcttcttttgttccaaaacgttccgtatacacttcttcaagtaattcttgtctttttttcaatttttcatcttcatattcaaaagatttatttacttttttgtatagatttcgattgttccacctagtcaatacaaatgaggtaatcaaatataaaaaataaagaggttgtgacaaaaatcgtgtcacaacctcttattccaaataaatggtattcaaaatttagttctatttattatcttgtcttattccgtatatcattcctcgataatccgacaatataactgactcgtaatgacataaagcaaaagatagataaggatcaataagccactcacaagataagccaaccagtaatcggcagtttttatatactgagtgaagacattgattgcaaatactgcgtgagtgatccctaatatcatgggtggaaagaaggtaagtgcgttttgctcgaagatcatccgtctgatccttctttgtggaatccccagcttagtcaataggtgataattttctttttcttcctctgcttctgctaattgccggactgtcaaaatactaccagtagcaataatcacgatcatcccgacaaatagtgtgacaaaaatattgataccgattcgccgattaactgcacgcaatttcgaatagctggaagagaaattcaaacgagagctttcttggctaaattgtgcttccttcatttggtcatccggaagtttctttgtgctaatttctccttgtagacttccatttacgatatcataagaataataaacagcattgagccactttatcgacaggtcattgctcagtcgttcatctattttttcattatttccacctgatacatctacattgactacttgataatccacaccttttgctttttcaaaaacggtatcatctacaatcagtacaggacttagatataccattgtttcgtcacctaatacacttggaagcatttgttgaatcttcaattcttgattatctggcagtccaatactagatccatataatgaaatattccgaaaaagagtttgcatttgatcaagcaaaacagtatgaccaggtgatttcaaagaaatgttcggcaaatctggattaacttttctgaaggcttgatattgtgtttccgtgatcagattagcagtttgaaacataggttcttcgagattttgactatagatactcccaatgactttataatgcaaggtgatttctttagttatcttctgcccttcctctgctagaatcggcttgatttttttctctgtctcaacatcaaactgatagtccatcggggaggaaactttctcctggtaggataaaatagtagagatactagccgtgccgccaattgtcattaaagaaattccgagaatgactgtaatcagagaatttgtacgccaacttttgagcaaatgaacttgcgtgttacccattatcaaaaaattgataccatagtaataaatcttccatttactcaatatgatcaaaaataaccgaaatgtataacagaaaaacaaataagtaccgaccacacaaacgaaaaaaattaaaaaaggaaaaaagaaaactaatgtatcaagataatgataactgatcatccatgaagtgatttccctaaaatgactagctccaaaatatccgctcgttaaaagtagtaacccgatgactgcgagtaatcggtgccttgtcctgaagcgcattgttgaactatctgcttgttctttttctccaaaacttcgaatcattggatagcgccatattttccatattgaatatacagatactgctaaaaggatgatgaaaaaagcaaataaagtatctactactgatggaatggagataaaaaatggactagtaagatccatatccatcattcgaaccaaaatcattgaaaagagtttggaaaaaataataccgagtaatatcccagaaatacaggcgaacaatccaattatcatgatttctaacacatatatacctgatatctgcagtttattcataccaaaaagctgatagatgcctatttccttttgccttctattcaagaaaaatcggttggcactgaatacgaaaaaaagcaaaacaacagtaatgataaatccaccaaaactcaatccaccatctatcgaagtatcttgacttgctcttctgactaaagattgatcgtaggtcattgcgctgaaggaataatagatcattacggataaagtcaaactgaaaaaataaacaagatagcctcgtgactgccgaaaaaaacttttaacggctagtttatacagcattcatttttcctcctccgccaatcgtcgcctgcatgtctattactttctcaaagaactctcttcttgtccctcttctgacaacttcagaaaaaatcacaccatctttaataaataaaattctatcgcagtagcttgctgtatatggatcatgggtgactaacagtatcgttgctttttctttttgattcatggtcttcaagtagttcaacaattctgtagccgacttcgagtccaaagagccagttggttcatctgcaaaaatcacttgtggctgaacaacaagtgctctagcagctgcaattcgttgtctctgtccgacagaaagttcatcgggataccgtttgagcagttcttctatattcaacaattgagctacatgtcttactctcttttccatttcctctttagtcatccgttcaactgctaggggcaataggatattgtcttttgcatttagggtatcgatcaaattgaactcttgaaaaatgaatcctagtttttttcgacgaaagtcactgagctcactgtttttcatttttgtgatttcttttccttggatcgagacactgcccatcgtaggcaaattgatcgtggacaagatattcatcagcgttgtctttcctgcaccacttgggcccataatcccaacaaactcgccttcttctactgtgaatgagatattatctaaggctttgacgggagaaagtttgctgccgtagcttttacttagatgtttcacttcgatcatcttttccaattcttctcctcctctttcatttttcatttctatttatttgcatagtagcatatctacgaataatttgctcttatgtttttgtcacttttacttggactgaataaaaaattttattcaattattttattcagcaaaattaaatatgcaaaaaacaaatccaccagctacaagttttcaccttttttcacaataaaatatacactacatatagtatagaaatccaattatacagcacattgaatactatatatagccgatatttagttgctccttccccgattttgttttatgatagacaagaacaatttagcaggagttgaagataatgaaagtaaattatgaagaaaaaactgtcgttactcagcagccagagacatcccagatgaaagtcatcaaacgcgatggccgccatgttgatttcgatgaacaaaagatcaatgaagcactgatcaaagcagaaaagaaaattcacggctcattatcaccacttacttatgaaaaaattcaaatgattgcagacttggttgtccaagaaatcaaaagccggtttgctgaaaatgtcaaaatctatgagattcaaaacatcgtggaacatatattactagaaaaaaacgaatatgaattagcagaagagtacatcaattatcgtaccaaacgagattttgctcgcagtaaagcaacagatatcaacttttcgattgaaaagctaatcaacaaggaccaaactgtcgtgaacgaaaacgcaaataaagacagtaatgttttcaatacacagcgagatctgacagccgggatcgttggaaaatcaatcggactgaaaatgttgccaccacatatagcaaatgcgcatcaaaaaggcgatatccattaccatgatttggattatcatccttatacaccgatgacgaattgctgcttgattgatttcaaaggcatgctgaacaatgggttcaaaatcggcaatgccgaagtcgaatcgccaaaatctatccagaccgccacagcacaaatctcacagattattgccaatgtagcgtcaagtcaatatggtggctgttctgccgaccgaacagatgaattgcttgctccttttgcagaattgaactataaaaaacatctaaaagacgcggaagaatggatcgattcgccagaacgccaaaaagaatatgcaaaagcaaaaaccaaaaaagatatcttcgatgctatgcaaagtttggaatatgaaatcaataccttatttacttcaaatggacaaactcctttcacttcattaggatttggactaggagaaaactggtttgaaagagaaattcaaaaagcaattttacagattcgaatcaatggattagggagtgaaaagcggacagctatcttccctaaactgatcttcactttgaaaaaaggtgtgaacttaaaccctgaagatcctaattacgacatcaaacaactagcattggaatgtgcaacgaaaagaatgtatcctgatattctgaattacgataaaatcgttgaattaactggaagtttcaaagtacctatgggctgtcgttcattcttgcaagggtggaaagacgaaaatggtcaagaagtaaatgtcggacgaatgaatttaggtgttgttacattgaatttgccaagaatcgcgatcgaatcaaaaggagatcagaataaattctggcagttactgtctgaccgcttagaaatcatgaaagatgcgcttctctatcgtgtagaacgttgtaaagaagccattccagcaaatgcgccaattttatatatgtatggtgctttcgggaaacgtctttcacgtaccgattctgtcaatgaattattcaaaaaccgtcgagctactgtatcgttaggctacattggattgtatgaagttgcttcagctttcttcggtggcgaatgggaaacaaacccagaagcaaaagctttcacacttgatatcgtcaaagaattaaaagctaatgcagatgcatggggggatgaatatggttatcatttcagtgtctattcaactccaagtgaaagtctaactgaccgtttctgccgtttggatacagaaaaattcggcatcatcgaaaatatcacagataaagaatattatacaaacagtttccactatgatgtgcgtaaaaacccaacgccatttgaaaaattggaatttgagaaggattatccaaaatattgttcaggtggattcatccactactgtgaataccctatgctccaacaaaatccgaaagctttagaagctgtatgggattttgcatatgacaaaatcgggtatcttggtacgaatacgccaatcgatcattgctatcaatgtggtttcgaaggtgatttcaaaccgacagaacgagggttcgaatgtccagaatgtggaaatcatgatccaaaaacatgtgatgtagtcaaacgtacttgtggctatttaggaaatccgcaagctcgtccgatggtacatggccgccataaagaaatttcctcacgtgtgaaacacatgaaatgaggttgtgaaaaagctgtcctgcatcaagtaataagaatagctaaacaaaaatagctcctcatatttttcgtttagttgggcttattactgcagatgcaagcttttgaacaccgtttagtggagaggttgtgaaaaagctgtcctgcatcaagtaataagaacagctaaacaaaaatagctcctcatatttttcgtttagttgggcttattaccgcagatgcaagcttttgaacaccgtttattcagaataagaggctatgacaagtcttttttcaccaccctctttcgatggctttgtatctttgaacgccctctatcaaaataagaacaagctttcttgaacaatggatttaggtcagtttgttcttatttatgtggtcgagtagattttatcttcaatagctatatctttgaaccttaaatgaaagaagtttttttatgagaaatccaaaaccaaaagaatggttagcaaaagactacagccaaaactatattgctgactacaaaccgtttaattttgtcgatggtgaaggtgtccgcaacagtctttacgttagtggctgcttatttgcctgcgaaggctgcttcaacaaagctgcacaaaatttccgatatggcaaaccattcacacctgaattagaagaacaaatcatcgctgacttgcgcaacgattacgtgcaaggtttaactttacttggtggcgaaccttttttgaatacagatgtttgtctgcaagtcgtacgacgtatccgaaaagagttcggtacgacaaaagatatctggtcatggacaggctatacctttgatgaattgctacaagattcagaagataaattagaactcctttcgcaaatcgatatccttgttgacggacgctttgaattaagcaaacgtgacctaaaactacaatttcgcggaagtagcaaccagcggatcattgacgtccaaaaatctttagaatccaatcaagttgtgatttgggaaaaatgtacggatgcaacagaaacctatgaacaaatcaaaaagcaagacttgatataaaaacagctttgggagagaaaacggatttccggtttcaactctcaaagctgtttttatatttcttgattttcccataatggaaggacgatgttttcataagtcatcgggtccagattcgtcaaagtaatccctaacaatcggatccctttttctactcccaagatttcctcccatataaggcttgcttgataaaagagtgcttcttttttatagatatattctggcaatgtcactcttttggtcacagtagaatagtccgtgtacctgaccttcaaaactactgttttcccatgtttttggactcttctcagtgcttcttctactttttcagctagttggcgcaactgagtcagcactgcttcttccgtttgcaacggctgcccataagtatgctcttttcccacagattttcgctctcttgtaacgtttactggagaatcatggattcctctgactttacgataaagagaatagcccatttttccaaaatttcgaatcaacatcatttctgtgcattcatataggtcttttcctgtataaatccctagctcatgcattctaggtacagttttcttccctaccccatgaaatttttcaattggcaaagcttttaaaaatggcacagcgtcttgaggggcaactaccgtgattcctctaggtttttgatagtctgatgctaatttggccaaaaacttattgtaacttactcccgcagaacatgttagctggacactctcccaaatatctgcttggatcattcgggcgattttgatggctgacttgcaattgattttattttcggtcacatcaagatacgcttcatcgatactaactggttccacaatatctgtataacgatagaatacttcccgtacttgtttggaaatatcgctgtatttatgatggtcgccaggcttaaagatggcttgcggacaaagctcatacgctttttgtgcactcattgctgaatgaattccgaattttcttgcttcataatttgctgtagtcactactccacgcccaccagtgtcactggggtgtctggcaattactaatggatgtccgcgaaactcaggatgatctcgttcttcaaccgaagcgaaaaaagcatccatatcaatatgaatgatttttcttgatgtatcattatgtaaaggaaattgcagctccatcatcctcacctcttatttattatacaggaacattcgttcgcgttcaagagatttgaaaagttagtagctgatttcctcattagtctttcattatagacaacttatactatctcagtctaattcatggtactgacggtagacttcttgttttttcagcccatttttcagcgctactgctttgatagcagcatttggtttttcgcctgaagcgatctttgcttctacttgttcctttaacgttcccaactcttcatcaacttccgtcactggcgtttcaaacaaattcccttctacaagcagacaacattcaccctttactggatgttcttcgatataagcgagtagctcttccgtacttcctctaaggtattcttcatggacttttgtcaattctcgacacaaaacgacttggcgatttccaaaaatttctaagaaatttgtcaatgtagcagtgatccgataaggtgactcataaaaaatcagcgtagctgtctgttcttttagctttttcaatgtttctttctgttcttttttcttacgtggaaggaagccataaaataaaaatggttgaggcactagccctgaagcaatcaaagccgtcatcccagctgtaggtcctgggatagagatcacagaaatcccttcttttatgcaggctaaaactagctcatgtccaggatcgctgatggaaggcattcctgcgtcactgacttgagcaatcgtttttccttcttttaacaaagcaatcaatcgagggacacgttctttataattatgttcatgtaaacttttttggggtgtatggatttcaaaatgattcaataacttttgtgtattacgcgtatcctcacttgcgataagatcggattcttgcagcatacgaacacttctgtagctcatatcttctaaatttccaattggcgtcggtacaagatataaatccccatataccggatttcccttgaaacttttttgattatacatctgtcacaatctccttaataaaaagactggagcagtatttctccgctccagtctcctcttgttattggtcatcgaccgctttcgcgatagatcacttctagacaaaacgcacaaggctcgtcattgtcccttcttgatccatataaatcgtagcagacatggaatccttcttcataaattttttcaagattcatacgagacttagaaagttcctgcttcacattttcagctggagcttgtgcaacttggttcaattcccgcaggtgttcccgcagacgttgattttccatctccaaagttgtatttttttctacgatctcatgcaaagcatgcttcatttcaacaagttctgttaatgtatttctcaactctgattctaattgattcaatccgtcgtataatgatctcttatccattcatctcacctacttggataaattctttcaattcatcccattcatattcgacaggattttcccgtccagtcagccgaatactaacgatacggctaagcagattcaaccctacgactttccctttaccatcaggtgtagcaattacttttccaaagtcagggagttcttttttcgctgtctcgtattcttcgctctcatattgcagacagcacatcaagcgtccgcataaaccggaaatttttgttggattcaaagataaactttgatcttttgccattttgattgatacaggcacgaaatcgcctaaaaaagaagaacagcataatggacgcccacatggaccaattccgcctattatctttgcttcatcgcggacaccaatttgtcgaagctcaatacgagtacgaaatacagtggccagatcttttaccaattctctaaagtcaattcgcccgtccgccgtgaaagaaaaaatcaatttatttcgatcaaatgtgtattcagctttgaccattttcatttccaactcacgcaactgcactttttcttttgcgattttcaatgcatcatgagcatcttttttgttttttttgtctttttctaattcagcttgtgacgctttatgcaagatcggacggatagcttcaggaaggtcattgggatcaatctcttttttaggaaggacaacagtagcaatatgtaaggattgctgagattcgactaataccttgtcattataaacatattcagagtctcctggtgcaaaataatagatatgacctgcatctctatatcggacacctactacttctaccatttccatcctccttgatcatcatcctttgcggcaagctaaaaaatcgtatgcaaaacgaactgttccgcaacagcctgaaaactgacattgctgcgtagtttctgctctgcgatcaatatccgttcaattatctggtttatctgtttcactttgccatattcgccgtttgctactgcttgacgctgtgcttcctgataataaaacatcaagacagataatcctgtaaactgttgtgttttttctttaaatgattttaccaattttttttggacatagataaaggcttgagtatcttgcttttgcaagtaaacgaaccattgataaatcaagtccttagcatcattaaaccattcatcttgagagatttcaactgcttttcctaaactgtttgttaagaaagccaaaagttttgctttttccaatggaatctgctcttcttgcaatcgatggatcagtgcttctttcgaaagttcttgaaaatgcagaacttgacaacgagattgaatagtagggagaattcttcctactgcatctgtttctaacaccgctaaaaaatctccagggggctcttccaagaatttcaacaaactgtttgccgcactgctattcattttttcagcttctttgatcaaaaaaactttttttcttgattcgtaaccgctgcgactgaattccgtctgcaaacgtctgatctgatcgactttgatggtttgtccttccggttcaataaccaaaacatctggatgttctttcttttcgatccgctgacaattgttgcattttccacaaggcagattgtctttcatttgggtacagaacaggtgctgtgcaagccatatacctacttcatgttttcctgttcctttctccccttcaaaaagataagcatgagcgatacgcccatgctcaaaactccgttgaagctgctgatacacgatcggttgcatttgagccaagtttatttcttgattcatagctcagctcctcctaaaattgatggaatccttcaacaggtaagacgaagactgtggcaccgcctacttctacttctactggataagggacgcccccatccatcgaaatatccagtgtaacaggtgtagatacaaattgctttcttgattcacacgtttttttgatgatttccaatgcttcttctacacggtcatcttcaatacccacgataaacgtactgtttccagccttaaggaagccgcctgtcgatgatagttttgtggcacggatatttgcatcaatcaattcatttgataaacggttgctgtctttgtcttggataatcgctaaaataattttcataaacgttcaccttcctagttttcaaaaaattgcggatactgttcaataattgtatgataacttgtttgcagcacttcttcaaagctttttcttgcatcaactttgtggattctttccggattctcttctgccagctttaagtaagcatgacgtacacgctggtggaattccaaaccttccgaatctaaacggtcgatttgattttgtctgtttttcttgattcttcttaatccggtgtctgaatctacgtcaagataaagggtaaaatccggcgtagtaccttctgtagcaaactcattcaaccgagcaatctcggtaacgccgatgcgtcggcctgcaccttgataagcaagagaactgtcgacaaatctatcgcataaaacgattttcccttttgccagagcaggcagaaccttttcgactagatgttgtcttcttgctgctgcataaagcagtgcttccgtacgttcatccatccgatcattttttggatcaaggatcactgctcggatctcttcagcaatcggaatgcctcctggttctcttgtttgaatgatttctgtttttgctacttctttcaaaagagggtaaagttcattcaagatgctggtttttcctgcaccatcaggcccctcgattgtaataaatagtccgttcacattgttgcccccatctcttgtgctgcttttatattgtatctgaaaaaacacttaattagaaatttataactcacgtcttccttcgacagctttcaataaagtaacttcatctgcatactcgatatcagagcctacagacagaccatgtgctagacgagtcactttgatacctgcgggtttgatcagacgtgagagatacatagctgttgcttctccctctgttgttgcatttgttgcgataatcacttcttttacatctgcatcatgcagccgctgcaacagagaagaaatattgatgtcttctggacctgtcccttccatcggtgataacacaccatggagaacatgataaagtccgtgatattctcgcattttttccattgccattacatctttcggctcttcgaccactaggataacgcttcgatcacgtgaaggatttctacatatttcgcagggatcttcttctgtgatgtttccgcagatactacaaaaatgcaaatcgcgttttacacttaacaaagatttagcaaattcatttactacttcatctttcatatcgatcgtataaaaggcgagtcttgtcgctgttttctgaccgattcctggaagtttcatgtagctgtcgatcagtttcgcaattggttctggatattgcatattcattactccttcagtttaaaactaaaatcctggcaaaccttttgcgtatttccctaattttttctcagtttccacatcaatttgtgcgatcgcatcattgactgccattacgacaagatcctgaagcatctcgatatcatcaggatcaacgacttcttcattgatttggatatctttcatgcgacgatcgcctgtaaaaaccgctttgaccaattcattggtggctttacctgtaaactctgttttatttagcagctcttgtgcttctgccatttctttttgcattttttgtacttgtttcatcatgccttgcatattgcccattccacgcatcataattatctactcctttttattaatcatctaccactgtaacagcttcggagccaaacagttcctctgcttttactacaagtgtttcttctggtacttcttgttcttgaggaagcaactcgatttctccttctgagtcttcagaagcaaaagagttttctgttccctcttcttgtgcctgcgtcaaataatttcttcgaagttctggccagctttctcttgtaatataaacaggatcaggcgcataatctttgatcattcggcttaagttgttgtgtaccgaaagctgcaattcttcgtcatttgctgctctttgacaaacaatctcataatcaaacgcaatcactagtcctgtaggtccagctgcaactggttcgcttgctttaagcattgctcgctgagtgacagatagactcatcagcaagtcttcccatacttcttttacttggttcagatgctgtcttgtcgcttcccgcagaactttatatactcgttccgtcggtacacgataggtacttgtctgttttttatgatttgtttgctgtaccggctgtacttttgtattctcaattcctgtattactgcgtagttccttgatttcgtttcttagttccttaatctcttgttgtagctgttttactatctgatcatctgcaaatgctacatctgctgaaggaacagaagcagacggtagctgtgcaagtttgactgtagcgacttccaaataaatagcggcactattggtaaaacgaatttcattttgagtatcgctcaaaatctttatcattgaaaacagctgatccgctgaaacagtttgtgtcaattctgtaaatgtacttctgatcgtactcgattgttcctcaactaggttaggtgcttgctgatacatcagcaagtcacggcagtattgtaacatatcctctagaaagcgacgtgattctttgccggctgcgagaatttggttcaatgtttccaatgcttctggtacttcttttttcacgcaagcactcaagtaactgtccatcatttcgtcagttaagctacctgtcacttgcatggcatcatctaaagtaattgttccttcactaaacgagattgcctgatcaagaatactcaatgcatcccgcatcccgccttctgcagaacgggcaatcacattcaatgcagctggttcatagctgatagtcgattctttcaagataaattcaagatgttcgacaatatctgccgtattgatccgtttaaaatcaaatcgctgagtccgtgaaatgatcgtagctggtattttgtgaggttcggtcgttgctaagatgaatatgacactttcttttggctcttccaatgttttcaacaaggcattgaaagctcctgttgaaagcatatgtacctcatcaataatgtacactttgtacgctgcctttgtaggcgcataatttgcccgatcacggataaatcggatttcttcgactccgttgttgctggcagcatcgatttcgatcacatcttcttgcgtaccagcagtaattgatcgacacatttcgcattcgttgcatggctcgccgtctttactgttcggacagttgattgcttttgcgaaaatctttgctgcactcgtctttccggttcctctgggtcctgtaaacaagtaggcatgtgaggttttgtgggaaacaatagcattttttagtgtctgtgtcacagctttttgtccaacgatgtcttcgaaacgctgcgaacgccagactcgataaagtgcttgatatgccataaggatcccccttttttaaaaaattcactatctcttattatacgtgatattaggtaaaaaaactactatccttctcggctttttcaggtatttaaacaatacgcaattttccatttcaattccgtctctagtccgagaagtttcacatcttcctatggtataataaataaacaataattgtttggcattagctgaatcagaggaggaattttttatgggtcttatcaaagcagcaacaagtatggttggcggcggtctggcagatcaatggctagaagtcatcgaaccagacaatatgagtgatacaacggtcatgacaaaaggtgtcaaagtccgcaaagatgacaaacgtggctccaatcgtaaaggaacagaagatgttttaacagacggaacagtcgtccatgtctatccaaacatgatgatgcttttggtcgatggtggaaaaatcatcgattataccgctgaggaaggttattacaccattaaaaatgacgcagctccttccatgttcaacggaacactgaaagaagcaattgctgaaacttttgaccgatttaaatttggcggcgtcacaccgcagaaacaacaagttttttatatcaatctccaagaaataaagggaatcaaattcggtacaagcgcgccgttgaactactttgacaatttctataacgcagaattattcttacgggcacatggcacttattctattcatgtcgttgacccgattttattttatacaaacgcaatccctaaaaacaaaacacaagtggaaatcaatgatatcaatgagcagtatttagctgaattcctaacagcgctgcaatcagcaatcaatcagatgtctgcagatggtcaacggatttcttatgtaccatctaagagtttggaattaagcaaatacatggatactgcattggatgattcttggcgtgaattacgtgggatggagattgtttctgtggctgtagccagcatttcttacaccgatgattctgtgaaactgatcaatatgcgtaacgaaggggcgatgctaggtgatcctagcgtacgtgaaggatacgtgcaaggttccattgcacgtggtatggaagcagccggaaaaaatgaagcaggagcaatgaccggctttatgggtgtaggtatgggaatgaatgcaaatggttcttatctttctcaagcagctcaaaataaccaagaacaaatcaaacaacaagcagaaaaacaaaatcaacaaactgcacaaggaaatgcggatacttggacatgtccagtttgcgggacagaaaattccggaaaattctgttccaactgcggagctgccaaacctgtagaaaacgttcagcctaagctacaaatgcgatgcagtgaatgcaatgagatcgtggatctttccaacggcatccctaaattctgtccaaactgtggtaaaccgtttaaaggaatccccgttgattaatttatttagaaaggtgtgcagctgatggatgttcttacacataaatgtcctaattgcggcggtccgttgacttttgatcccaaagaccaaaaatttcattgcgaatactgcctgaatatctatacagaagaagaagtcagccaatatgagcaaaagcaaaaagaagcgcgtatggctggcgaagaaagcaaagaagaaccttcacctaccgaagattttacttttacagcccaagaacagcttgccgatatgaatgaagccgagcgcaaagcggttgacgaggcaggcggtttttcagatacagcggacgaatctgcagataataccgcagcgatggatctttttctttgtcccaactgtggtgcagagatcgtgactgatgcgacaactgctgcgacttattgttactactgccataatcccgtcgtactatcgggacgtttaagcggagaattcttgccaaataaagtacttccttttgctgtcgagaaagaagaagcaatcaacagatttctcgcttggaccaagaaaaaatggtttgttcccaaagcttttttcaataaggatcaaatcgataagttgacaggtgtgtatttcccttattgggctacagatgctgaagtagatggtgccatgcaggcgaatggtacagttatccgcatatggcggataggtgacatcgaatacacagaaacgaagcaatttgctgtttcaagagcaggcaagctttcttttaaagaactagtaaaaaatgccttatcaaaaaatacgcaacaaaagatggtcgaaggcgtgcaacctttcccgttagataaagcaattgattttaaaagccagtatttagccgggttccaagcagaaaaaagagatatcgaatatgaggcaatcaaatcacagattcaatctgaattaaaagactattcagagaagctgttaaaagataccgcaaatggatatacaacattgaccagtgtgcgaacttctgcttcaatcacaaacgaagtaaataattacgtattactgccggtatggcttgttacttatcgaagcaatgactcaagtaaaaaagtctactactatgcaatgaatggacaaacaggaaaggttagcggtgtcctgccgatcagccagaaaaaattgggactgaccgctcttgggattttcgctgggctagcgatcctctttctgatcggaggttacttgatatgatgaaaaaattttttttattctttcttttgctagtaagtgttggctggccggtggctactcatgcagatacagctacggtaaatgatgaggctgggttatttacaacagatcaaatccaatctttggaacaacaggcagaaaagctgaatgaaaaaatcaaaggacgagtcttgatcgtaacgactacatctaattcagaagaaccaagagactttgctgataattacttaagagacgcagtcggaaatgatcaaaatggctcagtattgctattagatatgggacagcgtgaaatctacatttcgacttctggtaatatgatcgattatttgactgacagcagaatcgattcgatcttagatgatgtttatgatcagatgacaaatgctgcctattacaatgctgcaaaagcttacctgtctaaatcagcaacatatgtggaagacggagttccaggaggacattatcgtgtagacgaagaaactggcaaaattacacgctataaggttttgacgacagtagaaatcatcattgctgttgttttggctcttatccttagtcttgtcttttattttgtgactgtttcgcgttatcaattgaaatcaggcatctacaaatatccattccgagaaaaatccagtatcaaattaactgaaaaaaccgatcgtctgacaaattcttttgtcacgacaagaagaatccccaaaagcccacctcctggaagcggcggtggcggaagtactacccattctagcggtggcgggacttttggcggtggcggcagaagtttctaaaaattgctaaatgaatgttcgcaaaaaaagggctgtgacaaaaatcgtgtcacagccccttttgttgcaaataaacggcgttcaaaagcttacatctacggtgataagtccagccaagttaaaaacataagagactgtttttacttggctcttcttattacttgatgcagaacagctttttcacaacctcttccttaaacggtgttctcctaccaactcctcggtcacaagtcacaatattcatcaaacatgaaaagctgtttttttgaaattgttccttgtgactcggagctaaacggcagactcacgacctctttcttaaacggtgtacaatcagctgtccttcggtattagctcaaaaaacggcaaaatatgaggaactatttttccgtttgtttctctaatactcaggtcaaaacgctgatttcacaacctctttgttcatcaaaagataatattgtcttctaacaagtccatattcaaaataacgatatgatggtctttaacggtgataataccatcttttttcagttgttttaaaattctgttcacactgctagcagttgagatgccacaaaatttggcgatttcttcattcgtgatcgaaaaatcgatcagcatcccttcttctgtccgcacaccgaataaatcatataattcgtaaagttgcgtacaaacagctcccagctttccgtttaatagcatttgctgcatttttttcatcgaataaagcagacgatagcggtaatactcttttacatagtgttgtagctttgggtcttggttgatattttgccaaaagcgcacacgattgattcgataaaactctgcatattctgattcaactcgaatattatacggcgaatcgatgaattgtgaatattcgtcttttaaaagagagacgatttcaagatctttgatatagcgaaggttaaattctctcccatcatttgaaataacacttgcttttaccgttccctctttcaagatatacgtatgggaatcttccatcccttcgaatgtcaaatatttatgatatcctttgcgtataatcggaaaaccatttttatccaaatattcctttaagactctactatccaatgatgctcccccatccaaactttcatctaaaaagatcatacagtactttaaaactttttaaagtccaaaggtattttactaatgatattaacatttgttaagtacctttttccatcacttatgcgatttttttccttttttttattcgttatactgcagaagtaaaattttttaagaatagagggaaaaaacatgaattactggatgaacacaatcattaatcgattagaaacagcatatcaaacaagatttgatatgaaagcttctttagtctttttaaatgatgcgtatcaaaactcgatcgaattgatcaaagcagtggatgagaatccaacaaacgaatgcgaagaatttttaaatctgtttatgtctacaagagatttatttattcgccaacttgttgatcgctatccatccaattatcacgatgtagaagttcaaatacaaaaattaaaagcatattcagcttaaggggaatgtataacatacatggaaaagaaattatttaataaatattttattggaatcacattgatcaattttattgtctacctgatttattatctgttgatggtcatcatggcagtcattgcgcaagacaccttacacgccagcttgagccaagcaggttttgcttctgggatctatatcatcggaacattgctggcacgcttattcatggggaaacagttagaactatttggtcggaagtttaccttaagaggcggcgcgatcttctatctcctttcaacattagcatatctttatacgccaactatcggggcattgtatttagttcgattcttgaatggattcggctacggtacagtttctacagctacaaatgctattgttactgcatatatccctgcatctaaaaaaggggaaggcatcaattattatggattaagtactagtttagctgccgctgttgggccatttttaggaatgattttgctgaacatgactgattttcgtttcattatctggttttcaattgtactggtcttctttgttacgattgcctgccttgtctttcctgtaaaaaatattccattatctgaagaacaaaaaatatctcttcgctcatggaatatcaatagttttattgaaaagaaagcacttttcattacaggaatcgcctttttgatgggtctttcttattcaagtgttttatcatttttatcttcttatacaaaagtaatccacttagttgctgctgggtcatttttcttcgtcgtatatgctttggtcatcacatttacacgtccattgactggaaggattttcgatgtcaaaggagaacaatacgtgatgtatcctagctatttattcttaacagcaggattatttttactgagtgtaacgacgaatagtgtgacattgcttatctctggagcattagtcggcctaggttatggtacgtttatgtcaaatggacaggctgtttgtttaaaaatcgtccgcgaacatcgaatcagtattgctttatctacctactttattggtttagacctaggcttaggcgttggtccttatttgatggggatgctaaaatctcttacttcatttagaggattgtatgtgattgccggagtcattccattgatatgtacagcactctatcttgttaatggccgaaaacatagtcatgaagcagagggcgaattgattgaatcattgaaaaatgaaatttgatcttgatgaatagataaaaaaaaccgttcagatctgaaaatgatctgagcggttttttgagtaaaaatagtttatgattattcttaattaaacatctatttatttttaaagccttcatttatcgataagaatagtttaactgttgatttattccattttccgttcatctggtacgatgccttgacttagcaaccacttgtggaagaaccattctgccacaccgatcaatagagcaggaatcaatactttcatccaaatatcgactgtatcattcataaaatatagatagagccacaagataactgcagctgaaccagcatctgcgatcgtcgctgcgatgttccctactttacgtaagatcaacagatcccctagcacatagatcatgactacaataattaccccaacaatcgttgaatccataaagctaacaccgtataaacctgtcagcacgacccacagaatcgcccagatcatgattgccttcactaccaacgccttcacatgtttcattttctgcactcctttctcctggataaaaaagtaagattatctaacaagataaccttttcattattataccatcggctaagagaagcgagcaaagataaggtcctatctaaaaatgaggaagccacttagaacattcacgtaataatttatccgtacagacattcgatatggtgttcctttactttcgcatactgttcttttgtcagttctttacttgtcaccagataatcgatttcatgaaaagcaatggcttgatgcatgaatttatgtgcaattttttgctgtgtaactaaaacggcaagccggtctgattgttttctaaaagcttttttgaccattgcctctccttcatgagtttctgttactccttggctgaaatctagcccgcgacaactcattatcgctaaatccgcataatatgacaatgcatcgttataggcttttgaaccgttgattgttgctcgtttcggaacaattgcccctcccaatacaaatacttttgccgttgtgtattcactcaacatagcagctgtgactatgccattcgtaataatctgcaaaccatcaaatcttgctaagtttctgactaaatgtaaagaggttgtactggaatccaagaacaagaccatatcatctcgaatcaaagaagaagctgtatctgcaatcttacgtttttctgtttcttcttctaatttggtaatcttcatcaggtaaggcacgtcaatttttcgattgtcaacaagcatggcgccaccgcgaactctacggatcaatccacttttttccagaaaaacaaggtcacgtttaatcgtggcttcgctataatttactaactcgatcaaatcgatgactcttgcaaattgattgttttttagataattcacaatctcctgctgtctattctccacttcattcaacataaaatcaccccatttactttatatagtaacaggaaaaaagaggttgtgacagaagtgattggattcaagaagtaagaagaaacttttcgaaaaaactacttctgaacatcgtgtgtggttaagaaggtatgacaagactattgtcataccctcttgatcatacatttttatttttagtataaactagccttgcctactgtgttcaaaatttccattttatgtttgactacttcttgtacctttttattagctgctggataaattgcattcggctcgtacatcgatggatgttcactcaatatttctctcaaagcattgaaaaagacacttttaagatcagagctcaaattcactttggcaactccgtattttacagcttcgctgacttctgcgtccggattacctgaaccgccatgtaaaacaaatggaagatcgatttgttggttcaattctttcagtaagtcgatatttaattttggagttctgtttttcggatacaagccatgcgctgttccaattgctacagcaagtgtatcgatgcctgtttctttcacaaaaatctttgcttgatcaggatctgtataaatgattgtttcagcacccccttcagcagaaccattattcccaatcgttccaagctcagcttccactgagacatttaccgcatgagctaacgcaaccacttttttcgtaatctgtacattgtcgtcgaatgatttcaaagacgcatcgatcatcacagaagaatagccgtttcgaatcgcccgtaagacatcttctatcgtaccgccatgatccaagtggataacaatcggcagtttacttgtataagcataggctcttactgccgcaacaaactcaacacttaaataggcgatttcatcaggatgaatttctaagattactggtgcttctaatctctctgcttcttcgatgattgctttcatcatatcatagctgcaaatattgaaggctggtactgcaaattgattctctttagccactttcaataactctttcattgtatataacattacgcttccacctcatttgttagattttcatttttcgtccacttgtcttgttttttctctttcactgtttttttcaatagtccaagcataaaggctgtagtgactgtacctgctgcaattgccaagacatacataggtaaattgttcatgacatttggaattagcatcacccaaattcctccatgaggtgccattgaagttactcctgctgccatggaaatccctgcagcgactgctgaacctgtcatcaaactaggtatcacgcgaatcgggtcagataccgcaaacggtatagcaccttctgtaatatacgaagcgcctaaaatccagcatgattgacctgaagtccgttcttctttagtaaatttatgtttgaataataaagtggctaaagcaatacctaggggaggtgtcattcctgcagccatacaagcagcaatcggtgcatttactccagctgacatcaaaccgatcgagaaagtcgaaatcgatttattgatcggcccacccatatcagctgccatcatgatcccgataagtaatccgaacaatagcccggatgtatttcccaagctattcagccaatttgtcaaagcatccaacacccatgtgatcggttgttcaatcacaaataccatcaaaagcccaataattaagatcgataaaagggggacgacaatcagctgataaatagcagaaaattctttttttacgctgattttatttgccagaaaatcacagatataccctgctagcacgccaccaatcattccgccaagaaaacctgaaccacctgtagaggccagtaatccggcaacaattcctggggcaaaacctgcttttccagcaatcgatgtagcaatccccgcgcctaacgcaggaaccatcatggcaaacgctgtatctcctccgatccttgaaaatgcagctgctaacacattatagtctgctgagttgggatcagccgctgtaatcccaaaggcaaaactcagtgcgatgatgattccgcctgcgatcacaaatggaagcatgtaattcacaccattcatgaaatgattatagattgtcggctttttctcatttgcagctggttctttttcattagacacaacgaatacgccaatatctctcaatgcttcgtctattactacttgcggttctttgattgctcggcttgtagagacacgctttacttttttcccggcaaatcggtccaattcgatttctttatctactgcaagaatgattgcatctgcctctttgatttcttgttcagataactgattttctgtttttacaccttgtgtttcgaattttgcttgatggtttagatttcttgctgttacttctaatttttctgccgacatataagtatgagcaattccagttggacaagcagttacaccaacgattttcatggttgttttcctcctttttctttactatcgctactcggacaaagactctactattttcattcttgactaatctgtctgatgatatctgctggcgtagtggcttcttttattccctttctaaaatctgcattcatcaatcgtctggagagtgtgctgagaatctctagatgcatatctgctgatttttcaggaactacgatggcaaaaatatattcaattggcatttcatctatcccgctatagtccgttaatttggctgtatgaaaaaaacacagtgctggttttgtcacatatttgctttttgcatggggaatcccaaatccatcttctattcctgtggagatctcctcctctcgtttgaatagtgccttaacgactttttgaacatttcttaccttatttgtttttttcaacacatcccctattcgctcaaataatgatccttttgaatctatcgatggatcgaaaacaatcagttcttctgctatcaattgatcaaacctcataaaaaacctctcccccacaaaaaaatgttaacgttttcttggaactgaggtcagtatagcatcgctagctgtaccgttcaatattatgaatgaacagaggaaaaagacccatcatccgcgtgtataagtcattaaaatgaacgatctagctcacaaataatcgcaagtctataacaaaacaaaaagccttccttgaaaggaaagcttagcttctaattttaggtaaatggttttttacttcgaaataaccttctttcatttcgttaataaaaggtgtctttatcatgttgatagtcaaagctatatactatttttttcattgttttgtgcattatgatcctacgactttttcagcatcaaacgaagttttaaattggcaaaaaaacataaaaaaacagactatccctatcagatagtctgctaaacgttgagttatcagcgtttttattattccgcagcgtttgcgtctttgagaccgtattttttgttgaaacggtccacacgtccgtctgcttgtgtgaatttttgacgtccagtgtagaatggatgtgagtcagaagttacttcgacacggatgactgggtatgtattaccgtcttcccattcaactgtttcttgtgaagtttttgttgaacctgacaagaatttgaaaccagttgttgaatccatgaatactactgggtggtaatctggatggatgttttctttcatgattttttcgctcctttgccctgctccatttgctgaaccagagttgatttgtcgatttacaacattaacatcttaacatgtttcagtcaaggttgcaattatcttttcagatttctggtcggattttttttaccaaaggagacatcttgaaattctttgaaaaattgctgattgttttttgttttacgcaaaaagcggatcagttgttccgtatattctaatgaatctccagtcatattttttcgaagtttccagatttcttctaattcttcacttggcatcaataattcttcttttcgggtacctgattttttgatatcgatggctgggaagatccgacgttcagataattcacgtgaaagttgtaattctagatttccagttcccttgaattcttcatagatcacgtcatccatacggcttcctgtatcgactaaagcggtcgctaaaatcgtcaaactgccaccttcttcgatgtttcttgctgccccgaaaaatttcttaggtttatacaatgcggctgggtcaatcccgccactcaatgtacgtccgcttggtggaacaactaagttataagctcgagcaagtctagtaatgctatccatcaagataacgacatctcgtttatcttcgactaaacgcattgcgcgttccaatactaattcagaaactcgagtatggttttgcggttgtagatcaaatgtagaagataccacgtcgcctttcacgcttcgttctagatccgttacttcttccggtcgttcatcaatcaatagaacgatcaattctacttccggatagttttctgtgatgccattcgcgatttcttttaatacagaagttttccctgcttttggcggtgcgacgatcaatccacgctgaccaaaaccgattggagaaaagatatcgatcattcgggtagatagtctttgcagtgttgtttccagttgaagctgtctttgcggataaagaggtgttaaggctggaaaatgcggacgttcttttgcttcttccggatcttttccattaacgctttccacgtgcatcaaaccataataacgttccgattctttaggtggacgggcttttcctgccactttgtccccatttctcaaactgaatcgtctgatttgtgaggcagaaatatagatatcttctgcacttggtccataattgattggccgtaaaaaaccgtaaccatcttgaccaacgatatccaatattccttccatataataaaatccttgtttctctgcttgtgcacgaatcacagctagagataattcctttttgttcatcttactgtaataaggaattttaaattctttggcataactataaacttcttttaacgttttgttctctagttctgccattgtcaaataatcgctcattcagctcccacttcctctatcatttcaattgatgcccctaaggctgttagtttctcgataatatgatcataaccgcgtaagatataatctacattgtaaatcgtcgttgtcccttctgccaatagtccagcaatcactaaacaagcacctgcccgaagatcagaagccacgacttctgtgccgtgaagtttatttggaccattcacgatgatcatatttccttccacggtaatatcagcgcccattcgtgctagttccggcacatgattcacacgtttcgcatagatcgtatcgatgatttctgaagtgcctgtagtcatcaatagtaacgcagtaagtggctgctgcagatctgtggcaaatcctggataaggataggtcatgatgtttgcgggttttaattctttcgaggggtaaacttcgatttcatcttcgctgattttcatatggacaccaatttcctgcaattttgctataaagctttccaaatgttcaaagatcacatttttcactttgataccatttcctactgcagctgctaatgctagataggttcctgcttcgatgcggtcaggaatcatgaaatgccgacagccatgtaatgtttcgactccttcgatacggatcacatctgtacccgctcctcgaacttttgcccccatattattcagtaaagttgccacatctataatttccggttctcgtgcagcgttttcaattactgtctgtccttttgcttttacagcagctaacatcacattgatcgttgctccgactgaaaccacgtccatgaaaatccgattgccacgcaatcctttattttctgtccgtaaatacatggcaccatgttcatttgtcacttcagcacctagagcttcaaatcctttgacgtgtagatcaatcggtctagggcctaaataacagccacctggcaggcctactaccgcttcgccaaatttaccaagcagtgttcccataaaataataagaagcacgcaaactattgatttttccgtgcggcatcggaatcgatacgatttctcgaggatcgatttctagtatattgttggaaaaatggacagttgcgcccatgatctctaaaatttcaattaatgaatgaacatcttgtatgtccggcacaccttccaagatcactggggaatcagctaagattgcagctggaatcaatgcaactgcactattttttgcaccgctgatcgttacttcaccagctaaaggtcggtttcctttgattacgatttttttcatctgtttccaccttgtttattaatcttttttcatggatatgcttgtattttatcatagataaaaaaaagaaacgagcatggtctgccgtttaagtaaaaaaaaagatccccgactgaagcagatggatccgagatcttttcaaagcgaggtacttattctgttttccctaaatattcttccaatgttatccctgcctcggttattttttttgctgcttttttaccaacgtatcgataatgccatggttcgtaaccaacacccgtaatatgcactttgtttgatggatagcgtaagataaaaccatattgatacgcgttatctgctaaccattcatacacttctttgtctgtagaaatacttgactcagcgttgatatctactgctaatcctaattcatgttcacttgtgcctggtgcagctacccattttgctgcttcttcttttgctttttgattggaatagcctttttcttgaaaggcggcaattttatcttccatgattttttcttgatcttctgtcgttcgaaaacttgaaacgattttcggatagattccttctgctcttgctgcatcaagcatcagctgtaagtcaggatatatacgcttgtctactgcttgatcgttggatagcttttgtaactccacagtgtatccttgaggtattttatgttttgcattgactagtagtagattccatgaatcccgttcttctccacatacttggattttttgtggtgtctttctaaaaaatagacctatacttgctaataagacgattaataggattacagctactgtcttatacgatcttttcattattcttgtcctccaactaaaaaatctttgcttttcttagtaagtttaccaagtaaaacaaagacaattttctgttatttaacaagaatctcttacgattttcctacgaaagcggcaaatcaattgtgaagcttgtctcttcatctttactttgtgcagtcaattggccagcatgaagttcaatgatttgtttggcaattgctaatcccagtccagctcctcctcgatttgtttgtcgtgcggtgtctaatcggaaaaattgttcaaaaatcctagatagtttttcaggtggaatagttggaccttgattagagaaaataatcttaacccgtttcttgtcttgatctgtttttgccgagagtttgatcactgctccttcatagctgtagttgattgcgttttgtaagagattatcaaaaacgcgctgcattttatcgacatcaaaacgaatcgaaagatcagcttctaactcactttctagagtcagctgcttggaagacaaaagaggcaaaaattcataacttagctgttctaacatcatcttcagatggacttttgtcggcatcaattcgatatttgataaattgaaccgagcaatttcaaagaactcgttgatcagttcttctagtctttctgccttatctaaggaaattgatagataatgttttcttagttcagaagaaatttcctgttcatctcgtaacagtgtaagatagcctatcactgaagtcaaaggcgtcttcaagtcatgagctaaataaacgattaagtcgttttttcgttgctccgcttctttggcttgatgctgactcaaaactacttcctgacgaatttgattcaattcccattcaaactcctgtagatcttcagaaagtttgagaggttctatttgattttgataaagtttccttgaagcttcaagtacttcatccaactgtgccatacttcttgaccatgttctaagtaaaataaccaatcctccagctagtaacgcaatcaaaacgacaaaaatataatttctttctaggtttttcgcaaattgatagaatctatccgaccattcccacgtatagagcccgaataaaaagcgactaacaaaaaaaaacatcataaaagcactgattgttgctacagtaaaaatacttaattgtgtagctaatcgtttcagcaagcgtttttttaaacgtgaagaatttttggcatcacctgttttattcaactttatagcccactccccaaacagtttttataaattttggtttgcgtgttggttctttgagtttttcacgcaagcgtccgatatgtgccatgactgtattattgttgtcgagaaatttttctccccaaacggcttcaaacagctgttctgctggaacgacctcgccctttcgttcggccaaataccataggatagcaaactccaagggtgttagagagattgtttccccataaagtgtacacgtatgtagcgtttggttaatgattagtccgtgtatatcaatttcttttatcgattcttctgtcgaataatcaacttgaatgttatatttctgaaaacgtcttaactgtgttttgattcgcgcaacgacttctaaaggattgaaaggctttgtgatataatcatctgcacctaaagtcagaccagttattttatctatgtcttctatttttgctgtcagcataatcacaggaaaaaaatgattttctctgattttttggacgattttaaatccatcaatgtctggaagcatcacatctaatacagctaaatcaaatgattctctttctatgcagtccaacgcttcttgtccaagataaaatttctgtacttcatatccgtcatttttcaggtagacttcgatcaaatcagcaatttcctgttcatcgtctaccaataatattttatctggcatcgtattgtttcaccaccactaacaaattttctaaattatatcatatccatgtcgactattattaaaaacattgtgctatttaatgtacttgccttcgtattttcgttatgtaattgtcaatattctttcattatgtatctatctactcatacgaattcagttatcaatatttattttaactcataaactataagtaatcttcatttttccctcaaaattttctgatgattttcctacagatgttttttaacaaagattccttttataaaaggtttctataaccttggaataataactctcttattgataattataactttgcctttctaaggcgaataccatctactaaaaaaaaaccaaataaatatgttatttaaaaacataaaaagaacgggacaaaaatgtcccgttctttttctcacaaccgaataaacagtatttgagggctattgatgcagctaaaacgaattacgctttgttagctgaaccgaaccagtcgatatgagatttagcatcttcaacgattgctgctttacctggagctaataatttacgagggtcgaatcctttaccttctttatctttaccagcttcgatatatttacgagtagctgcagcaaatgataattggaattcagtgttaacatttacttttgagatacccattgagatagctttttcgatttgatcttgaggaatacctgatccgccatgtaatactaaaggcatgtctggacctacagcatcagcaattgcttgtaagtggtcaaaagctaatcctttccagttttctggatattgaccatggatgttaccgataccgcaagctaagtagtcgatacctgtagcaaccatttgtttgcattcttcaatatcagctaattcgccgttaccgatgattccgtcttcttctccgccgattgaaccaacttcacattcaactgagataccttttgcatgtgctttttcaacaacgtctttagctaatttcaagttttcttcaaatggtagatgtgaaccatcgaacattactgaagtatagcctaattcgatacattccaaagcagcttcgtagtcaccatggtctaagtggatagcaactggaacagtgatgttcattgcttcaactaaatcagtgattaaatctttacagattttgtaaccacccatgtatttagctgcacccattgatgtttggataagtactggtgcttgttttgcttcagccgcttcaaggattgcttgagtccattccaagttgtttgtgttgaatccgccgacagcgtaaccgcctttacgagcagcttttaaaaattcagctcctgatactactggcataataaaattcctcctaagttttgtaaaactaaatttgttaagacaattcttaaccaacgaccctattttaccaaacatttcggtagttttctactaaaatcaatgaaaatgaaaattttcaagaagttttttgcaaaaaataaaatatccaatagcgctttaatcgaaaaaagtcttttgctttctatcttttttcctacaaataataacaaatcagaaaaagagaaaagtgacaagaaaattgcttatccccttctcttgctacttttctctttctatcaagttcaaaaattattttgtttcgtgatctgctaatgatgctccgacaaatgctttgattaatttttgcgggcgatttggacgagaaatcaattctgggtggaattggcatcccacaaagaattttttctctggcagctctacgatttctactaaacggttatctggtgagacacctgaaaagactagcccttgttcttcaaacaattgacgatatttgttgttgaactcatagcggtgacggtgacgttcttgcacaacatcggctccaccatatgcttcagccgtcttcgttccttttttgattttacatgggtataatccaaggcgtaaagttccacccaaattctcgatgttttcctgatcagccattaaatcaataatattgtttgctgtatctggattcgtttcagctgatgacgcatcttctaatccaacgacgttacgtgcaaattcgacacaagccatctgcataccaagacaaatacctaaaaacggaacgtcattttcgcgagcataacgaatcgcttcgattttcccttctactccgcgatcaccaaatccaccaggaaccaagattccatctgcgtctttcaaacgttcttctacattttctctcgttaattcttgtgctttgatccaatcgatctcgatgtctgaattataggcgaaaccagaatgtttcaatgcttcaactactgagatatatgcatctggtaactcgacatatttgccgacaagcgcaatccgtacttttttcttcaagttcaagacacgttcttctaattctttccattctgtcatgtctgcttctggtgtatctagttttaaatggtcgcaaacaatttgatccattccttgtgcttgtaaaactaatgggatggagtaaagtgtatctacatctggcgactcgataactgcttctggttcgacatcacaaaattgtgccaatttatttttcacgctttgagaaacaggttgctctgtacgtaccaccaaaatattcggttggatacctaaaccacgtagctcttttacactgtgctgcgttggtttagttttcatttctccagcagctttcaagtaaggaatcaatgttgtatggatatacataacattatctgtaccgacatctgctttcatttgacgaagtgcttcaaggaatggcaaagattctatatcccctactgttccccctacttctgtaatgatcacatctgaatcagtcattttagctgctcgcatgattttttctttgatctcatttgtaatatgaggaataacttgaacagttgctcccaagtattcgcccttacgttctttacgcaaaacttcagaatagatttttcctgtcgtcacgttggagtatttgttcaaattgatgtcaataaaacgttcgtagtggcccagatccaaatctgtttcagcaccatcatctgttacgaatacttctccgtgctgatatgggctcatcgtccccggatccacgttgatgtatggatcaaatttttggatagttacttttaagccgcggtttttcaataagcgtcctaaagaagctgcaacaatcccttttccgattgatgaaacgacaccgccggtcacaaaaatatattttgtcataagttcaaaaactcctttttaatttatgtgcaggaaaagtctcagaaaataaacaaagctccctattcttcaataagaatagggagccgaaatttctgtaaacttctgaccctctaaaagggtgcccaaggtgtataatacaagctgactaagggaaagtcaagtactcaaatgaatactatccgcttacaattttttctttttcgatatcctttgagaaattatttcttaagtcctttatgagtgcaaaaaaaatttaacccacataataagcttgatataaacatagctaacgttaaacctaagcaaatcagaaaatcgttactgaaaaattttaagtgaaacaatagataaataaggaggtgcgacaaacgtcgtgcaccccttatttctaaataaatggtgttctcctgccaactcctcggtcacaagtcacaatattcaacaaacatgagcagctgtttttgaaattattccttgtgactcagagttaaacggcagacttacaacctcttgataaacggtgttctcctgccaactcctcggtcacaagtcacaatattcaacaaacatgagaagctgttttttgaaattgttccttgtgactcggagctaaacggcaggctcacaacctcttggtaaacggtgttcaatcagctgaccctcggtattagctcaaaaaacggcaaaatatgaggaactattttgccgtttgtttctctaatactcaggtcaaaacgctgatttcacagcctctaattcacgttattcctgttttaataaagttctagatattgttctctttcccactcggaaacagtttgtctgaatgccgcccattcgagacgttttgcttcaacaaaatttgagaagatatgttgtcctaatgcgtcaatcattacattatccttacgcaattctttgatagcattatggatagttgaaggtaagtcctggatatgtgcagcttctctttcttcctcatccattacataaatgttacggtcaacagctgctggcggtgtgatctgattacggataccgtctagtcctgcttgcaacaatactgccattgccaagtatgggtttgcagatggatcaactgaccgcaattccaaacgtgtggataaaccgcgagattctggtacacgtactaatggcgaacgattacgaccgctccatgcgacgtaaacaggcgcttcataacctggaacgagacgtttataagaattgactgttggattgcaaacggctgtgtaggcacgagcatgtttcagcaaaccacctaagaaatgataagctgtttcacttagttccaattcaccgtctttatcatagaaaacatttccttcatcattgaacaaagacatattgcaatgcataccagaaccattgatcccaaataacggtttcggcatgaaagtcgcgtgaagtccatgcttgcgtgcaatcgttttgacaacgagcttgaaggtttggatattatcacaagcatctaccacatctgcatatttaaagtcaatttcatgctgtcctggcgctacttcatgatgtgaagcttccacttcaaagcctagactttctaattccaacacgatgtcacggcggcaattttcacctaaatctgttggtgcaaaatcaaaataaccacctttatcattcaaggtcgttgtgatcccaccgtcttcgtctaatttaaataagaagaattctggttcaggtcctaaattgaaagaggtaaaaccaaggtcgcgcatatctttcaatgctcgtttcaaattcccgcgaggatcgccggcaaatggtgtcccatccggattatagatatcacaaattaaacgagcaacttttccatgagcactttcccacgggaagatcatccaagtggagagatctggatacaaatacatatcgctttcttcaattcgtacaaatccttcaatcgaagaaccgtcaaacatcattttattttctaatactttgtcgatctggctcactggaacttctacatttttgatcgtacctaagatgtctgtgaacatcaatcgtaaaaatcgtacgttttcttcctcaatgattcgtttgatttcttcacctgttatctgtttctttaccatggtatccctcttccttttttaatttattcagtcaaagaattgtctttgcaatccttgcgactgataatgacctgttttgcttaacccaccttgcgccaaaatctcatcacgaaaaatttgtcgaacgtcatgatctgtcaacggcttcttgttttttgcttcttgttttttcgcctgtgccatttcgtatacacgtttgatcccagccatattcaatccatctgaaagatagtctttaatctcaagcagcatatcaatatcattcagcgaatacatacgtcggtttccttcgcttcgttccggatgaactaaatcttgttcttcataatagcgaatttgccgagcagacaaatcagtcagcttcataactgtaccaattggaaatacggacatagatcggcgcaattccttttctcccatcagacgtcccctttcgttttataagttggctaaagtgtaccaattaaaaaaaatattgtcaactgcatatgttaggttttctaacatgagatctctatttttttataaaataacaaaaaaataagaacacaaaaaaggtatctagttgattttcgtaccagataccttttattttttattatactgtactatcctttattagtgtttttattgttaaaaaaacaaaattttattagttttttcttaaccattttgaattggtttttgcaaaccctttaacttcatattcgtttgtttcttccatgtacgcttcgtccaaaaccattgtttgtcttctcaactcgcttaatttctgtccttcgttgcttggcacagaaagtgtataaggggtcattagttccatcagctgacgtttgattgcttcgatcaacgccatcttaccttctttcgtctgagtagaaatcaatacatttgggaatagcgtaggcgtgaacatcgctgggtcgatctggtctgccttattgtaaacagtcagtatcggcatttctttcatattcagttcatccatcaattttaagacagtctgctcctgtaaaatacgatctgtagaactagcatcgactacatgtagcaaaagatccatattttgactttcttctaatgtagaatggaaagcatcgatcagttgcgtaggcaggtcttggatgaacccgacggtatccgttacagtaatctcaaatccttcagcaaaacgccatctcttagtcaatggatctaacgttgcaaacaattgatctttcgaataagtatccgcttgtgtcaatagattcaagatagttgacttcccggcattcgtgtagccaataagtccaatctgaaaaatctcgctattttttcttttttggcgattgcgctctcgatgagcttctacttctttcaattctttcttaacagcaaaaattttattccgtatatgtcggcggtctgtttctaactttgtttcacctggccctcttgttccgatcccaccgccaagacgagataatgttttcccttgccctactaaacgaggcagcaggtattctaactgagcaagttcaacctgcagcttcccttctttcgaacgagcacgcatcgcaaaaatatctaagatcagctgcacgcgatcaatcaccggaagaccaacagcatcggtaatcagttggctctgtctcggagttagctcatgattaaagatgatcaaatccgcttcatgcgcatccgcttgttgaactaattcttgtaatttccctttaccgataatcgtttgccgatccacttgtggtctcttttgtgtaattgtgaatacgacttctcctgatgcggtattcgtcagctgaactagctcttccattgactctgaaaagtaacgctggtttgcttcggtttctacccctacgatgattactttttcttccattttattccgcctccagccattttttgattgtttgctcaatctgacttttttgatttggctcacttataagatcaaaccactgtgcatccaaacggttacgaaaccacgttaactgacgtttcgcgtatcttctcgaatgtagtttgacttgttctgttgcttcttccaatgtttctttcccttcaaaataagggaaaaattctttatatccaataccttgactggcctggacttctccaagctcatacaccttacgcgcttctgctactaaaccttctgctagcatcaaatcgactctttgattgattcgttcataaagaatactacgcttcgtatctaatccaatcatgaggtaatcatacaattgctttggctcttctttaggtgccgtgatactatgtcctgtcgtctctaaaacttccagagctcttatcactttgcgttgattgttccagtggattttctcagcagctgccgggtctttttctttcaactgattccataatgcttgggaaccaattgtttcagctaacgtttcgtatttttttctaatctcaggattcgcttcttctgtcgctcctaactgataatcatatagaagggattggatatacagacccgtaccaccagctatgataggtaggtgccctcggttcgcaatttcagtaatcaattgtcgacctgaatgctgaaaatcagcggctgagtaacgttgagtaggttcgatcacatcaatcaaatgatgcggaacattattcatctcttcttctttgatttttgctgtaccgatatccagatttttatagatttgcaatgaatcaccgctgatgatctctcctccaaatagttgtgcgagttccacacttagcgctgttttaccgactgctgtcggaccgacgatcactaatactttttccatattttacctacttttcgttgattgtttccaccgaagagctttctccggaaaatcagttattattccatctattttgagttcttgacatttggccatttcttcttcatcgttaatcgtccatgcacgaattgcttttggaaaatcagctgcctggactggatgttcgaacaaccaagtattttttggatgtactccttctatataaggggtttctgctgctagttggatctttttatcagaagtactcatcaataagtccagctgtatctccggttccagtaatgcgattttttccaaagaatccaaatgaaagctgcaatatgcatgttgaaaaggccaatctctactttttaatgtttcggctaatttttcttcgataccgggatattcatactgatcagttttaatttcaatcattagcatccctcggtaatttttttggagaagcagtcctaacacttctctcaattcaggaactttagctgctggaaattctttgctgaattttcctcctgcattcaattttttgagttcttccaatgttttttctcgaatcagccctttaccgttagtcgtccggtccacttcttcgtcgtgcataacgatcaaataaccatctttgcttagatggacatctagttcgataccatctgcacctactcgtacagcttctgcaaatgcaggaagcgtattttctgggtgggtgccgctgcttccgcgatgggcatagatttgtaacatctttcttcactccgttcagttctattgtatcattaagaaaaaaagaaagcattaccacgctctcatgtgcaacggcaatgcttcaaaatatcagctccaaacatcatctttcgagaagaaaccaatcggctggcgcgtcatagtcttcaactgagcttttttttcattgatcatttcagtcagactatccgtaaaattctctaaaatcacgcgtccgcctttataagcatatccaccaatcttcattgtttcatctggagataaaatcacttttcgatgggagatattcttaaatagctcgtctaaaatataatttggcaaataaaaactattttgcgctgaaaatgattggagatacgcaaaatcgtcaatcgtgatataacaatcatcaaatgcatcaaagctgacatattcttccatcagcgttgtccgtttttgcaagatctcgttgatctttttatttaattgattcagcgtctcgatttctttgactttcaattccaattcacgtctacgctgttctttattttccaagtgacgcatttgcagtatcatgccgatatagacaactacagcacctgtcagcactccgataagaccagtaataccaactatcaatctgttgttcctccttgttttgtttctctgcttatcataccataaagcgggtttatgcgactaatttgcctaagttttttatttgaccttttttgaccaaaaatgtatactacattttaggtattagaaactaaattatggtacactatttctaaacgaaatcaaggaggaactctattatgaatttaattcctacagtcattgaacaatcttcacgaggtgaaagagcttacgatatctactcacgtttattgaaagaccgtatcatcatgttaagcggccaagtaacagatgatcttgctaattcgatcatcgcccaattgcttttcttagacgctcaagattctgaaaaagatatctatctttatatcaattctcctggtggttcagttacagcaggtatggctatttacgacacaatgaactttgtcaaagcagatgtccaaacaattgttatgggtatggctgcttcaatgggaagcttcttgctgacagctggtacaaaaggtaaacgatttgctttaccaaatgctgagatcatgatccatcaacctcttggcggcgctcaagggcaagcaactgaaatcgaaattgcggcacgccatattttgcaaacacgcgaacgcttaaacaaaattttagctgaacgcactggacaaccgcttgaagtgattgaaaaagatacagatcgtgacaactatatgacagctgaacaagcaaaagcatatggattgatcgatgaagtcatggaaaacagttcttcattaaattaatctgtttcaaaggaagcttttttaagctctcttatctaaaccaaataaaaaaggatggtcaactcaaactgaccatccttttttattttatggatgctactgcctatctttgctccttgaattttccttgcgcatgcatccgacctatctcgacataatgctggatgttttctttgtttttttgtatttcttcttttgtcaaaggacggatcactttagctgggcgaccaaaagccaagacattaggaggaataacttttccttctgttactaatgatccagcaccaatcaaactattctcaccaataaccgcatgattcaatatcgtggtccccatcccgatcagcgcccctttttcgattgtacagccatgtagcatgcactgatgtcctaccgtcacattctccgcaatatctacaggtgcatcatgatcgacatggatgattgtaccatcttggatattcgttctttgtcctacttttatccaattactgtccccgcgtaaaacagcttgataccagatcgtcacatcttctgacaatgtcacgtcaccaatcactgtggcatttgatgctataaaccgttccatatttatttttctcctttcattttttgtagaaactaatcctattgaataaagatatcatagcatatatttatttcataagaaaaaaacaggtaaaacctgctcaggccagatgtctatttacagtatctggtaactgacgttttacctgtttttattgtacatctatattttcttctattactttttttaaaattaattcgtacacttctatttgtgctgccaagcgttcgatttgaaactcattttcaaaaaaatcagctgaatcaaaaggcttcgtctgacagacgtgcgttaaacgatcaacttctcttttggcttcagtaattttttcatttaaaaactgttccatctccgtgtcctcacttttcttgataactttactttaccattatcaagaatagagaacaaaaaataagttttaaactgttttattcttatatgacttattctgcttcctcagcaaattggctgttatacagtttttcataaaatccaccttgtgccaataaactctcatgcgttcctttttcaatgatctgaccttgatccatcactagaatcagatctgcatcacggattgtcgataaacggtgagcgatgacgaaacttgtccgtccctccatcacgcgatccattgctttttgaatcaacgcttctaaacgggtgtctactgaacttgttgcttcatctaaaatcaagattttaggatcggagaccactgctcgggcaatcgtcagcaactgtttttgtcctaaagacacattgtctccctcagaattgatggccatatcatatccatctggcattgttcggataaaatgatctacgtttgctgttttcgcagcatcaactatttcataatctgtcgcatcaagctttccgaagcggatattatctgcaatcgttccttgataaagccatgcatcttgcaagaccataccaaatagtgaacgcacatcactgcgactcattgatttggtgtcgattccatcaatccttattgctcctttgtctacgtcataaaaacgcatcaatagattgatcaatgtcgtcttgccggcaccggtcggaccgaccacagctacggtttgaccagctttcacttcaaaattcaaatcttggattaatggtttcttcggatcatatgcaaaatcgacatgatcgaatgtcacatctcctaaaatcgtttctggcagtgaagcatctactttgttttctttttcttctggctcatctaaaatctcgaatacacgtttcgttgacgctgatgcactttgcaaaactgaagacaattgtgtcacgttccccattggctgactgatttgccaaatatattggatgaatgcttgtagttgaccgacaacgatcgccccagtaataacataaaagcttcctagaacagccataccaatataagtagcataggcagttaattgaactagaggcatcatcaagccagaaatgaatgctgcacgaaacccaaagtatttcaagctgtgattaacttttttgaatccttccaatgtttctttttcgcgtccatatactttcaatacactaaaacctgtcatattttcttggacgtagccgtttagctcaccaagagaattctgcatgctttgaaaatatttctgcgaagcattgatcactcgttttgagatccagatcgatgttggaatcatgatcatagagatcagcgccatcatcggctggatataaaacatcattgctgcagccaacgtaattcccaatatcgcatttacgataccaataaaagcttgttgtaaagcaccgctgactgcatctacatcattcgtcacacgagacaaaatatttccttgctggtttttatcgaaatatgaaaccggaagacgattgattttttcttctatgtctcttctcaaatcatgcatggcactttgaacgacatttgtcatcaaaacaccagaaagtaattgcgaaatacaataccctattccaacaactgtgatccaaatgagacatttgaatatataagaaaaattgattgattcgccattggcaatattacggctgatttctgtagtaggaagtcctgtaacatatggcaaagccacgttgaaagccactgtcagaactgtaaataggatcactaaaagaaaagtcccacgatacggtctgatatatcgagctaaacgttttaaggaagaaaaggtttttttcatgctaattcctcctttgataattgagaagcggcaatatcataataaatcaggcatttttccaacaactcccgatgcgtccccataccgacgacttctccttcatttaatacgatgatcttatctgcatgcatgatcgttcccacacgttgtgctacgatcaatacagtagattctgtcgtttcttttttcagacgagcacgtaacttcgcatccgtttgataatctaatgcagaaaagctgtcatcaaaaatatagatttccggacggcgtatgatggctctggctattgccaatcgttgtttttgcccacctgaaaaattggaaccaccttctgataaatgttcattaaatccatctggttttcgagaaatgaattctgaagcttgagcaatctcagctgcacgttccatttcttcttgcgtagcatcttctttcccgtatcgcaaattatctgcaatcgttccagtaaatagcaacgctttttgcggaataaacccaatcttatctcgcaacttgcttagccgataatctctcacgtctactccatcgatcaagatctttccttcactcacatcataaaagcgaggaatcaattggatcaacgtagattttccgctaccggtacttccaataaaagcaacggtttctcctggagaggctgtaaaactgacatttcgaatcactggttcttgcgaatggcctggataagcaaatgttacattttgaaattcgatataccctttagtttttgtatcagatataccctttggatcttctacaatcgaaggtttggcatctagggcttcttggatacgtccagctgaaacagctgctcttggatacatcatgaacacactggcaaataacatgaatgagaacaaggcatggaatatatactcgataaacgcaatcaaatctcctacacgaagctcgcctgcatcgatttgcactgccccgctccagatgatcaataccattacgatattaaataagaaataaaaacccggttgtgcaacagccatcaaacggaataagctttttgaactagaagcataattctcattgactacagcaaaacgtttttcttcaaacttttcattgacgaatgcacgaatcacacgcaatcctgaaagattttcccgcaagatactgttgattttatctaagtttttttgttgctttttagataacggttcagacaccttagcaatcgctacgactgccaataatagtaaaggtaatgcacctactacatacaaactgagtgtcacacttgtacgcatgaccatgtacaaactgacaatgaacatcattggtgccataaaaccgatacgtaaaatattttgcaggaacaacatgatctgataagcatcgtttgttgtacgagtgatcaatgaagatacgcctagattttcgtattcctgatgcgaataactttggatcttttcgaacaaatcatctcgaatatctgctacgatattagtcgtaatcctcgaaccaaaataacctaacaagatattcaaaataataccgattacagtaataacgatcataaatatcccttgttgcttcacataatcaaaatcatcattgcggattcctacatcgatcatacgtgctaaaatcgtaggaagtcctaattcaatcaaaataaaaccaaatacgcatatgaaattgaaaaacaagaatttcttataacgcatggtataatgccacattagtttcactttctcatctccttttaatcttttgttacattttcattactaaaaatgatagcacaacgagcctattaatagaacacttctctcataaaaaagtcattatgattatagcgggatgataaacattgattttttctttcaatctagttgatttctatacttatttgctgttttatgctaaaataacaattaattgttgtatattttttatacagaaggtacggttgaaaaaatatccgaacagataagcaaaaacgaggcttgtctctttgactcgaatccagtattctagtcaaagcatatgaaaaaccaggtggcttgtcccctcgttttgtgttgtctaaaaaaatcaactagctaaatcactgctttacgcagataaaggagacaaaacaatgatctataaagtttattatcaagaaacaaaagtacgcaaccctaaacgggaagaaacaaaatctctttacattgaggcaaaaagcgatgtagacgctcgccaacgtgtggaagaaaataccccatacaatattgaattcgttcaacttctagaaggaagtcatctagagtacgaaaaagaaaatgctgatttctcattagtggagttttaatatgaaactttccatcaaaaataacgagacaggcgtctttgctattggtggattaggtgaaatcgggaaaaatacgtatggggtacaattccaagatgaaatcattttgattgatgccgggatcaaattcccggaagacgatttacttggaattgactatgtcattcccgactacagctacatcatacaaaacttacacaaagtaaaagccttggtgattactcacgggcacgaagaccacatcggcggaataccctacttgctgaaacaagcaaatattcctatctatgctggtcctctcgcattagcgttgatcacaaacaaattagatgagcatggcttgcttcgagatgcagagctccatgagatcaatgaagatacgatcatccgttttagaaagacttctgtcagctttttcagaacgacccatagtatcccagatgcattagggatcgtggtgaaaacaccttctggaaatatcgtagcgactggagacttcaaattcgatttcactcctgttggcgaaccagcaaacttgcataaaatggctcgtatcggggaagaaggagtcttgtgccttttatctgatagtacaaatgctgagattccaacatttactaaatcagaaaaaacgattgggcattctattttgaagatcttttcaaaaatcgaaggacgtatcatttttgccagctttgcttctaacatcttccgtttgcagcaagcagcagatgccgctgtggcaactggtcgtaaaatcgctgttttcggacgaagcatggaaaatgccatcgtcaacggtcaacgtttaggatatatcaaagttccagacggcacatttgtagatgcacacgaaatcaatcgcttgcctgccaatgaaacgatgatcctatgtacaggttctcaaggagaagcgatggccgcgttgagccgcatcgcgaatggtactcaccgtcaaatccaaatacagccagacgatacagtgatcttttcaagttcacctattcctggtaatacaacaagtgtcaatcatttgatcaatttgctgtctgaagctggtgcagaagtgattcacggaaaaatcaataacatccatacttccggtcacggtggacaagaagaacaaaaattaatgcttcgtttgatgaagccaaaatattttattcctgtccacggagaattccgcatgttgaaagtacatgcttctctagcacaagatgtaggtgttcctgcagaaaactgcttcatcatggaaaatggcgatgttttagcgttaactagcgattctgcgcgtcctgctgggcattttgtggctggagatgtgtatatcgatggtagcgggatcggtgatattggtaatgtcgttttacgtgaccgtcacctgctttcagaagaaggtcttgtattagctgtcgcgacagtggatatcaagaaaaaagaaatcttggctggtccagatattctctctcgtggatttgtctacatgcgagaatcaggagaaatgatcaatgaagctcagcgaatcttattccacgctttaagagaatgtttgaatggacctgactgttcagaatataaattgaaagaagcgatgactggcgcgcttcagcctttcttattcgaacgtacagaaagacatccaatgattttgccaatggtaatgacaccagatgaagaataaataagagattatgaaatcagcaccttgtcctgaatataagagaaaacaaatgaaaaacatgagaagccatttttgtttgttcttattccttgatacaaggtggctctttcatagcctcttaaatttatttacttttcatacaaaaaaatacctgccacaagagaaattgtctcttgtggcaggtatttttgttactcgctttgttctctcgtaaaaattgatgtctaccatcaatttgatttacagataaaattaagcttttacaacgtttgcagcttgtgggccgcggtctgattcttcaacgtcgaaagtcactgcttgaccttcttctaatgttttgaatccgtcaccttggatagctgagaagtgaacgaatacgtcgcttccatcttcacgtgagataaatccaaatcctttttcagcgttgaaccattttactgttccgttttccataataatatcctcctcgtgccaaaagcactaatttaaattgtaacattgctcgtgtacgatagaggtgcaacagatgtttcaacttctattcccaaacaaaattacaatataattgtacacttgcttcattttttttgcaagaaagcaacttacttctcttccatcattccttcttctctcaaactaaaatatcgtttgcgtccgatgatcaagtggtccagtacagtgatccccatcatttctccacacttttgtatccttttggtaaaattcatatcctgctgcgatggaataacattaccagaaggatgattatgcgctaaaacgatccttgctgcacaataacgtacagcataatggaaaatttctctaggatgagcgactgactgattcagcgaaccgatgaacactgttttttttaaaatcacttgattcttcgtgtccaaataaatacaaaccaaatgttcttgtttgtgatctttcatttccagaatcaattgctgggccaattcgtagctggtacgaaccggtggagccgctctttcatgatccgtctgaattcgtcgacctaattcgatcaaggctttgatttcgattgctttcacgcgtcctatccctcgaatctcttctaactcatgcaaagtagcctgtcgtaaagaggccagtcctccaaacgtttttaacagatttccagcaatcgacatcacactataagggtgttgaccggtacgcagtaagattgccaaaagctcctgatccgataaagcttcagcgccataaatttccatacgttcccttggtaaagagctagtaggtacttctttgatcaatcgttttcccaaaaaaacatctcctttctatcttatctaaaataagatacgaaaagagatggatttttattttaacaatgcagggatttcatgtaaagaagaaacaaccccagctgtttttttgatcaattcttgggatggtggaagcagatctggtaccatgactaccgggatctcagccgcagaagctgctaaaataccattttgtgaatcttctaaaatcaatgtttctttcttcgctgtacctagcttctgattagctaacaagaaaatttctgggtctggttttgctcgttgaacattttctgcagaaacaatcgtctcaaatcgttcaaacagattgttcttcttcaataaaagttcaatgactgctcgttggttactggaagcgacaactttgggaatctgatgttcttctaaaaaagagaggagttccaacacaccgggcttcatttgtaccgctccttgcgaaaaacgttcaagcgtttcctggtatgaattatctatgaatctttgtacacttgttttgccaaattccgagaaaatcatatgataattcgcccatacttcttcatctgaaacacctaagaattttaaatacaggtctttatcataaggaaaacccatcttgtctgctactacttgtgtggcttcgtaatacactaactctgtgtcgaacagcaaaccatccatgtcaaaaatcactgcattatacttcatgatctcctcctaattgtattaataaatggcgaacttctgaaatgaaataaagtgaaccggtcacaactaatacgtcttcatttgtcatcttttccaatatatctgctaatccgaattgccacaatgaaacgattgatactctctcacttgctaaatctgatacttcacttaattcgatggcttttggatgttcaaaggtcgtcaaataaatatggacatttggtacttgctgcaatcgttctagcatttctctaacatttttagttcgtaaggcggaaaacaaaatgttgatttgatatcctttgaattcttttttcaaattctcaacaagccggttcattgcatgcgtattatgggcaccatctaaaacaactaatggctcgttactcaaacgctccattcttcctggccatcgagatttcttcaatcccttcaaaacatctttttctcggaaaggcagcttttccaattgacagtaaacaaaatacaattcgatggctactcctgcattttcagcttgatgttgccctaaaagcggagtggttaattgagggatctttcctatttcattaaaaaattcaaatacttctccccacatctcatcaggatgcagatagtttattttataattttccccgtatacataaagcggtgcattttttgctttagctgtttgttggatgacagtaaaagcttctggggcaatatttcctgttactactggaacgccttgtttgatgattccagctttttgtgcagcgatttcttcaattgtatctccaagtatttcggtatgatcaagtccaatcgttgttattcccgtcagcattggtacagctacattggtagaatccaataagccgcctaagccaacttcgataatcgctacgtccactttcttcatcaaaaaataatcaaatgccattgctgttaatgtctcgaattcagtaataccagctactgcttcaaattgatcaagttgtttgatcagtggctgatatttttttacaagctggatcaaatcattgtctgggatgcttttgccattgattgcgatccgttcattgaacgtttcgatataaggtgaagtaaatgtacctactgtcagcccagcctcttctaataggcttctcaaataagctacagtagaaccttttccgtttgttccagcgatatggatcgtttttacttttctctctggatgccctaccacttctaataaagcttcgactcggtcaaggccaggacgtgaaccaaatggtaatcgactatggatccattctattgcttcttcaatcgtcatcaacaattcccccatttctcttttattataacaaatagaacacataagaaaaataaaagtatgacaaagagaaaagaaacagagagaggaacgattttatcaactactttattgactcttgatacatgatccatctccctccttctcctacataataagagtagactaaaaaagagatgtgacaaaatttatgtcacatctccttatgaatcgaagctaagagtgaggctcaaactctttcctgtaacgatgttcaatcagctagcttttagtaatagctagctgatttcacactctctttttctattcttattgaatagtacgcaaactttcgattcgttctttgacagccgtttgcttctctaaataatctttttcttttgcacgctctgcctctactacttcttccggcgcgttagaaacaaaacgttcattagaaagttttccttggacacgttttacttcgcttgtccacttttccagttctttttctaatcgtttgatttcttcttcaatattgatcaatcctgctaacggcaagaagatttctgcacctgtcagaacagctgacatcgctagatctggcgcagtgatctcacttgatatcgtcaactcttcgggattacagaagcgttcgatatagcttgtattttcaactaaaaattgatcgattttagcatcgtttgttttaattagcaacgtaattggtttagacaatggtgtattcacttctgaacgaatatttcgaacggctcgaatcaattctttcaatacttccatccctttagaagctgtttcatcatcaaactctggacgtacaacaggatattctgccactactagagaatttccctgatgaggaatatgttcccatatttcttctgtaacgaatggcatgattggatgcaataaacgtaggatctgatcaagtgtatgaactaagatgctacgggtggtttgttttgaaacagcatcatctccataaagtacttctttactcatttcgatgtaccagtcacaaaaatcatcccagataaagttatacagttgtcgacctgcttcaccaaattcaaaacgatcaaatagctcagttactcgttcgatcgtttcattcaaacgagtaaggatccaccggtcagccactgatttttctccagataaatcgatctcttctacggtcattccttcgatattcatgataacgaaacgtgaagcattccagattttgttgataaagttccaagaagcatccattttttcatagctgaagcggacatcttgtcctggtgcagaaccattcgataagaaccagcggagagcatctgctccatacttttcgattacttccatcggatcgattccattacctaatgatttactcatcttccgcccttgttcgtcacggatcaatccatgaatcaagacattctcaaatggacgttcgccagtaaattccaagctttggaaaatcattctgcttacccagaagaaaatgatgtcataaccggttactaaagtgctagtagggaagtatcgcttataatcttcgctttccgtatctggccagcccattgttgagaaaggccacaaagctgaactaaaccaagtgtctaaaacatcaggatcttgtacccagttttcactatccgctggtgcttccatccctacatacatttcacctgtttctttgtgataccatgcaggaatttgatgtccccaccataattgtcgtgagattacccaatcatggacattttccatccaacgtaaaaacgtttgattgaatctcggagggaagaattccactgcttgatctgtttcttggttatcaatggcttttttcgctaacggcgccatttttacaaaccattgagtagacagccgaggttcaacaacgacacctgtccgctcggaatgacccacactgtggatcatcgtatcgattttaatcaatcgaccgatttctttcagatcttgcacgattgctttacgagcagcaaaacgatccattccagcatattttcctgctagttcattcatcgtaccatcatcatccataacatttacgcgtggaagatcatgacgattacctacctcaaagtcgtttggatcatgtgctggagtgatttttactacacctgtcccgaattccatatctacatattcatctgcaatgattgggatttctttattgactaaaggtagaatcacttttttgccgatgagcgcttgataacgctcgtcttctggatgaacagcaatcgccgtatctcccaacatcgtttctggacgggttgtcgcaatttctactacgcctgatccatctgctagttcatagctcatatgataaaaggcgccttcgatatctttatgaataacttcgatatcagatagagctgttcgtgcttgaggatcccagttgatgatatattcaccacgataaatcaaacctttttcgtataaggtaacaaaaactttacgtactgcttcagataatccatcatctaatgtaaaacgttctctactgtaatctaaagataagcccattttagcccactgttcgcggatgtggctcgcatactcttctttccattcccacacttgatcaatgaacttttcacgacctagatcataacgagaaatcccttgctctctaagcttcgcttctacttttgcttgtgtcgcgattcctgcatggtccataccaggcagccataaagtatcatatccttgcattctcttttgacgaatcagcatatcttgcaaggtcgtatcccaagcatgccctaaatgaagttttccagtaacatttgggggcgggatcacgattgaataaggttttgcttttttatctccgctcggtttaaacaaatcttgttctaaccaatgctgataacgtccagcttcaacttcttgcggattatattttgttgataggttattttcttccgtcatgctgttttcctcctttaaactaaaaaacgtcctaaaatactttcgtattctaggacgtatgatttacgcggtaccacctaaattgcaataatcaatcattattgcctctcaagtgagttaacgatcacgactcgtctatctctactccattcaagacagaaactcccaagctaccttcactggttgtcattgagaacctttcagcagatagttctctctctaagaatgaatgtgccagttactcctcttgttcagcgttatgcttcattctacaatggtttttttttttagtcaacaagtggtcgtgaaaaaaccacttcatttagtactaaaaaatttttgaaagaattacgacgaattctcgcaagatcaataagcctactcaaattttcctaagaaaaaacttctgagtaattctcatcaaagtaaataagcgtctgcaactcggttgtcaaatcaatgtattgaacattgacataagctgggacagttactctgtcaggcgcaaaattaagtatagcggttacatttcctttgacaatttcatcaatagcagattgtgaatatttacttggtaccgtagagattgctactgtcacattttttgctttggctatctccgcgaaacgatcaatcggatagatcatttctccatcaattactcgattgatcagtgctggatcattatcaaagacgcacacgatatttagattttcatttcttctaaaattgttgtgtttcaatgctttgccaagatttccatatcctactaatgcgattcgtttttcttctttagtattaaggatattattgaatacatcgataaggaaagggacatcatagccatatccgcttctgcctagctcgcctaattgcgagaagtctctgcggatcgttgcagaaggaatttgggtgatttcgctgaactcatttgatttgattctacttatacctgagtcatccagcatcttcaagtagcgtaaatataaaggtaatcttttcgcagttgcttttggcagtgtatctgttttttctcgcataacgacgctccttgttaataatttcacatatttagtgtaacatgtttctaacacgggagcaaggttacaagtaggaaggaaaagggtgtgagacaaataaaacggtgttcaaaagcttgcatctgcggtaataagctcaaccaaacgtaaaatatgaagaactatttttgtttggctgttcttattacttgatgcagggcagctttttcacaacctctgatacacggtgttccagaagtaacttcttcgaaaaataagccgaaatttcacaaaaatttgaaaagcaattttcgtaaattccttcttatttcttgaagctgcccacttctgtcacaacctcgctatttcatgggaaattctcttttttatatcatttatcaactgtagcttgatctctaaataaaattttatttttcagttagtaaaaaagaaccggcttttccataacttcttgataaatggtattcaatcagctaatcttcgacattagttcaaaaacggtaaaatacatggagctattttttcgttttgtttctctaatactctggtcaaaacactattttcataacctcttatagcaattctgaaaattcttcagttttttcattagacgattctgcttgtatctcttccatcttcaagccagctagtgctcgttggatcatttcatctattgctaaacgctcttcatattgatggaccttttccagttgagggcgtgtttttggctgtggaggagcaaaaatcgtacagcaatcttcaaaaggctggatagaaagattaaatgtatcgatctgttctgctacttcaatgatttcaagtttatccattgtcgctacaggccgaatgattggcgtattcgttacttcattgatagccaccatactttgcaaagtttgtgaagccacttgacctaatgattcaccattcaaaatgactaaaccatgacgaatacggcgaatttcatcggtcaaacgcaacatcattcgacgagtaattgtcatccaatatccttgtggcactgactttttgatttcttcttgaatctcggtaaatggcacttcgataaaatggatcgttcccacataaggtgctagtttggctgttagatcttttgctttttgcagtgcttgttcacttgtatacggcggactagcaaaatgaacagcttcaatttccactccccgcttcatggcaaagtaccctgctacaggagaatcaatccccccagaaagcataagcattccttttccgcttgttcctacgggcaatcctccagctcccttgatcgtttcatacgatagataagcgccatcacgccgaatctctacacgtaatggaatatctggttgacgcatttgaacttggatatgcgggaaaatatcaaaaacagcattacctaatgtttgattcaattcattacttgtcaattcaaattggtgatcgcttcttttagcgataattttaaatgtttctttcccagtataaatttctttcatgatgtcttgaacagcttgtttcaaaacttcgacatctttttctacacgaatacttggagaaaaattttggatcccaaatatttttgctagttttggaataactagctgcccgtctgcgccattcaataaaagatgcatccggtcccgatcagcatggattttgatttctggaaagtctttcaaagcttgtctgacattttgtgctagttgcatgataaagctttttcgattctttccttttgtcgaaagttccccataacggaccataatttcactgtatttcacaagaacactcctcttttaattgattgcagaaaatttcttataaagctgcttgaaaataatcataaattgctcgacttctgcaagcgaattgttttcatctaagctgattcgaacagcagatgtagccagatcatttggtacatgcattgcgtgcaatgtactgcttgccatatgtttacgtgaggagcaggcactagtagtagaaacaaatatttgtttttcttctaaggcatggacgagaacttcgccgcgaattccttttagagcaaaacataaaatatgcggtgcatagtcagttccttctgaaaaaatcgtcactttctcatacgtcttcaacgcattgattagagctacttttaagcgttgtgtctgctcaggtttttgttcctttatctctaatgataaacgtaaagctttagccatagccacaatacctggaacattttctgtcccacttcgctgatttctttcttgccctccacctgtcagtaatggtgctaaacgacgaccctttttccaataaatgaaaccagttccccgtgggccatggaatttatgagctgaaaatgttgcaaaatcaactctttctgtcaaccattgcgagaatggtacttttccaatcgcctgaacagcatctacatggaaatgaattttaggaaaatcatccaaaagatcactgatttcctggatgggctgaatcgatcctacttcattattcacagccataacagagactaatactgtctcttttcttattaattctttcaattcgtcgacacgtacaaatccgcgtttatccactggggcgatacttacttcgattcctaattcttttaattgttctgctgtctcgctgacggccggatgttcgactcctgaaatgatcatatgattcccatattctcttttttcgatcatcgttccttttaatacccagttatctccttctgttccgcctgaagtaaaatagatttcttctggttctacatggatcaaatcagcgatctgctttcttgcttgctgcaacaaccggttagcttgattgcctaaatcatgcaagcttgatggattcccaataatccgctgactggtttttacatatgcatctaagctttgcggaaagattggggttgttgcactgttatcaaaatatatcataagaaacccctcttttttgaaattcttttctattataacggttgtccaaggtgctttcaagagcaggtgaaattttcacttgtttcaattttcaaatatacaaaaaaagacaagaacaagacaataatccgtcttgctcttgctggtttactaacttttttgctttatactaagtctggatgattaaaataaaaatcttcgatgcgtttgaaagcaccaggttctactcgctctaatgctgtaccgatttcgtctaatgcttcttgatagtgatattctttattgaataaatagtagcttttatcaattgcttctctcacttcttcgtgtgtatgacgataacgatttgcatattggagcatttgctccgttaatgctgctgcatctactaaatcatgtgtcttcttatctaataattctagatcttcttcacatagagcaactaaacgattgacctcttccatgtttactcgaattttattcaagacaacacttagttcttcaatacggtcagtagcaacaaaaaagaattctaggtaatcattcggcaagccaggcaaacgttgtttttctacaaaacgtttcaaactgcgcaatttgaattcgaatgtatcgatcttttcttgcgcttctttttcgccttttctcaattcatgtaatgagtcgtcgatctctacttgttgcttttcgatatcttctaagactttgaagactgttttatagaacgtgcgcacttctgaataaggaatttcgtgttgacggatctgtggaatcatctgttcattttgacgttccatttcttccacttcggtttggaaacctcgtacacggccaatttcattgtggttcaatgtatagctttgagatgtgtgatccagctcaatcaataattgacggttattctttgttgtatgtttgatatactctgcaatcgttgattggttagtttttacatatctctgagcttccatttcccgttctaagatatcatataacgaatcaatcaaatcagctgtttcacggttttcaaattcgaccgtttcaacttctgttttttcaagattggctaatgaattttcaattcttcgacttacttttgcgatatcttcagcaagatcttcttctgggaatacatattgttcttccatcaatttctcgtaagtatcactgatttcttcaagttgttcagggaaagtggtatggagctcctcatacagcggtggaatttttttcatcagagcttccacttcatacgtatgtttttctgctttatccaaaacctcgcgggcttcaacagggtctccagaagtgtttaaagtcacaaactgcgtaaattctttttcgatcactttgatctgtttttgcaattcaaaaagagctggtccgtattcatgctcgtcttctctgactttttctttcagttcttcatagacgtcaagtgcctgctgaacagctagtgagttgcgttcttccgtttcccgcaattcctttagaccttcacggatttccgtcacttgtttctccatttggtccattgtagcttctgcttcaacaactgctttttttccttttaagaaccgaaaactttcattgaggttttccacttcgaaaatttgactttctagttcagcgaacgaggaagtagatatgtcattccatttttgactccattcacgaaaggtattttggctttgcccaaccagatgcatttttttaacatcatcgacttcttcaatcactggcaagtcaaataattcttccttgcgtttttctaaggcatccaatcgatcttggttttttttcttcatcaagtaactaaccaaaaagacgacaatggcgactataatgattgcaatgacgattccgatgataacattatttcccatttatggttcctccgttttcagtatgcatcttttatgcaacagatggcgttctgcttggcataaatccaaataatacgtctctcgtgcaaaagacatctattctagattatagcatactattttcatgcattcactaacttaaacgaaaatcttttgtttttccatcgtataaagataacaaaaatagtgaaactctgatcactctttttcatttgtgcacatgcctatatcagcggatttcttcttagcaatcgcttcttgaatctgacgttggatttctgccgcgattttaggttctggagcatattccatctgccagttttcaggtttcaacactttatttgttacagggtcataatgaggttttccatctggaaataatttccccatatttgcctgatggacgatttcgaatattcgatcaggcactattcctagtaatgaaaaagaaccataagtaaagtaaaggatatctgtcagtgcatctacttgttcaatcagcggatcacttccccactgtgttttaccaagtattttttcttctgctttatctaatgcttcgtgcagcagcataacagcttcatgcagttgttctttattaggtgaagtagctgcaacaaattcaacaagttcttctattttgaacgcagcacgtgtatgagcttcattttctgtaaaagccgtgggtatctctggtcttcttggatcaaaagttttgtggaatgtttctactttttgaaaaggtgtctctgcttccatactgattttttccttctttcattgactaataaatcagaccgaagtgtttcagtccttcgtatatcccatcttcttcatttgattgagtcacaaagtctgcagcatgttttacttcgatctgagcattccccatggccactccaattcctacacctttcagcatctcgatatcattgtaatgatcgccaaatgccataatttcttccatttcaattccgacagcatttgcgaaagcttggatgcctagtaattttgaaccaccttttgggatgatatctacagtatacgtatttgaacgctgaaacgtacactcgggaaagcgatgttctaactttttctgttctgactccggactgagcaatatacattgataaattggttcttttaatatctctaacgtttcataacgatccttttgtcggtgagggctaaaaacctggaggatttttttcatcagacgtaccgggaatttacgcggtaaaaagctgactagtcgcttgataaaaatcgattgtcctaatagcatcgtcgttgatccatctaaccgatttctcgcaccaaaaacgatttgtcgatggttctcatctgcaaattcaacaatatgttccaatactttttgttcaaaagggtggtcgataatcgtgcgatctgcagaaaaaaccagttgaccattatacacgacatacatatctaattccaattcatcaatgatttctttgatctttactgggctgcgccccgttgctacaccgcataaaatgccgtttttccgagcatattcaattgcttgttttgttgattccaacgcttttgaacgattggtgaccaatgttccgtcaatatcaaaaaaaatagctttgatcatagacttcgcccctttcttgaataaaataagcccttaaaacagatccatttgggttggattgagtccatctggcttgatatttaatattttttgcagtgctaatgcattttcagccgcatcaccaccagaattattattaaaaatcacacctacctcttttgtcttagaatcaactactttgacttcatgtgctagttcttgcagttctttttctgaataacgatataacgttctttttttacgccactctttatcatttgcttgccatccttgcgcattcctaccatggaatcgaaaaagagcaaagttcggattggtgacaaatggatcaaaaggaatcgttgtattcagcaactgtggctcatcgatgatggctaaagaaaaagcggctctagacataaagtttcttgtacgttcaagaaattcatcgctgtaccaagaataatcccgcaattctatagaaacaggataaccctcaaaccactttctaagtttgcgcaagtactggacattttctttcgtacatttgaatgatgaggggaattggactaaaaagcaaaacatctttccagcatctaccatcggcgacataacatctaaaaaatgcgcaatcatctcttcttcggtctgataataaggcttccagtctccttgaccgctgattccttgatagactttgactacaaagcgaaatgatttaggtacttcacttatccaattctcaactgaggactttcggggaattccataataggcagtatctaattccactaagggtagaaaccctgcatattcataaagagtgttattctttttaccagttaatttgtcatgttctttaaacgatgttaatccgattctgatcatttccggccaccttcgtgattgatttccttggctgctttcttgtaaaagaaactcaaccagatactccattgtattaggaggtcaaggttgagtcttttccattttaataaggtcagcttttttatgataagttaggctattcgttattcttcactgatagcaaaactcttttatatagtatacaataagatttaacggctatgcaaaattattcgtaaggaagtctgtaaaatgaaaaaaatacttgtactacacaccggcggaacgatcgccatgaaagaaaacatgctcacgggcggtgttagtcctgatgtggcaaacccattattagatgcagaaatcacaatccccaagcatgtagaattattagttgaagatatcttcaatcttccctcaccacacatcatgccttctcacatgttggtattaaaagaacgtatcttgtccgcttatgcatcaggtatatccggagtggtgatcacacacggtacagatacattagaagaaactgctttttttcttgatacaacgattggcgacaaattaccaattgttttgactggggcaatgcgttcaagtaatgaacttggaagtgacggcctttataattttgaaagtgcgattcgtgtcgcaagttgtgaagaagcgctagataagggggttttggtggtcatgaacgatgagatccattctgcacgctacgtgacaaagacccataccacaaatgttgctactttccgaacacctacattgggtcccatcggcttagtaactaagaatcgaattttattcttgcaggaacttttagaaacaaagcgactggacatttccgctgtagatgggactatcccgatcgttaaagcatatgctgggatgcaaggggacttattggaagccatcgcccatacgaaagtagacggtttggtaatcgaagctttaggtgcggggaatctccctccacaagccttagctgctttggaaaagcttcttgtccaaaaaatccctgtagtacttgtttctcgttgtttcaatggaatagctgagcctgtttatgattatgaaggcgggggaaaagaactagaaaaaatggggattattttctgtaacagtattaatagtcaaaaagcacgtttaaaactattgattgctgtaaactatggtttgtcgggtgaagaattgatttcgtttatccaaaactaaacaatatctaatagctaaacttaaaaagagaggctgtgacaaaaatagtttcttcgaaaactaagtcgaaaatttacaaaaatttgagaaacaattttcgcaaatttcttcttatttcttgaagctgaccccttctgtcacaacctcttttttatttatttttccatataatatttgcttcacaatacagctgttcctgcattcggatttcatgttttgttttgacaccattttcgatagggatttgttcaaaatggctttcgatctcattcccgtactctacttctttatcaaatcgaataattactttttctggaacatgcgtagtcaaaaagtcatatcctaatacgtcaatgatccaattaaaatacatcgcattattaacatgctgattactatcgatatcataaaaacgaacacgatatggcaacatgaagcccgaatcaatcttttcaattttttcctgacgcttgattttcttgatcttctcactctcaaaaggagcaatgatctcttcattaacactgctcatttttcgattcacaaaatccatcaatacgaaaacagattctattttgactaattctttcccatcttcatcatggatccagaagttccgataacagaaaaacttattgtactccatggcttgagtcgttactgagattacttcaccgactctagggagacgattaatctccatggaataattcgtgatgacccaagtaagtccaaagctattgacgaattcactgcctcttcccaactggtcgctttgatcttcagacgttttgataactactcctaacatcgaaggaaatgtcatcgtttggttgatgtcacactcataatatgaaacttcatgctttttggtatatttttttgccaaaaacacgccctcctcttaaaaattttctagtaattgatctacttgggaaccgtaactttctccaaacatattcaaatgtgccaaaagataatataactggtaaatcggcagtcggtctttccatcccttttctaatggaaatatagtttgataagcatctaaaaattccggtcggaaaccaccgaataactggctcattgcaatatcttgttcccgattcccataagaaacagctgggtcgacaaaaactggatgcccttgctggtcaaagaacacattaccactccacaggtctccgtgcaagaggcgtggagtgatcttttttggttcaaccgatttcaatacacgttctttaaatcgcagatacttttcttgacgctgtacattccatcgattcgtttcttctgccaaagaaatctgggattcaagccgatctttaaagaaaaaagtccaccaatcttcttcaaaagaatttttctgaacaagtgtacccaaatagttatctttacgaaaaccaaattgtggcgctgtttgctgatggagattagctaaagctgcagcaagatctcgttgatccccttttcccggctcgatccattccattaacaaataagcgccttcacttgtttcacctagcatatacgtatccggtacacgtacgaatgctgacagttcttttaatccgtctacttctgcttcaaaaaatcctttttttacattcggatggatttttaaaaaataagcacgatgttcggtttttatacgataggtctgattaacatcgccaccaacaactggaatcactttaccatttaatttcagatcagataaaacagtttggatatccatgactttcccccctactcccaattttattctacttcgtcatcatatttttaatgataaaaggattatttccaatccttatcctttatttagaattatagcacagggaccataaaaaacagggaatggactttaaagataaaaagagctggcttaagccagctctttttatctttactacatactcttcattgaaatactcgtctatgctaaagcacccattggatcccacggagatagaacaattggttcttcattgaacgcatttaattgctctttcgtcaataaatcttttcttacaacgatttggtacgtatattcgtccatccaggcatcactcataacaaagaagccattctttccaactttttcgccccagctattttcgactttccattttgttgattgcccgtctactaagtcaacaccggtcaataccatcgcatgggtcatcagactttctccaaaatctaaacgttcagctttagtcattgtaaaatccgtatcaaatagatcatccattgaataagcatctaaggccatgatgccactagttctagtagaagattgacctacatcacaaccaaaccaaacagtttctccttcttcaagctgagcaatcgctaattttttgaaagtttccatatcaacattcagatatttgacttctttcccgccaacgacatttcctagcatctctactgtataagaacgattgaatggtttgtcttttgttggtgcattgatcacgctaacataatcatctaattttacaccgatgtatttatcataaaaaatttgtggtgtcagtcctcggtcaagatgatagttcttttcttcatcgcggtactcaaaatcgaattcttttggaggtgttcctaatgagatagctaagaagttataaatgctttctagcatttcttctttcttttcttcaatagcgtctaatgtttctccttgagcaaccattttccgtaacactactgcatctttacgcagtaatttgttcaagtagttattcaaatctcgagaatttgaactattcgcactttccggcatcaccgatttaggcacaacgccatatttttggaataatgaaacgatcatatcccattggccgccatcttgttgaggagtagcgagtaagaaagctactttccggctatcgattgcctcttttcctgttgcaatgatgttttcatagaaataatttgccttttcatatttatcccagaaaaaagtgtaattttgtgataattcaaactcttttaaatggaattgattcagcatcttatgacggaatgtgttcagtgcagcaaacatccagcaacgccccgattgcatttgattagccactttccccgtagccaaatctatagaaaataccggtgtattctccacatgtgctgaaacattttcagcagaagcagtaattccgttcttcacaactgcccgctgcaatgcctgctgtttgatatttgcttgaaactgtttgttaaattttgttgtcatatcaggcgtaatagctttcatccaatcatccttccaaatccaagttatacttcgtattttactcttaagaatttagaaatacaatctcttctatgatgaaattttcatttgaatgagaatatacttacaacttcatgaagaaaaatgtcatacggtatacaatagttttcagataaaaaggaatatttctatgagataacgaaaatggcctgtataataaagaagaggcctagaagaacatcatacaataagatagctttcaaaatactcattgaaagaaggaaatactataacgtaagaaaggagatgaataaaatgaaaaacctgattgctggcggctttttgtttgtaggtggtagcatacttatgaatacagaacattttggaaatattgtccctttccttggggtagcttgcgccttgattggtgtagggatgctcatttatttcgtatttagcgatgacgggaaatatggttaattgaattgtgcgtagaagactttactctcttccaaggaaagcgatatacagtataaaaatggaagactttatttatcgtaaaaaaaagaaatccaagtgaatggatttctttttttagctgtgtaagcttttatttactccggcagtaggactcgaacctacgacatcatgattaacagtcatgcgctactaccaactgagctatgccggaatcaagtacatgaatataatatcaatttcttctaaataacgcaatactttttttgaatttttttattatattatcaaagaaaccgttcgcattttttgttatttttattttttctaaaatctgttttcctattagagaaacacattttttcgaaaaaattctgttgacaaatacattaatattcgttatcctattatttgtattaatgataatgccgctttagctcagctggtagagcgcttccatggtaaggaagaggtcgccggttcaagcccggcaagtggcttccttaaacagtgcagcatattggtttaacaatgtgtctgcgctgttttttattttatgacataaaaaatgaatgtttatattttaatagcacaaagaaagtctatatgataactataaaaaggagagcaatatgaaaattgtttttttgcatggtctaggccaagacgaacaatcatggaaagatgtaatctcttatctacccaatagttattcttgcaaaagcctttcattgttcaatcatttaaacagcacagacactgctactttagacgacttaaccaaatacatcgaagtacaattgaatcagataaaggaaccttttattttatgtggattatctttaggcgctgttattgctttaaactatcttgcaactccttctccatatttaaaaaaggttgttttagtcgctccacaatttgagtctcctaatcgcttattgcttactttagacgaaaaaactaaatttagttaaataatttccatttcttttcctattttttgataaactgctactgcttcatcaagcatttccctcgtatgttccgcagtcggcatatttctgatcctgcctgtcccaagaggcacagttggataaacgattggtttagcataaatcccatgttcgatcagcttcttagagaaagtctgagtcactttttcgtctcccaaaatgactggagtaataggtgtttcagacataccgatgttatagcctacttttttcaattcttctttaaaataattagcattttcccaaactttctcgacaagttccggatgttcttgcatcaaagtaatcgaagccaatgcagctgcagctgcacctggagttagcgaggtagaaaataggaatggccgacttctagctttcaaccagtcgattagtgttttcgatccagctacataacccccaacaacacctatagctttcgagaacgtgcccatttgcatatcgattttgtcgcttaatccaaaatgcttgacggttcctgcaccttttccagttacgcctgagccgtgcgcatcatcaacgtaggtgatcagtccatatttttcaacaatcggaataatttccggcaatcgtgcaatgtctccatccatggagaaaacaccatctgtgatatacatgatttttttatatttcttactttctatcgcttcctttgcttttttctcaaggtctttcatatcttgatgtttaattcggatgatttttgctccggataagcggcaaccgtcaataatagatgcatggtttaattcatccgataagatagcatcttcttttgtcattactgcagagatagcgcccatattgcagttgaatccagattgaaaggcgattgctgcttctgtccctttgaattctgcgattttttcttctaattgctgatggattttcagcgaaccattgatcgttcggactgctcctgctcctacaccataagtttcggttgcttcaatacatgcttttttcaattcttcgcgattggcaaatccaagataattgttggatgctagattgatcatcttttttccgtctacgatgatacaagcaccattttcactttctagtatgtcgatcgtattgtataaccccttttctttcagttgatccaattctttctctaaatacattgttagttctttggaagacattgtctccacctccatattcatctgtcttgcagaacataccaaacatatatcgtgtcattcatctacaaagcaagtatgccatatttttgataacgcttacactgattatgagaattatttaaccacattttttatttacagtatctttttactttcaaatgacttatatagtatgaacaattaccttttagataatgatctattttactctacctgggcagataaatacaacacaaccattgatagaagccctttcgttaaaatcaattgtattctgaatatttaatttatttattgcatagaccaataaaaatacgtaaaacttccatcttcatttatcagcaatttttaattttactctctgaatatttcttaaaagttttacttgttgaattcgaaaaaaggactgtgacaaaagtcttgtcacagtcctattcttccgaataaacggtgttctcctgccaattccgaatcacaagttacaatattcatcaaacatgagaagctattttttgaaattgttccttgtgactcggagctgaacggcaggctcacgacctcttggtaaacagtgttccagaagtaacttttacggaaaatgatccgaaatatcttggagctgaccacttctgtcacaacctccatcattttttgttatttttgatccaattgtctggagtaaaattttcatcgtcaatagaccattccagaaaaaattcttctaagaattcacgcatgaaggtttctcttcgtttggcttcttcatatccgtaatcagtattcattttatcagacagcaagaacagtttttcataaaaatgattgatcactgtcgtgccttttcggtaattttctttgtccttgaatgttttcggatacagttcaggatcaaaaatcgggtgcccatgtccaccgccgaaataagcagtacgcaaaatgccgattgctcctaatgcttcgatacgatcagcgtcttgaacgatcttaccttccagagatagttcggccgcttcagagagatttttagaaaaggacatattttcgataatggaaaaaatcatcgagatctgttcctctactattggcaaagagcgaaggaatacacgaagctgttgctttgcctcgttctcatttttaacgactttatcatcaatcgtatcatgtaggtaagctgctgcaagcgtcacaaagcggtctgcctgcggttccgtctccaaaattttttcagctaacttgacaactcttttggtatgatcgctcccatgtcctgtttgatcatgcgctaattggtccatactataatcagcgatcacttgtaatttatccattcgttccacttctttcttaagtaaatagctgaaaacatctatagattagatgaatttcagctatctttgtaaattgtattttattttacctgatatacattaaaatacaggtctttcatatagtcgatcaggtattgcggattaagcggttcatgtgttgcatccatgattaattgatttggttttctagatgcaccatattgatggatatgctctgacatccagtttttgattggagaataatcgtctgacgctagaacattttccacatctatttcttgctgcaaagaatgaagtaattgtgccgcatacatatatcctaatgcataagagggaaaataaccaaagcttgcacctgaccaatgaacgtcttgtaggatgccttccacatcatttgttggtcgtattcccagatactcttcatatttttgattccatatttcaggtagttcagcaacatctaccccttcattgaaaatcattttttcgatttcataacgaatgatgatatggagagggtaagtcaaactgtctgcctcgatacgaaccaaacttgattttgtatggttcaatgaacgataaaatttgtcaaaaggaatatcatcgaatgttccttctgcacattcttgaaagaaaggatattgctttttccagaagctgcgactacttccaataatgatctcgttaaacaacgattgtgattcatggatacccattgatgtaccttcataaaccggtgtatacgcatatttatcatcgatgtcttgttcatacataccatgaccagcctcgtggatcactccaaaaacagccattttgaaatctgtttcgttccatcgtgtcgtgattcgtgcatcattcggattaattccagtcataaatgggtggacagtgtcatctaaacgaccacggctaaaatcataaccaagttgttcgattactttcactacaaatctcttctgttgctttttcgtcattctccgatttaaaaagtctgtttcaggttcagtccctttttcttgaagcgtacggcggatcgaaagaattccttctttaagctgatcaaataccttatcaaggatttcgacagtcatcccgggttcgtattgattcagcaaaacatcataattcgtcttttcatcttttctccagtaaggtatcaactgttttgttaattcaatattttgattcaatgcgtgttgaaaatcagaaaattgttgtgtttctctagctttttgccattgtccgtgtgctgaagaaacggcagctgtatattttctcataagatcttccggtacgcgatgttccaaatcatactcttcttttactttggcaaaaacggcagttccaacttccgacaattcttccggatgttcagaaaaatagcgaatggcttctttgatttttggaccgattttttttgaaaaataaatgctgtaaagatagctgtctacttcacttcggtatgcactagctttttcaggcatacctgtttgtgtatcccaatcgaggattcctaaagcttgttgtagaagattgatttcttttacttcttgtaaaaattccttttcattcatccaaaagtcctccaacttatcctagttatcatttatccaatagctatatctcacttacatttactacatttcctttgcatcgattaattcaaaccgttcaacagccagtggcatttcttcataaaattcttttccaatttggggcattaactccctaaaaaactttttatgagctttataccagtaatcatagctcaaatcaccctcaccctcagcacgggcaatttcttctgttacttcattcatcggcattatcgtcatatctgtatactttatgattcctacaggtttgtctttactatttaaaacaatggtataacttccgattttagacaaaggatcttcatcgtaatacaggtattcatcgtatgatgaacatgacgctgttttgatcccctttaaaatcaagtccgctagctcatcagccatcggtgttccttcccaaccccactgctctgcggtaacatttgtttcagggagttcaccttgccaaaattctttccaatacttttttgcttgttcattcattttcaattcctccaaaaatcataagtttaaaggttttaaatccccaactatggtttttaggtacccatacttatatcctagttattcgttttcagcccgttcttttctaggcggacgagttccccaatactgaaatagatccgtacgcaatgcaccattatacaattttctttttttggttgctttttgtccgtaaaattcctcaaacgctaagtcgctagtcaagatatatttactccatgtttttaatggacggaacacatcgcccatttctttatataattttcgaacggtttcttcttctcctagacgttccccgtaaggcgggttagccacgatgaccccgtattctttatccgttttgaagtctttgactgcttgttgcttaaaggtaatcgaagagcctaatccgatttcttctgcattggctttggcaatttcaatcatccgtccattgatatctgaaccagtaatatctaattcaatatcataatctgctttttcttcggctgctgatcgaacattttccatgattccttgactgaaccaatcccaagattcgcaagcaaactcacgattgaatcctggtgcgatattatggcctattaaggctgcttcaatacaaagcgtacctgaaccacatacaggatcataaaatggacggtcttttcgccaatttgtcaacataacaagtgctgctgccatgttttctttcaatggtgctccacctttttctaagcgataaccacgtttgaataaacttggtcctgtcgtatccagagttaccatcacatggtctttcagcaaagctacttccaactgaaaatgtgcgccagtttccgtcagtggtacagaagctggacggtgataataggtacggagacgttcaacgattgctttttttgtgatcgcttggcaatcaggtgtgctatatagtttcgacttgatcgattttccagctacaggaaaagctgcatctagtggaagaaaatcttcccaaggcaatgcttttacgttttcaaacaattcatcaaacgtatacgcatcgaattccccaaccacgatttttactcgatctgctgtacgtaaccataaattagctgtagcgatcgtttccattgttccttcaaaacgtgcacgtccgttctcaacttggcattcgattccaagatctcttaattctttaccaaccagtgcttctagcccgcttgccgcagttgcgacgaggttgaacttcctgtttttttccatacacaatctccttatttataaaaaaaggaggtgggacatcagtcctaccccacacttttactcaaattccgaataaccggtgatacaaaagtttgttttgtaataagaacgactcatctgaagtattgaaaaatagctttcaaatgtttttcttgtttcttataacgcattacttttgtcacgacctaattccctgatgtttgcggttttctataagccatgttctgtactttgcttttccagggagaaaaaacaaagcggtaaccatctatctgcagttatactgcctttttgtcctgttcttcttccagacaaaaagcgcccctaccattgtttgggttgctcgctcgaggggtttaccgcgttccaccggatgggtttccccagccgcttcgtcactgtggcactttcaaggatacttaagcatagccgaagccttagcttgttttcctgccgttactccaaagagtaccttagcttatggtttcgctaagcacgaacactacaggcatcacagcctgtgcgagcatggactttcctcagcctgatcaagtcagaccgcgattacccgaaaaccgcaaattcattaatcaaaaattaaaattgacgtgttttttcattatcatctaagcttgtgtctgcatttgtgtagttatttggattaggttgtgctggtttgactgcacttgcttgttgatcaagctttttaccaaatacttcacgttcaagatttgacaagcgttttaagatatcaaaattggtcactgctgcgctctttggtgcctctgtttgttgcacgcgtgtttgagctgctccttgagttttagataattgagctacttttgcactcaatcgatcgttttcttcttgtaaagcaaggagttctttgctgtaagtttcataatctttgatgatattgtctaagaattcatcaacttcaacgggatcatagccgcgcatttttgttttgaattcttgttgtaaaatgtctttaggactataaaccaaattcgccatatttacacctctagttttcatttacgtaataacatttctacctttttcattgtataggaaaaaagttgataaatcaaacacaatatcgattattcactaaaattttgaagaacgtccatactgatcagccgaatttcgtagggatgatctgcttggtaattctgtgcatcttcaaaaaaatacttcgtttttccagggaattcttcatcatagatcagcagacagcccactgtatgttcaagtataaaacgagtgtgattctttagctgactaggtgattggtagggttgatggctaacagcttcgacataatctgctaattgttctgctaattgttttttttcttggttcccttcattccagttattaccaaaatcagaaaaaggatacaaaataccaagagatagttccggatattcttctttcaattccgctactatttgcacagcccatagttcgacgcccaaattcccactgacaagtacccattccagcccttcttctgctaactgacggagttctttttttaaaacatttttaacaacttggattttaggatcattttctttaaaaacactgagttcgaaacttcgatacccagacacatagattacttttgacttatccatctcagattccttttctttctatccgcttttttgctataatgtggcctaggagtgtgattaaagatggtattgcgctatccaaatggccaaccttattataagaatgcctctcccgtcgaaaaaattcaagaaaaaagaaatcagatcactgaattcggcaatcgggggatgcactttgaagaagcaatcaatgaaagtaataaatattatctttcccgcgggttggcggttatccataaaaagcctacccctatccaaatcgtgaaagtagactatcctaagagaagtgctgctgtgattaaggaagcctactttacccaagcctcaactacagactataatggcgtctatcgaggcttttacttggactttgaagcaaaagaaaccaagaacaaaacatcttttccctttaaaaacttccatgcccatcaaatcgaacatatgaaagcatgcctcgaacaaaatggggtctgctttgtcttgttatggttttcgtctttgaagcgctgtttttatttgaatagtgttcatttgattgcttactgggacgcccaaaaggaaaaaggacgcaaatcactacctttatctttgatcgaagaactaggaatagagatcaaaactggtatttctccgcggattccttatttggacgcggttgacttctatttatcaacattatctattgaaggagaaagcaagaatggcaaatgaacaaactagaagctctagacgacagaaacagcctactcctaaaaagagtgtgaagaagaattctggcaaaggttctggaaagtcctctggaacacataaaaaaggattatttatcaagatccttttaggaatactctcatttttctgtatcctctttttagcaggtgtaggacttttctggtattacgcaaaagatgcgcccgaattgacggataaaaaattagacgctaccgtatcttccaaactatatacacaagatggcgaactattcgaagatttaggcgcagaaaagcgtgaaaaaatttctgcgaatgaattaccgaaaacattagaagatgcgatcgtgtcggtagaagatcgccgtttttataaacatatcggggttgaccctattcggatcatcggttctgccctctctaactttacctctggcggactgcaaggcggaagtactttgacacagcaattgatcaaactgtcctttttctccactagtgcagaggatcagaccctgaaacgcaaggcccaagaagcgtggatggctgtaagattggaacaaaaaaaatcgaaacaagagatcttgacctactacgtaaataaagtgtatatgtcaaacggcttgtacgggatggagacagcttctgagatgtactttggcaagaaattatcagaactttctttaccgcaaacagcattgcttgctgggatgcctcaagccccttctgcctatgatccttatgtttatccagatcaggcgaagaaaagacgagatactgttttgtatacgatgcttcaaaacgaaaaaatctctcaaacagaatatgatcaagctgttaatgtaccggtaacggatggtctgcaagaactaactcaatccgatgacaatactaagatcgtcgataattatgtcaaagaagtcatcaatgaagtacaagaaaaaacagataagaatgtctacacagacggtttagagatttatacgaatttggatctggacgcccaaaagaaactatatgatatcgtcaacacggatcagtatgtctcttacccagacgacgagatgcaagttgcctccacccttatcgacaccaataccgggaaagtaaaagcccagattggcggacgtcacatcgcagaagacgtaactttaggaaacaacttagcagtgaatacttcccgtgattttggttctacgatgaaacctgtcacagattacggaccagcttttgaatatttgaaatattctactggaaaaactattactgacgcaccgtataactatgaagggacttcgactcctgtaggaaactgggataatcaatatatgggcaccattactttacgccaagcactttacttatcccgtaatgttccagcagtcaaattattcaatgaagtcggttcagataaagtggcttctttcttaaaaaatcttgggatcgaatacagtacgatccatcaatcgaatgcgatctctagtaatacggaagaacaagatgggacaaaatacggagcttcttccttaaaaatggcagcagcctatgcggctttcgccaatggagggacttattacaaacctcaatatgttaataaaatcgtcttccaagacggaacagaagaaacttatgagccagatggaaaaacagccatgtctccagaaacagcttatatgatcacagacattttaaaagatacgatcactgaaggaactggtacgaatgcgcaaatcgctgggttatatcaagccggcaagaccggaacatccaattacacagatgacgagtatgcaaaacttggtatttcttctggggtgtatccagatatcttatttgcgggctatacgccaaattattcgatttccgtgtggacaggttacaataaaaaaatgacacctgtcacttcagaatcgtcacacgtagcctctgatgtttatcgcgagcttatgcagtatgtttcagctaacgtgacaaatacagactgggagatgccaagcggattaattcgtgtgggcggtgaactgtactacaaagatcaatatacagctagatcgaatgcagttacaccatcaacaactattccatcttccagctatgtccagactcctggaagctcaacaacagagacaacgactcaaagctctagctctactagtcaaagtgaatcaactgctgagtcctcaaaagaaagcacgacagcagaaacaagcgagccagcgtcttcaacaacggttccttcttcttcatccgaagaaagctcgacaccgtcttcatctgctcctcctgcttcttccagtgagccagcaactagcggagcggatgctgcaaatgaccatacaccatccagtagcacctcagcttctggaaacagatagtaaaaaagaaaccacgtctacaagcgtggtttcttttttgtgtctatgtaaaaaacagctacaaataaaaatcatgtaccaagctgtattacatgattttttataagactatccagcatatacatgtgtgatctaacatttagcttaaaaattagaaaatccatttttcttttatcattacatatactttatccatttacttgtttataattaaatcggctaaatacacactagtcttttatttagtgccacttcttaataatcccattgttattatcaaataaaaaatacaatatatggttttgaataattttttgaaagaaggcttcattttgagttatctgatagtatgcttaattatcataatttgtctgcaccatctttttttatcgaaaacaatacctcgttattccaagaataaaaaagctgaaaaatttagtttattattaaataaatttactttaattgctcctatccttgcatttattattttttctgtacttttaagcactactcttaaaggaaaatttatggaaagaagctctcatgcaatgattctcacttttttatggttgttgttcaccagaatctatatttttctgatgagcctgaaaccgcccaaatccattagtttatgtttagttataaatggtatttttttattatcacttatcatttttattacacctttagatagatacgtcacttatttatataatcctttggaatactggacttattttataggtatattggaaggcattattttctacatcgggtattttcccaagaaaaataacaacatttatttttatcgcaataaattgtaataagttaccatcctagctactgagtatgtacatttactttttcatgcaaaaaagataaacgaaacggcttttctccatgataacaagataattcatacatttatttgcaattaaagaaaccacgtctacaggcgtggtttcttttttagcgtcttttcttttagacgcatccgatttttcccatcttgacatattgatagcaaaggacatacctcgcacttgggatttcttgccgtgcaatgatatctaccgaaaaaaatcagtgtatgatgtgtctttacccataattcttgtggtactttccgcatcagtgtttcttctacttccatgaccgtagcatctagtttgcagatcctcaggcgttttgagacacgttccacgtgggtatctactgcgattgctggtatcccgaatgcatcccccaatacgacatttgctgtctttctgcctacaccaggaagagacatcaattcttctcttgacgttggcacttgcccatcgaaacgttcaatcagctgctgtgcacacgctttgatgttttttgctttatttcgatacaaaccaatcgtttttattttaagaatgatttcattgattgaagcttctgctaacgcatcgggtgtcggaaaagaggcaaacaaatctggcgttgctttattcactgatacatctgtcgcctgggcacttaagatcactgcaatcaataactcaaatggattattgtgcttgagttctccatgtgcttcgggaaacattccatacatcgtttctagagcttccattgttttttgtttgcttaacatattccgctactcctccaaccaatttttcagtgagactttcggcaattcttcttgttgagctgactgttctacttctctttgaagaagctgctgttttcttcgtttttggtcttcttccacttgttgttttgtacgtagattttttctttcccacgatagcaaaatgcggtcaacgtaattaaaactataagcctgatttaatacggcttcccgcagtgctagcttcaaaatttccggctgataatggtcttcttctagccattgtccaatccgctggaactcgatcgaagaaagcgggcgtccaaattcttgttcaaataattgatacactgactggatttctttttcttgtgttttttcttcgtattttctttcttgtgtttttaaatactcacctaattgatcatagatggggtaaagattatatcgatctgcttttttaccgttgacaatcgtcgtttctatcttgataaatccatttgttacgagacgatccagtattttaaaaatctgatcttgtttgattcccatatccatagcaatcatctgcaaatcagggaaagtatctccttcaagctgtgccatgtgcaactgtagaacaaataaaaattcttcagattgtagaccgatcctatgataatttttaagtaaaagattagatatgactgtttgtccagcgcttaagtaattttctaaattcaacatgatttctcctccgctcaatcacagtatacgtaaaaaaaacatgggaagcaagaacaggtttcttttctattacttcactgatcggtcagatttacagtgtcgtctacttgatttttgtttcttcatgtttttgatgcgcatcttcacttttcggaataaataaattaagcagattttgctgtttcttagaatgttgacaaggaaacaaaattgctatacactatttttgtttccaagttaacattatttcataaaggagtttttttaatgtacagtttcacaaataaacattctaaagtttttggatacgtctctgtcttattcactggattaggatttactatcgtcagtcctgtacttccgtttttagcgctgccttattcccactccgtacatcagcaagctttctatatcactttgctcatgtctgtttatgctctagctgccttcttatctgcccccattctcggtagcttaagtgatcattttgggcgtcgtccgatccttattatcagtttattaggatcaagtatcggatatttgatttttggtttaggaaattcgatatggatgttgttccttggtcgtatcattgaaggattgacagcaggagaaatctccaccttatatgcttactttgccgacattacggaacctaatgaaagaaccaaagtttttggatggatgggtgctttagtcggtataggaacaacgattggtcctattatagggggtctattagctgagttggggaattctgttcctatatttatcggagctctctttactttcttaaatgccgtttatggctacacatttttgcaagaaagccttccaataaaaaaacgttcagtagatttaagtttctcccatgtaagaccttttcaccaattacaacaattattcaagatttcatccgttattcctttattgacagcaggttttgctgtttggttagcagctggctctcttcaatctatcttttctcaattttcgattgacgcctttcagtggaaggctggattggttggtttaagcttctctttgattggaatcttggatattgtctcgcaattgttcattatgcctcgattgctcaaaaaattttcagaacagcagatcacaagaatagggatgttcagtgaaatcctcgcctatctattcatcacattatctggaattcttctactgccgattttgtttttatttgggattatctgttatggtttcggcgattctatttttactcctgtattcaatggacaactatccaattctgtctcagataaccagcaaggtcttgtaatgggcggtacccaaagtatacaatctctatcgcgcgtcatcggcccgctaatcgcagggcaactttatgctgcagcaccatttcttccgacgatattcgggttcttgcttatgatttttgcctattattattacaatataaaacattagtttcatttgcttcttcgtataaattctctgtatcgaccgataaaacgaaatactgtgtcaaattcttcttttgacatattttcaaatacagcagcatctcgctgtacccatttttgatggagctgctcatgtctattccttattttttgtccgattggcgtcaattgaaaatagatttcttttttattctcttcgctttgataagtgtttatgatccctctggctatcagtttttttgttagcttactgatggctcctctagtcatataactagcattcgctaattttgtcacattagaatcagggattttcccgatatgttcaatcacttctagttcatttagcgtaaatcctgcaaattctttttccatttctggtttattacgatgaataatctcattagctaaatccagatattcttctattagcagttgtcttttatccatttctacaccttctttttctttcattatattgtttttttgtttcctattcaacaaagataaaaatattttgcaggaaaacccaatctgaaaccaagaaaaaaaggggttgacaaacttgtcataacccctttttctgattaaaagatagtaaagagacagtcatcggtaattgtgatgattttttgtcatcacttaaggatgagcggccttttcaaaaactgtctttaaagatcatcatcagtttctagcacatatggctgaccttcatatgtgtactctgtattcaatgtgccgtcattttcatctgagtagatgcgtctactgaaaggaaaacgatgagaaacattatctttggcgtcttttgctggcatcgtgtaatattcctcttgcgtttcattcaactgagagagtacttgatctgccaactcatcaatattgatcgttgatttcttcgaagcacttttataatcttctaaaaatgcatcttgttggacaaaatattctttattcatcttctttctcacctttcttttcaaaatcaaataaagctgcttgttcttttatgtaacagctttatctttgctgcttattgtgacaaaaaattcgaagaaagacaactaattgtacttttcacaaaaaagacagagggtcgtgacaaaattgtgtcacaaccctttttctttattgtgcagtttcgatttcgcctagcgctgcttgtgcaagtaggttcaagtaattccatgggcggtcaaaatgtggttggaagaagaaatctgaaagtgcgagatcttctacagtcattttattttgaacagctaaagacatggtatttgctgattgtgtaatgtcgtatttggacatgaactgagcacctacgatacgattcgttcctttttcatagactagctccatcattactttttcagtagttggcatgaactctggacgataattatcttcaaatacagtcgcttggacttctagatcgttcaaagttgcgctttctttggtcacacctgtcgaaccgatcgtccagccaaataggtaaagtcctgaagttccttgagtaccacgatacgccattttatgatctgtcaaattatttcccacaagcaaaccttgacgaacggcatttgttgccaaaggaatatagttttgcgtgccacttggattgtagttgactactgcagagtctccagctgcaaaaatgtctggattacttgtctgcatgtattcattcactttgattgccccgtttggcagtgtatctacttttccttcgatcagttttgtatttggacggaagcccacacataaaatgaccatatctgtatcaaatgtatctgttggtgtagctacttgtttcacttttccttcttcatctgtgataaattcagtaacattttcgcctagcgcaagagtaacaccgcggtctgtcaattctttttctaagatatctgtgaatggtttatctagatatttattcaagatgcgatctaatccatcaatcaatgtcacttgttttccagattcgacaaaagcttctactaattcaataccgatatatccaccaccaacaattactacacgttttgcttctttcgcttgtgcaataatttcatttgcttgattgtagtttttgcataggagtacatttttcgcatcgattccactaatcggtgggataataggccatgaaccagttgtcatcactaatttatcataagaaaccgtttctgtttctcctgttttcagatctttcgccgttactgttttattctctgtatcgacgtctgttacatcgtgttccattttaactgttgctcctaatgaagataattcttcaggatttgagtagaacaagcctgctgggtcctttactactccgccgacataaagtgcgataccgcaagataagaaagaaatattgtcatttctttcatatactgtcacttctgcttctggatgattttttaaaatactttttacagctgcagtacctgcatgagtacagccaattactactactttcatttatggtccctccgattaacattttgtccttcgacaaaactactataacagaaataaaacggatacaacagtttaatgcttgtgaattcacaaaggtttgtttgtagtttcattccttttcaagcataagaacccaatatctacaagattcttattgtgataatattcactttgatatctaagattgtgaataaaagacaaaaaaataaaaaagctagcgttttttttacacagctagcttttttaggtataacacttgtagaaactgtttttacatttgcgccttttttgctgactctttacaatccggacagagtccatacaattccaaccgatgttcattaatctcaaaatcagtcagtctgctcgcagccatttctatatcttcaagccctgggtaatgaaaatcaacaatcttaccgcagttttcacaaattacatgataatgacgctttgaactgaaatcaaatcggctagaagcatcgccgtacttcatttcttgaacaaatccaatcgaagtaaataagcgaaggttattgtaaacagtcgcaacactcatatttggaaaccgatgttcaagtgctttataaatctcatcagccgttggatgggaatgatgttcaatcaaatattctaaaaccgcgtaccgttgaggtgtgattcgaatgttctctttttttaacttttcgataacctcttcgactaacttattttccatgtaaacaccccacgttgttattctcgtcttatcatactatttttacattttaaaatccacttaacatgaaaagaaaattcaattttattgtattttaatgaaaaaagacgtaaaacagtcgcgttcactattctacgtctctattcaaataatttttctcatcataaatttttgtgtgttcttttcatctttaaaagttttttacataaacctatctggagaaaaaccaagtgccttatatctcttggtaaagggctgtagataaataacgttcaccattgtcgggaaccacagctaataccttcttgccttttcctaattcttttgcgacttttagcgcggcagcaattgcagcgccagatgagatgcctactaaaatcccttcttttcgcccaacttctctagctgtttccatcgcttcgtctccactaatagaaaggactttatcatacacagaagtatccagtgttttaggaacaaaacctgtaccgattccttggattttgtgaggtcccgcttctttcccttctaaaatagcagattctgctggttctaccccgattaattcgattttcggatacacacgttttaattctcggccagcgccagtgatcgttcctcctgtaccgatacctgcaacaaacgcatccaagccatttactccaaatgcttgatgtatctcaggaccagtcgtcttctcatgcacaagaggatttgcttcattttcaaattgtaatggtaaaaagtagccgttttcttttgccaaacgttctgcttctctgattgatccagaaataccatccgcaccaggagtcaaaatcaactctgcgccgtaccctttcatcaataaacgtctttcgatactcatcgtctcaggcatcacgatgattactttatatccttttgcaactcctaccatcgacaatccgattcctgtatttccagaagtaggttcaatgatagtatcacctggtttcagtagaccatcgtgttctgctttttctatcatacttaaagcaatacgatcttttacacttcctcctggattaaaaaactcaagctttacaaaaacatctgctgaatcttctggtacgattttatttaatttgacgattggcgttttgccaatcaattcggtgactgagttatagatagctgtcatcttcaattcctccttgtctttgctcttcttacttatcataatacaatctgttcatttatggcgagtgattcgtctttgactagcaaaaaaaagacaaagatataccatatatggtagtttctttgcctttttatctaaatcaaacgtttagttcttgaccaactaataaagaataactggacatagacatgccatttttcgccattagatcatcaacagacatgccaaatttttgtgcaatatcccatagcgtatcacctgacacgactgtatatgtctgaccattatttgcatttacatctgttgttgaagatgatgacgttgaagtcgtcgtagtagtcgttgttgttgtacttgtggttgttgtagccgaacctgttgatggcgtatcaaaacgggttaaattataagtattaatcaatgagttcaatttggccccataatttggatcggtagcataacgacctgtcaagtacgctgttgcatcataaaaacttgttgtattgcttttccacacgccagcataatgataatcgcccgtggaaaaactggttgaacgaagaacattcgcatggtcttggaaggattcccaataagaagaatattttcggaatggttcattcatcgttacccattgtccgtttacatattctttggttgccatataaacgacctgtccgttatagcttcctttcacaccgaatagattataatttggcgcactagctaatccggaagtgccatatgcactttccaacaacgcttgagcgatcatgactgaagcatacaagtcattacttgcagcaacttctgacgcagaccagccgatttgatcgataaacgcttgaggatcagcgactgtttgagatccttgttcatctgcatgaacatgttgcggtaccgctgtaaccatcatcggcccaactaaaagactcgttccaattaaaggagcaatcgcttttttattgatcaccatttttcttttaagtctatggtgccgggcactgcgggtcttcagctcttgcattcaaattcctcctcaaaataaaaaaacttaataaaaagttctcttcttaaaacaaacttaattaattaaattatacttttaattctcaagaaacacaaactaatccgaagaattctttgttttgtcatttaaatgtaacatagccgaaaacgaaaagtaatattgatttattcttctaacacataaagaacagctgtctccaacttgcagacagctgttcttatcagtcaaacaattgcttggatctatgatagttgattgtacgtattcacgacattttctactgtaaatccaaattcttctaaaattttagtgccaggggcagatgcaccgaaatgatcgattgtaatcgttgcgccctctgttcctacgtagcgttcccatccaaatgatgcagcagcttcgatagccacacgtttcttcactgatttaggaagtacgctttctttatattcagaagattgtttttcaaagaggtcaaagcttggcatagaaacaacagaaacatctttgcctttttcagccaattctttttgagctttcacagccaaatcaacttcagaacctgttgcaatcaaaataccttctggtgtttctccttgtgatggagaaagaacatacgcgccttttttcaccatttcatctgctacttcttttgtagaaggcaatactggaaggttttgacgactcaatacaaggatagtaggcgcatctgttgtctccatcgctactttccaagcagcacgtgtttcatttccgtctgccggacgaatcacttgaacaccaggcatgcagcgaacagatgctagttgttcaatcggttcgtgcgttggtccgtcttctccgacagcaaccgagtcatgtgttaagacgtaaacaacaggagtatgttggattgctgctaaacgaactgctggtcttagataatcgacaaagacaaagaatgttccaccgtagatacgagttccgccatgaagttggataccattcatagccgaagccattgcaaattcgcggacaccgaaccagatgttgcgtccttcataatgttcaggagtgaaatctttatctgcagccaccattgtattattggaacctgacaagtccgctgaaccaccccagaagcttggtatagctttcgataattcttggatgacttctttacttgaaacacggcttgcttgactgcttccaacttcataagttggcaattctgcatcccagttttctggtagtttgccatcaaaagcatcttcaaattgttgtgctaattcaggataagcttttttataattggcaaacatttcattccatgcatcttcagctttttgtccttcttctatcatcgtttgatggaagcgggcagctacttcttctggaacagtgaaatctggatactcccaaccataaacttctttagccatcttgatgccatcttcaccaagaggagcaccatgaacagcagatgttccttctttaggagcaccatagccgatgactgtttttacttcgatcaatgttggtttgtctgtttcagcttttgcttcttcaatcgctttagagattgcttctaggtcatttccgtctttcactaagatatgttgccagccatatgcttcatagcgagcaccaacgttttctgtgaaagcttttgaagttggaccgtctagtgaaatatcgtttgaatcgtataaaacgatcaatttccctagtttcatatgacctgccatcgaacttgcttcttgagataccccttccatcaagtctccgtcaccgcatattgcatacgtatagtgatccatcacattaaagttttctttgttatacgttgctgcaaggtgcgcttctgccattgccataccgacagccattgcaatcccttgtcctaatggccctgtagtggcttctacaccatctgtatgatgtacttcaggatgtcctggtgttttagaatcccattgacggaattgtttcaaatcatcgattgtcacttgatagccagctaaatgaagcaagctatacaacattgctgacccatgtcctgccgaaagaacgaaacggtcgcggtcagcccagttttttgatgtcgttggatttactttcaggtgttttgtccataacgcatatgccataggtgctgcgcccatcggcaatccaggatgtcctgagtttgctttttggactgcttcaatacttaatgtacgaattgtgttaacgccaagttggtcaattttgtcaaacaaaataacccctcctattaatttaggttttttttacctttatttcttacactttcattctataagatgtcacacgaaaaagcaatctttttcagtattttttactaaaagttgtcatttcggttgtgtaagccttttttcttttggatttcttttaatttttccggggtcacgtcattgccctcaggatcgacgactttcattccttcgatatgatgacgcataccggaacgaaaagcttccaaatactctttgcgcaagttgatttgttcttgttcttcggcttttgagagaccattttccttctttttacgtgcaagttcattgatccgctctattttttcaggtgacagcatgctcagccctccttttattctccttcatattatataaaaactgaaaaaaaaacaactagataaactaaataaaatacgaacattcgtttgatttagcgctttttatatggtactatttatttatcaagtgaaagaaggtgtaccttgtggcccgacaaactgaatcaagacaaatcgaagtcttacgatatatccatgaacaagtaacccaaaaaggatacccgccaactgtccgtgaaatcggggaagctgttcagctttcttctacttctactgttcacggtcatcttgcacggcttgaaaaaaaagggtttatccaaagagatccgacgaaacctcgtgcaatcgagttgacaaaacaaggtttagaaaagattgggattcgtccaacaactattccagtacttggcgtcgtaacagctggagaacccattttagcagtagaggatgcttcagacttctttccaatccctcctaatctttcttccgaagaaggcagtctctttatgctgacaattcgtggagatagtatgatcaatgctgggatcttggatggtgacaacgtgatcgttcggaagcaagaaactgctcaaaatggcgatattgtcattgcaatgactgccgaggacgaagcgacttgcaaacgattctataaagaaaaaaactttttccgtctgcagcctgaaaacgacttgctcgaaccaatcatcttagatcaagtatctatattaggacgagtagtaggactttatcgtagtcatatctattaattgctactaataaaagaaaactttttaaaaagagtttgagacgatggtctcaaactcttttttcgcccgggttcttcttctttcaaatttttatcacttccctctttacaaaccgaacaaatattcgtatactaaatatacgaacaattgttcgcataaattaacgaggtgagaattcatgaaatcaatgagacgtcttggcttagtattaactgttttgtttttaggtattattattggtaatttcggcatacgtccagctttacttgtgtttgttccgttatttactttgtggttcatgttgtgggatgaaaagaagtaccgtcaatctgagcggcgcagaattcatgaagatcatttctatcatgagccctactacagatccaggcaatcataataaggattgactgctaattattcaaaagacaagaagttaaacttttacggggatgtgacaaaaatcggtcacatccttttttcgaataaacggtgttctaaagccagtttttcggtattaagtcaaattgcggaaaaagtgattttttaaacttctactggtctttgcttgtttccatttataaaaaaatagcgaccctcaaaggtcagatagagaatctggcttttgagggtcgctttaaaatcgcttctttgagaataacatcaagaatagcttcttttttctgcttaatattccattaatgtaatgatgtcatatcctttgattttgtcgcgtccatggagatccatcaattcgatcaaaaatgcgcagcctacgactacaccgcctaattgttcgatcagttcgatcgtcgctttgattgttcctccagtagctagcaaatcgtcacaaatcagcacacgttgacctggtttaatggcatccttatgcaatgtcaatgtatctgttccatattctaatccataagtcacttcgatggtttctcgaggtaacttcccttttttgcggactggggcaaaaccgactcctaactcataagcaacaggacatcctacgatgaatccacgggcttctggcccaactaccatatcaattcgtttttcttttgcataatttacgatttgcttcgtagcttcccgataagcgtcaccatctgccatcagtggggaaatatctcgaaacacaattccttttgacggatagtcgggaatactggcaatataatcttttaaatccactctttgtttcctcctaggttgttaaccatttctttatggtaggaatatcgctcaaaagcaaaaattcctcaactttgattttattgagccgccgctggtataatctgctctcagtcaaaggatgactttctgggctagcgactttttgtaaaacaccgttctctattgtaacaaatttcaattcaaaaaacacctgtatcataaaaattaataatttttcagggatacgcaaatattgagctattgcttttattttatgacgtatatcaattcgttcttgagaatggatcagtttaaacaattttgcgtactgttctcttgtgcctaccccattcaaataggcctcatcaggcgaaatccccatcagataaacacgattgaatgaataagaccgaaaaacttctttcagatccgctaaatcatctggacaatccataataactagagagttcggttttcttttttcaattattgcctctacagaatctagtccttcgaaaacaatcgcagcttcctggataatctcaggcacgaatttcaacgtcgaagaatcaaatgctaaataaaggctaccttccgacgttcggctctgttcacggaaacgttttgcccgccaatcaaatacttgcagaccacccacagaaaaatcagataccatcagctgcggtttcttacgcccgttccattcattgatcgaaagctttcctaccacatctacctgattattcagcagttcttcttcttgagtaccaaaaccaaaagcgaccgcatcaagctgactcgatgcatcggaaaggacaaatttcagatgctgttggtttgctccgattcttttgatattttctgcttggacttgtcgaaataaaaactgaggcaaaggattatccgtaccaaatggcgccaatagtttcagctcatcaattcgctctactgttacttcatttggcagcaatacttcatcaattctcaactcaggccctctcatcaagtcaatttgatgatcgactatatattggttcatcttctcctgtagtatagtgacattttcacttggcatcgttaaaccgactgctgcatgatgtcctccgaagtaagtaaataaatctcgcatctggtcaagcatttcaaaaagattcaaggcttcaatactacgtccagatcctttagctgatccatcttcttttaaagtaaggacaagcgttggtttacccgtttcattcattattttcccagcaacaatgcccaaaacgccctcatgccatcctcggtttaccaatagatggatatgattctccttattgaccatcactaatgcttcttgtgttatctgctctacgattgcttttctttcttcattgatctcattcaatttttttgcttgaacggatgcttcctcttcatcaaacgtcgcaagtaacgagacggcaggacgtggatcgcccatccgaccgattgcatttagtctgggagcaatcgaaaaaccgatcgttgtttcgtctgcatccctcatttttacgccgctttcttcaaatagcgcctgaagtcctatccgttctgaatgatgaatggcatcgattcctaatgaaacaaggattcgattctcatcagtcaatgaaactaaatcggcgattgttcctatcgctactaaatccaaaaattctgcaggcggttcttccaataatgcagaagctactttgaatgctactccgactcctgccaaatctggaaatggatagtgccccgctggatgacgagggtgaacaatcgcataagcgtctggtaaattctcaggtagttcgtgatgatctgtaatgatcacgtctacaccagcttgctgagcgtatgctaccgcatcatttcctgctaccccgttatcaacagtgatgatcaactggattccttcttcgatcttttcttggtataccgattggtttggtccatacccatgctcaaatcgatttggcaggaatacttctacttctgcaccaagtaattccagtgtttctttcattaccgttgcactggtgatcccatctgcgtcataatcaccgtaaacgaggattttttctccactgattacagcttcttggattcggctgattgctttatccatatcgtgcatcagatacggatcatgtaattcttgttcctttggatgtaaaaatcggttgatatccttttcctcatggtaacctctttgccacagtaacttaccgacaaatggagataatttcagttcacggatcatttggagaaaggattcagaaggctctgtctcgcttaacttccaatcaaaatttgcttgtctcactttctcactcctaacttagttattatagcaaaggaaatcagcaaaaaaaagcagaaagaaagaataaaaacagatcagatccgctagacagatgttcagcaggacctgatcttttgtacgaccatttatgaaatatccctattagtcaaaataattgaagctttgtttgggcgattgagttttttgttcttccggcgctttcaattgactgatttgtgcggttttcgcttgtaactccgcctgataagcagcttccaactccgcacgttcgtttctaaactcgcgttgctgttcttcttttgcttcttcaattttcttttgaagttctgtttgatattctgacatttcctgagtcagctgtttgatttgctttttttgctgccatagtgttgccgaagcagtcaaaaatacaatcagtgcaccaatcagcgcagaaccgatgatcactaagatcaatggcgcagaaaaggaagtgaagccaaaacttacaggaacatttttattgttcaatacagcaaaaagaacaataatcaaaactaaaacaaatccaagaatcacattgctttgctttttcaattccttcacctactttttgttaaaaattccgctggctaaataatcaccaatcgttggaaacagcgtataaaattttgatgcaacttctaaaataaacggttgattgatttcccgttttggatgtctcatattgcggacgatcatttttgccaacttggcaggttctaaaacgatttgtccgactttttccaaatagcttccgcttggatcagccttatcgaagaaatctgtctcgattggacctggattcactgtcgtaacagctacgccaagtggtttcaattctaatcgcaaagcgttggagaagccaaggactgcaaatttcgtggcagaataaaccgttgattttgcagttgccatttttccagccatagacgcgatattaatgatatgaccttgtcttctttctgccatatcgatcgcaaatttttgtgtcaaaaccatcattcctaagatgttgacttcaaacatatcgtatgcttttccaaggtcgaatgtaaggaagtcttcgaaaatcccaaaacccgcattgtttaccagaatatcgacgcgcccgacttcttccatcaccttttcatataattcgtccacgctttcaggattgctgacgtctaccttgaaagcataagcctctttgccgctcaagcgtctgcactcgtctctgacaccttctacaaatgccattcttcgtgcgcaacttataacgattgctccttgctttgctgcttcataacagatttgtgcgcccagaccgcctgaactacctgttactaaaacaactttatcttctaaattcatgcctcttcctcctcgcgaaatggaatctcaatgctatcaaaatctttcatgatcgtcgtgttttcaaacacttcttgtgcttctttttcaagctctaaagctgcttttcctaaatatctcgcactaatatgagtaagtagcagccgttttgcctgcgcttcttttgcaacttcagcagcttgatgagtcgtggaatggaaatagttgtgcgccattcttgcttcatctttattaaatgtgctttcatgtaccagaatatcgctattttccgcaagcacaacggaattatgtgtttttctcgtatcgcctaaaatagtcacgattcgtccttttttatctggacctacgaaatcttttccattgatcgtccgcccatcttctagttggatcgtttcaccttgcttcagtttgccgtacagtggtccagctggaatacctaattcttttagacgatccacctgcaattctcctttatgatcatgttcaaccacacgataaccaaaactgtcgatcccatgatttagtttttttgtataaacagaaaattgctgatcagtaaaaatcggggctgtttcatttagctcaatgaatttcagcggataacttaaacgcgtttgcgaaatacctaaagagacttttatgtattcctctatcccttttggcccgtaaatctctaatggcgtatccccaccttgaaatgaccggctgctgatgagcccgggaagtccaaaaatatgatcgccgtgtaaatgtgtaatgaaaattttaccgatttttctcggacgaatagtcgttcgcaaaatctgcatttgcgtgccttcgccacagtcgaacaaccaaacttcattgcgctcgtctaaaagtttcaatgctatacttgtcacatttctatgttttgcaggaacacctgcacctgttcctaaaaattgtaattccataatctacctgactttctttaagttcctctttaattttagggtaaaaagaagggataatcaaccgtaagtcgagaatgggttcaaattaaaaataacgttctaaagcgatagcgttttctttgaaaattactataaaaacagcagcgaacccgtttgagatcctctgctgttttttattaatttgaagatccagaactttcattgtcgttggaagtttgcggatgtttgtccttccaagtcttttgtgcagcttctttcgcatgattttcagcttctttcgcatcatgcacatctttttcgacatcttcataatccaagcgggtaatttctccgcctaattccatcattaccaattgattcagtgggcgattgtcctcttcatcagcaatcaagatcagtcctgtagctccttcaccgattttatttcctacaaagtcgaacacggtctgggcatcttttatttctttggcatcttgtgtcgcaccgatcattcctccggcaaaccatcctaataaaatccctagcggaccacctaatacaccaaccaacattccgattaatccacccgtagaagatttgttattaccggtaaagtcgataaaatcttctattttgaattgatgtgtcccattaggatcatggctgacaactgccatctgttctcctttaatcgaacgaacagcatgtaactttttgatttctgaaaatgcctgatatgcctggctttctacttgaaaatttaaaatgattactcgtttgctcattaaaaacgcccctttcataccttcttgttatttattttacctttaattgtaaaataagaaaagaaaagcactctttttttccaataaaatagggctgtgacaaaagtcgtatcacagctcctttttccgaataaacggcgttcttgaagctgatcacttctgtcacaacctcccttaaatctgaatctatattttttggtatttgtttttatttgcttgcctattcgacaaattcaaattcaaactcaccgatacgtacaaggtcgccatctttcgcaccgcgtgcccgaagagcttcatccacacccataccacgtaattgacgagcaaaacgcatcactgtttcatcatgatcgaaattcgtcatttggaataatttttcgatcttctcaccagataagatccacgttgcatctgaatcacgatcgatttggaactcaggaccttctggattgaatccatagtgtacagtttcttcttccagttcttcttcgtacaatgggaattctggcgttacttctaacaaatctgctgtagcattcaataacgcgtccaatccttgtcgagtcactccagaaattggaaatactgggatgtcatcagcaaattcatcttctttttccttgttcagctgttctttgaatttcactagattttccggtgcatccggcatatccattttgtttgccacgatgatttgcggacgctctagcaagcgtaagttataagtagataattctttgttgatggcaagatagtcttcataaggatctcgtccttccatcccactcatatcgatcacatgtaaaatcactcgtgttctttcgatatgacgaaggaattgtgtacccagcccaacaccttgcgaagctccttcaatcaagcctggcaagtctgctgcggcaaaacttctgccatcacttgtagtaaccattcctagattaggtacgagcgtcgtgaaatgataagcgccgatttttggacgagcagatgaaataacggatagtaaagtcgatttcccgacagatggaaaacctacaagtccaacgtctgccaatactttcaattctagttcgatttttcgctcttgtcctggttcaccgttttcagcaatttccggtgcaggattccgaggagaggcaaaacggatattccctcgtccaccgcgtccaccttttgccacaactagtgtttgaccattttcaattaaatctcctaaaagagcaccagtctccgcatctcggacagtggttccttgtggtactttaacataggtatcttctgaaccacgaccgtgcatccctttactcatcccattttcacctggctgcgctttgaaatggcgattgaaccgaaaatccatcaatgtacgtaacccttcatcgacgatcaagatgacatcgccgccacgaccaccgtctccgccagccggtccgccgtcaggaacgtatttttcgcgacgaaatgcaaccattccgtctccgcccttgccagctttcacatcgatcgttacttgatctaaaaacatggacataattaagtcctcctattattcatttatttatttgactgcctgaatttccacaataaacaaaagtcttacttattttatcggtgaaatctgattttgtctatcatttcagcaaaaagattgtttaccttcttctttttttatcatttggtaaggtttccaaccttttttctgctaccaagtataattttttgacaaaatattctttgcgtagcagaataacagtgtattaattgtattaattgaggatgccgtttcacagcacccctaataaaggaggaacttttgatatgacagtaaaagtaggtattaacggatttgggcgtattggccgtctggctttccgccgcatcaaagaagtctcagatgatattgaagtagtagcaatcaacgacttaacaagtccaactatgttagcacaattattgcaatttgactctactcatggtacttatcctggcacagttactgcaacagaagactcaatcgtagtggatggcgaagcaactcgtgtttatgcagaacccgacgcaagcaaaatcccttgggtaaaagaaaacggtgtagatatcgtactagaatgtactggtttttatacatctgaagaaaaagcaaaagcgcatttagatgctggtgtcaaacgagtagttatttctgccccagctggtgctatgaaaaccatcgtctataacgtcaatgatgatacattagatgaaaacgacaaaatcatctcagcaggttcatgtacaacaaactgtttagcacctatggcttatttcttaaataatgaatttgggatcgaagttggtacaatgacaacagttcatgcctacacttccacacaaatgctcttagatggacctgtaaaaggcggtaatttgcgtgctgctcgttcagctgctgacaatactatcccacattctactggtgctgcgaaagcaatcggcttagttatccctgagctacaaggaaaattacaaggacacgcacaacgtgttccagtcgttgatggttcattaactgaattggtttcagtattgaaaacaaaagtaactgctgatcaagtaaacgaagcaatcaaaaaacacacagttgacaatccttcattcgggtatgatgaccgtcaaatcgtttctagcgatgtcattggaacaactcaaggttcgatctttgacccaacgcaaacagaagtaacaactgctggtgatttccaacttgttaaaactgttgcatggtatgacaatgagtatggatttacttgccaaatgattcgcttactagaaaaattcgctaatttgtaatttgatagatcaatcgataaaagaagcctttgactggatccagtcaaaggcttctttcttttcatcccctacttttaaactcgttcaatgaacatattggcttaaaaattgttggactacttgctgatatttttcaggatctgtcttgtatgcttccgcatgctcggctccttttacaacatacttttcttttggtcccttcgttgcacgatagaccttatctaacatttcaaatggtacaaatgtatcttcatctccatgtataaagagcattgggcgctggtttttcttcaattgttccactgcatttgcttcaccgaaaaagtagccagcacggacttttgtcactagacttgttacttgcataagcggaaatgctggaagactaaacatatcgtctagctgataagcaagctcatcatggacggaagaataaccgcaatcttcaatgattgctttcacattatctggtagtttttctccgctagtcatcataactgttgctgctcccatgctgacaccgtatagaacgatttcttgcgattttccattgttttctagcactttgtttatccactgtacatagtctttacgctctggccatccaaatccaatgtaatccccttcgctttttccatgtcctcttgcatcaggaacaaggacattgtaacccatatcatgaaacatctttgcgtaattggtcatcgtttcagcgtttcccatatagccatgagccacaagagctgttttttcacttttcgtttcagcaggaagataaatcgctgataatttcagaccgtcttttgaagtgatggtccaatcgcttcggttttcttttgaactaaaccatttatgtgcatccgtttctttggatgtctgtgttgtaccaggtgtatcttcgtctaaaaagtctttctcagaaggcacaacagcataattataaaaataattccctgcaaacactaacgcaacaatcagagctaaagcgacgcctaaaaggattttcatccaaagtttcataaatcatccatctcatttctcttttttcatataaccttgaattagtataatcaaagaatctctactatgcaatgttcatttttataacctataaaaaaacaaaataaaaaagcagaaataactggctatttctagcggattatttctgcaataactaattatctattttttattttcaattaatttaaagcttgaccatggtttcaaaaagtcaaggaggaataattcgtcatcggagattcttcctacaacattgacacgtccgtcgtttttcatatccttcaaggcgatttgtgtttctcctttgtattgaccgtacccttcattgtcaatcagtacatccccatgatgcatatctcgcgtattatgaggcgggaaatctttatctttgtagtatacacgagtcatcgttgaacgaaggatatattctgagcgatcccctcgatagctatgaaggttatcaaacaagcagattcgttcgttttctgtaataccttcttccgtatctactttcaatgttggataatccgcgttaaatgcttctgccatttctttcaattcttcttcacttgcgtacgcatttccaatagaaatatcatcaatcaatcctgtaaggattaaatgcttcacttgtgtcgcaatttcaagatctcggtggtcttccagcgtgcacaagccatcttgcgtaggccaagggccaaactcagcagattgcgaattgacgaatgccatcgtattcaaattatattttctgaatttttctgaacaaaaaacaaagtgttcgtatcctaaaccagagtatcgatgaggataaaaattatgagaacctaataaattatccgtgtttggcgaataactcatgatgttgtcaacgtaattcgtgcccgaactcatattgatctcgattttgataccaaaaggattgcgcgtcatttttgcttcttctgctcctgtgaatccgatatctaagcggaccccgtaggcacccatcttatggaaaaaagataagtcatcgtaagaaatctccaactgttcaaataacgctggattgatatcaaccattacttccatgcctaggctattcgcgtaatcaactacttctttaaattctgaaagaactttttctttatcatcattgatctgcagcaaactggtaaaaacccgtttatacccatacttatgagctaaatccaagtacgctttgtccttttcaaatgttgaccgttctggataaatcgagattcctaattttcccatattaccatttcctcctgcatcttttcgtttttgtatccacttacattatagcaaacacaaagtaaatggtctacaccttttctttttcttttaaaataaatgataaattccaataatttaagtaggtattttccctctattttgttatcattaaagataacaaaatagtaaattggaaaggaacagttatgaagaaaaataaagttattttaagtattagtttagcagcagcattgctgtttgctgctggttgttctgcaaacaacacgacttcttctagttcgtctacagaaagttcaaaaagtacatctactgcggaaagcacgactgccagtagcgtcgatttgaacgcattggaattaccacaattgacgaaagatgtcgccgaaaatgaagatctggtcgaaatggtgacgaataaaggcacaatcaaaatcaaattatttcccgaatacgcaccaaaagcggttgaaaactttatgacacatgcaaaagacggttactacaacggactgactttccatcgcgtcatcaaagatttcatgatccaaggtggcgatcctaaaggcgatggcactggaggggaaagcatttggggagaaggatttgaaacagagatcaacaaccacctttataatataagaggtgcgttatctatggctcgctcacaagatcctaacagtaacggcagccagttctttatcgttcaaaatacagatgatatgcatgatggtcttttaaaagacgactatcctcaagcaatcatcgacgcttataaaaacggcggttatccttcactagatggccattatactgtcttcggccaagtgattgaaggaatggatgtcgtggatgctattgcaaatatcgaaacagatagttcagacaaaccaaaagaagaagtaaaaatcgataaaatcaatatactgcaagaagcaaaacaaaaataaaaaaataacgcctgaatcccgcatagatgacaacgtatgctaggattcaggcgtcttctttttacataaaaagcaagtaagcttccttttgttttgctatatcaggttttatagtcaagcattttggttgacgatgaacgtaaactcgcactcacagacttttttatcatctacatatgctgcagataacgctgtaccgactgatcccttcattttggtgatttcaaaatgacatttcagcacatctcctggaacaactttttgacggaatttggccttattgatcccaccgatataagctctttttcctagaaactcttctgattttaggataagtatcgaacctgcttgtgccagtgtttctagaatcaacgcacccggcatcactggattgtcaggaaagtgaccttggaaaaaatcttcattgattgttacattttttgtcgcaacgatcttttttcctggttctaaagtatctacataatcaatataacaaataggataacgattaggaatcaattccattacttcagtagcagataatacgtaagacataattaaactccttctttcaggcaattgccattttcattactttgactatcaaagtatcatattcctaaatatttagcaatctttttttaatttaagaaaaaatagtttgacaatcaaaacattttgactaataattaagaaatcaagaagttattttagctattattctctatttttttacgactatcaaatttttatcagaaacaaaggagagtcattatgtcatttctagaaggaaaaaaaatcgtcattatgggcgtcgctaacaaaaaaagcattgcttggggttgtgctgaagcaatgttgaaacaaggggcagaaattatctatacttaccaaaatgaacgaatgaaaaaatcattagtcaaattggtcggcgaagaagcattcactgtagaatgtgatgtttctagcgacgaaagcatcgaaaaagcaatgaatgccatcggtgaatatgctggggagatccacggccttgtccatgcagttgcttacgccaacaaagaagaattgtccggaaatgtgtctgatatttccagagacggctatcaattagctcaagatatcagcagctactctttaattgctgtatcaaaatacgcacaaccgtttcttgcaccaaacagcgggatcgttagcatgacttatctaggttcagaacgcgcaatcccgaattataacatgatgggtattgcgaaagcttctcttgaagctgctatccgttatttggcagctgagttctcgcctaaaggaattcgggtcaatggaatctcagctggggcaatcaaaacattagctgtcacaggtgttaaagactatcaaaaactgatccagttatctgaatctcgtacgcctgatcagcaaggtgtgacgatcgaagaagtcggtaatgcttgtgctttcttaatcagcccactttccagcggaatcatcggtgatattatctacgttgacaaaggtgtccatctttcataaacttttgttgcattctttaaagtaaaacatataaaaatcaggaaaaaactttttaaagtctcttcctgattttttctttttacgtttttttcaactcattactttgaaattattccacgacttcaatccagccttctggtgcttctatgtctccaaattgaatacctgtcaattcatcatacaaccgttttgttactggtcctacttccgtttcactataaaatacatgaagattgttattgtgataaatcccaccgattggagaaataacagccgctgtaccacatgcaccagcttctgcaaattgatctagatcatcaatgaaaatatctccttcaattgcttgcagtcctagtcgttcttgagctaactgcaacaaggaatatttcgtgatacttggtaagatagagggcgattgcggagtgatgaattttccgtcttttgtgattccaaagaaatttgctgcacctacttcttcgattttcgtatgtgtggctggatcaagataaacacaatctgagtaatccagttcttttgcttctgttcctggaagcaaacttgctgcgtaatttccgccgacttttgctgcaccagtccccttaggagcagcacgatcgtaatcagatacaataaaattcgttggttttagtccacctttgaaatacgctcctactggcgtacagaagacgacaaataaatattctggagctggatggacaccaatgttttcaccgaccccaatcagtaaagggcgcaagtataatgtagcgcctgttccatagggcggcacaaaatcttcatttgcttttaccacttgcttgacagcatcaacgaacatcttttcagggaccattggcatcagcaatcgtctagcactttgattcatccgtcgactattttgttcaggtcgaaagagattgaccttgccgtcttttcgacgataagcttttagaccttcaaaacattgctgaccataatgaagcgctggagagccttcatgaatcgtcaggtaattatcttctgtcaattctccttcttcccattgtccgtctttccatttggcaataaaacgccaaggagttttgatataagaaaaacctagattgttccaatcgatttgcatatacttaccaccttcgttattttctccacattttatcattatccatattatttgtcattttattttcagcttttttccttcattatagttatttttgctatttccttttttgaaaacttcttggtacaatacagaaagaatcaaattttagaaaagaggattttatgttttcattattagcaactgccggtacgacagactcttctggcgagacattgacagatcaagctgtcagcaaagtaaatgcgtttcagcggttttggaacgggattgattgggacgccattttggctgcctttatccaaaaaagtttatatctgatttttttgatcgtccttttttggattcttcaccgtgtgggaaaatatctgattgataagtcttttaatcagtattctaaaaaagccattctaaacgagagccgcttaaagactttacatagtcttttaaatactatttttcattatacccttggtttcttttttatctatgcaattttatctgctatcggtgtgccgatcggatcacttttggctggtgccggaattgcaggtgtggcaatcggtcttggtgcccaagggttcatgagtgatgttattaccggattttttattatcatggaacaacagatggatgttggggactacatcaagctagcaaacttaacgattgaaggaaccgtcgtatctgttggtatccgtacccttcagctgaaagcaacggatggtactgtccatttcatcccgaatcgaaacatcaccacgatcagcaatctctctcgtgcaaatatgcaagtacttttagatattcggattgttcctgaagaaggatatgacaaaatctatgagatcattgatcgagtaaatcgtacattagctgaaaaataccaagaagagctccaaactgaaccttctatctttggattagtggatcttggaaacagcaattttgcgattcgtacggtctgctacgcattgaacggaaaacaatatgccttaaaagaagagttcttgagctcctatgtcaaagaattgacagcttctggtttcacgattccgaacagtccaattgctgtcggaaaataatttggacaaacgatgcaacgaatctcactaaaaagagcgtgggacaaaagtaaagaacacttttgtcccacgctctaaacacgtataaacggcggaagcagaagcaactccttcggaaataagctgaaattcacaaaaatttgaaaagcaattttcgtgaattccttcttatttcttggagttaaacgcttttgtcccagcctctttttcaagataaagtcaaaactggtacgctgttttttctacttattttttgattatcttttagtttctcgttctttagctcacgatatcgatttgttcttttaattcttcgattttcggagacaatatattacgacgttctaattcatgcaccatgaagtttacggctttaagcagctcttttcttgtaatgattcctttgaaaatccgatcttctgtgacaaccggtaaaaaaggcgaatcgactaacaaatggagtacttcttctagttcccaattttcatcaattgtcggaacatctgtttctgtcacatcagcaaccgttagtccttctaacgggtccatgctgattgtttgcaagtcaatcattttattgaccacatctgataaacttactagtcctacaaagtgatcatcttttcctaatacaggaattttggaataaccgaccttcgataacacaagtaaaccatgggataatggatgatgatacataacatttgccacattttctgcaggaatcaaaaacgtttcctgattttccagcagcatttctcttactataggtccaatcatctgatggcctccatttctatttcattcaacactactattttaccgaaaccggatgcaaaattcataaaataaagcttatttttattaaaaattagagtttttttattcagcgctctctcgaaaaagaaaaggccaactcttcaactgcctgatgggcacggttatagtattgaacagaaatttggtcatctaaactttcgataagagcatatgatgggatttggatcgggcctctaggctgagaaatgctaccaggattcaaaaacaggattttctgatccatctcacagcctatttgatgggtatgaccaaaaaacaccatatcggcagttgcagctcgagcttcgattgctaactgtgtcaaaccaaatcggacattcgataaatgaccatgagtcataaatactgtatcctgaccagtttggatcacttttttctgttcgaatcctggtccataatcacaattaccttgaaccacttggaatgtatcccataatgggtcagaagcttctaattccgaatcaccacaatggaaaaagatatccacttcagaacgataacgatctactaagtcaacgaggatatctctgtctccatgattatcacttactactaaataccgcatctatctctctccttccagccattgtttccactcggcactcaattttttcattgcttgagcccgatgactgatcttgtttttttcttcgctcgataattctgctgctgtttgtttcttaccttctgggataaataaaggatcatacccaaagccattttcgccagatggtatacgggctactcgaccgggccattccgcttctactacaaggctgtcttttttgggtgccgcgaatactaacgtacaatggaattgtgctgttcttttttcatccggcacatctgtcaattcatataataatttggcgttattccccgcatcacttttttgttcccctgcaaaacgtgcagaatagattcctggcataccgcctaaagcatccactttcaaacctgaatcatctgctaagactggctgatcaagcaattgtgcaatcgtttctgcttttaatcgggcattttcttcaaatgtgctgccagtttcttccacatctggcaattcaggatagtcaagtaatgtttttacatgatatcccgcttctttgaacatatttcgaaactcttctgcttttcctggatttcttgtcgcaatgatgattgtttttgtttcttctatccgctcatcattttgagcaaactctgttagcaaagcatgtttttgctctttgatcaaatcttcaatcgcgttttttccaaaaaagagcatttcattcaactgttcaccatcaaacgttgcttcttctccagttccttgaatctccacgaattttccagattctgtcattacaagattcatgtctacaagtgctgcggaatcttcttggtaatccaaatctgtgacgcaagtcccatctggtaagattcctacgctaactgcagcaagatgttcttttattggatcttctgacaattctttttctcttaaaagtttttcaatggctaatttcaatgccacgaatgccccagtgatacttgctgttctagtaccgccatccgcttggatcacatcgcagtctacgatgatactacgttctcctaatttttccaagtctactactgcacgcaaggaacgaccaataagacgctggatttccattgttctaccagaaagttttcctttgctgctttctctacgatttctcgtactcgttgctcgaggcaacatactatattctgctgtcacccaccctgttcctgtttctctcaaaaagggaggtacagaatcttctattgttgcagaacaaataactgttgtatcaccaaaacggatcactaccgatccttctggatatttgaaaacatttgtttgaagctccagtttgcgaagctcttgggcttttctcccgtcatgacgcatccttattttcctcccaattcgatatgttctacatttaagtgtccgattccaagccagtcttcagctatttcctcgaaaagtttggcagagccagttgtataaaactggcataatgtccgaccattttgcggtgaattgctcagattgaaataatctaacagcatagatacttcacctactgtttctgctccagaatcgatcagttgaacattttctcccattacattttgaatgatggggcgtaataatggataatgggtgcatcccaaaatcaatgtatcgatttttttagtggttaaaggagctaatgtttctgccacaatttttttcgccaccgatgaatggtattcattactttcgacaactgaaacaaattttggacaagcaagacttgtcacagtcaattctggtactttctctttcagtgctttttcataagctcgactttttactgtaccaatcgtaccgataatgccaacttgtttattttgtgttttttttactgccgctctagtaccgggaaggatcacaccgatgactggaatagaaagagcagctttgatttcttctaaagccaccgcagttgcggtattgcaggcgatcaccagcatcttgattccttgatccactagataatccgtcatttcccaagtatactggattacctgttccgcgggtctagggccatatgggcagcgtgctgtgtctcctacaaataaaatattttcattcggtaattgtttcagggcttcttttactacagtcaagccgccgacacctgaatcaataaatccgatagggcgattatctgtcaatcgtatcatcctttttttcaataaattctatcctccctattgtgtactttttagcgtgaattttcaagtgctcttacttgcttaaaacaatcgaaatctcttttttcgaatggaaagaggaaaagcggttgtgactttagtttgccacaaccgctaaaagaatcatctattaataactgtaccgtctcttttccaagtaaccggaaagcagagaaagcgcgtaacataccacgaagtacataagtgtcatgatgatgaacatcggaagcacataattggtgttctgtccataaataatacgtgcctgatgagaaagttcaggtaaagaaatgattactgctaatgaagtatctttgatcagtgaaatcaattggctcacaattgccgggatcattgatttaaatgcttgcggtaacacgatcgttcgcatcgtttctacataagtcagtcccgttgataatcctgcttccatctgtccttttggaacagcattgagtccagctcggaaaatttccgacaacatagctgactcaaaaatcgttaatgctgcgacagcggaccagaagatgttcatctgaatgccgatttgaggtaaggcaaagtaagtgaagaaaatgatcaataataatggaagattccgtataatatcaatcactacaccaaggattttggaaaagaaagggatatccgcaaaacgaatcacacctgtcagaccaccgatcaagaaactaaaaatgatcgaaaacaatgaaacttcaacagtaacctttaatccttccaataaaaaacggatattcatccatgaaaaagcgccgctaaaatccatgtatttcccctccttctatgaacgaaccgcccattttttctcaagataaaccattaagtaagataacggtagcgtgataactaagtaaaataacccaacgatgatatacgtatcgaaggtattgaatgtttcactggcgatcaagtctccttgatacatcaaatctaaaccagctacgattgctaaaatagatgaattttttacgaggttgataaattggttgcctaatggcgggataacgattttgaatgcttgcggtaaaacaatataacgcatgatttctgaataggtaaaaccagaagatagtcctgcttctgtttgaccttttggtacggtttgaatccctgaacgtactgtttcagcaataaaagcagatgtatagatcgttaatccaatcgtacctgcttggaatccatctagattaaaccaataaatcggtacgacaacataaaaaaacatcacgatgattaataatggaatgtttctaaaaaattctacatatgcctttgctaaggcgctcactactttattctttgataattggaagattgccattaacgttccgataatcaaactaaacacaagtgctaagacactcgaaaacaatgtgatcttgaacccgtcaacaaagattggtccataagtctgtatcaattcgctcattgcctctcccccttactctacttttccttcagtttcatttggaaaccatttttgatagattttatcgtatgtgccatctgcatgcatttcctctagcgcttggttaacagctttcaagaagttttcttgccctttgttgatcgcaatcccgtaaggctcattagtaaacgttccaccaactaactcatactctggattttcatctgcaatccctaacaaaatcgcattatccgtagtcatcgcgtctccctgaccagattgtaaagcagtaaatgcttctgcatagttttctaattctaaaatttttgcatctggtgcatgctgtcggatattcgcagccgatgtagaacccttgactgctagaaccgttgtagaagcattcaaatcatctacacttttgatttggcttcctttctttaccaacaaagcttggccagcatcgaaatagacatctgaaaagtcgacctgtttttttcgttcatctgtgatcgtcatcgttgcaataattgcatcgatatttccgtttttcaataatggaatccgagttttagaagtgacttcaacaaattctgtttttccattgtccccaaggatctttttagtgattgcttttgcaatatctacatcaaatccttgtacagttctgctctcaatatccatcattccaaataatcgagtatcatacttgacaccccagatgatttcattggtagatttgcttcgctctaaaatatcttcatttgccaacccatttcctttacatccggctagtgcaagaaaagcaatgcctaaaaggaaaatcaggcgtattttttttaacctgcgcatctttttcctcctatcaatgattgataactttactgataaattgctgagctcggacttcatttggattttcgaaaaagtctctcacatttctgctgtcttccaatacttctccatcagccatgaagataacacgatccgccacttctttggcaaagcccatttcatgtgtcacgacaatcattgacataccgtcatgagccaattttttcataacgtctaatacatcaccaatcatttccggatccaaagcagaagtaggttcatcaaacagcagcatctcaggattcatcgctaaacctctggcgattgccacccgttgctgttgtcccccggataacatggaaggataagaatctttcttatctaacatattgacagttttcagaaatttctcagcgtttttgactgcagttgcctggtcttgctttaacactttgattggtgctaatgtaatattttccagaacggttttattaggatacaaattgaaatgctggaaaaccatgccgatattctttcggacttctgtcaactttgtctttttatcatgcaagtcagtatcattaattagtagcttgcctgaagaaatcgtctctaatccattgatacagcgaagcatcgtgctctttcctgaaccagaaggaccaatgacaacgacaacttctcctttctcgaattcgagattgatattttttaatgcgtggaacttgccataatatttatccacgtgatcaaatttaatcattgccatagaattacactcccattattatttagtaagatttcttttaaagatgtataataaaatacattatatctgatagtttagtaatttgtaaagtttcttagaacgtttattctcccataaatatttcttccatttctaatctattagttattttatcctctttccttgttttttccttaggaactgttgtttcttttcaggaaaaacggtaagatattaagtgctcagacttacaaatcgtaaagaggtgtcttttttgaaaaatattattttaacgggagatcgaccaactgggaagctgcatttagggcattacgtcggttctctaaaaacccgagtggctatgcaggcagatgaagacaaccaactgtttgtcatgattgctgacatgcaagcactgacagataatgctaaaaatcctgagaaggtttcatcaaatgtcttgcaagttgctttagactatttagccgtgggattagatcctgcaaaatctactttatttatccaatcacaaattccggaattagctgaattaaccatgtattatttgaacttagtcagcgtaggacgcgttcggcgcaatccgactgtcaaaacagaaatcgaacaaaaaaaattcggtgaaagcgtgcctacaggattctttatctatcctgtttctcaagcagcagatatcactgcattcaaagcgaatcttgtacctgttggcgaggatcaaaaaccaatgctagagcagacacaggaaatcgtacaaagcttcaatcatacatatggtgaagtcttggtggaaccaaaaggcgtattcccaccaaaaggaatgggtagattacctggaatcgatggaaatggcaaaatgagtaaatcgttaggaaacggtatttatatctccgatcctgccgatgtcttacagaaaaaagtcatgagtatgtatactgacccaaaccacatccatgtacaagatcctggacaagtagaagggaatatggtcttcacctacttggatgtattcggaacagataaagaagcaattgaagaaatgaaagctcattaccgccgcggcggacttggtgatgtaaagatcaaacgatacctcattgatgtattggaagctgaatttgcaccgatccgtgcgcgccgagaagaattggaaaaagatccttcagctgttatggaaatcttacgtaaaggtagtgaagaagctgctaaagtagctgcacaaacactttctgaagtaaaatcagcaatgggaatcaattacttccattaattcatttactctaaaaaaacaggctgtaaaggcctgtttttttatctcgtctctgtgctattccttttttaaaatcaaaaaaagagatgtgacacaacttcgtcacatctctttttcaaatgtatggtcttcaaaagctacttgatcgttacttactatattttccctcttagcgaatacttgcctctaggttttctaccaacgctttttcgactttttccattcctttattgatttcttcatctgtcaatgttgcttctgggttgacgaatgtcaggctatacgccatggatttatgtcctttttcaatgttttctccttgatagacatcaaataattggatatctgttaaaaatcttccggcagcagaacggataacttctgttaattcctgatttgtcacagtttcttttacaagcaaagcgatgtcccggctgactgctgggaattttgtcactgcttcgaaaacgatccctttttgagcagcttccactacagcagataaatcaaactcagcaacatatgtttctggaatatcataactttttgcaatcgttggatgcacttgaccgacaaaaccaataaatttttcgccaaggtaaatcgcagcagttcttccaggatgcatttccttcatttctgtcactgtttgataatggacatcttcagtgatgcctagttgttcaaataagttttctaaaagacccttgatggtgaaaaagtctacattttgagctttcgtctgccaatctttttcttcccaaataccagaaacagcgattgctgcatgttttacttcttgcggcagatgtgtgcacggatcattttcttggaagaatacccgcccaatttcatataaagcaatctctgtattttttcgagcagtgttataactgatatcatctaatagtccgctgatcaaattcattcgcaatacagaacgctcttcactcattggccagtccaaacgtgtaatattactttcatttataacaaactgtcttgatttttcttctgttgtcaatgcataactgattgcttcgctcaatccgcttccttcaaagattgtacgaattttacgagtagtttcttgttcttttgacaagcttccagcaaccgtttctccacttggaagtgtagatggcaactggtcgtatccataaatacgagcaacttcttcgataatatctgcttcgatttggatatcccagcgtcttggtggtactactacggaataaacatgctccttttcttcatagctaaatccaagtgcttcaaaaatctcatttacttctttaacgacaagagatgttcctaaatattgattgatgcgttcaagtgaaatcttcactgatacgtcttctgctttgatctctgagcctttgaccgcgccttgtagaacttccccacccgcaagagaaacgatcattgctgcagcaacctcactggcttctccaacagtcgcatggttgattcctttttcaaaacgtgcagaggattcactacgcaaattaaattgttttgctgtacgacgaatcgaaattggatcaaataaagcagattctagtgcaactgttgttgtttcattcgtgatctctgagtctaaccctcccatgacaccagctaaagcaactggttctttgccgttagtaatgacgagattgtcagttgtcaattcccgagattctccatctagtgttactaatgtttcattttcttttgcacggcggacaaagatctcttttgatttcaacttgtcgtagtcaaatgcatgtagtggttgtccgaataaaagcaaaatatagttcgtcacatctactacattgttgattggacgaatgccttcgttcatcaaaagattttgcagccattgaggacttggctggattcttactccttcaatgattctgatttgataagcaggaactgcttctttatcttcaacttccacttgaattttatcgctagcaggacgtgaggattctaccagcttttcgtcatcgaatgtaggagtctgacgataaattgccccaacttcataagctacgccacgcattgacaatgcatccgcacgattcggtgtgatagataattcaataatcgaatcatccatatccaaataaggaaaaactggatcgccatttacagcttcttgtggcatataatagataccttcagcgtattctttcggtataacactatctgaatagccaatttcttgtaatgagcaaatcatgccatttgatacttggccacgcatttttccttttttgatttttacattaccagcgatacgtgagttaggaagtgcaacaatcactttgattccaaccttcacattaggcgctccacaaacgatttgagacagttcgtcttcgccaatatcgacttgacaaatagaaaggtgatcagaatctggatgtggtacgcattccttgacttcaccgacaacgatttttttcaagccttcttctggaaccgttactccctctacttcgattcctgtcacagacatcttatccgctaattcttttggtgttacattcgataaatctacataacgattgagccatttatatgaaactaacattttcttactcccccttgaactgacttaagaaacgtaagtcattttgatagaaattacggatatcattcactccataccgcaacatagctacgcggtctggtccaaggccgaaagcaaagcctgaatattcttctggatcgattcctgacatcttcaacacattcgggtgtaccatgccagctcctaaaatttcgatccatccagtgtatttacatacgttacaaccggcaccaccacatttgaaacagctgacatctacttctactgatggttccgtaaatgggaaataacttggacgcaaacgaatttcacgatcttccccaaacatttttttcattacgacttctaatgttcctttaaggtcgcccattgtgatgtttttatcaacaactagcccttcaatttgatggaactgatgactgtgggtcgcatcatctgtatctctgcggaagactttccctggcgagatcattcgtagagcacccttagagaaatcatgtttttccattgtccgtgcttggactggtgaagtatgtgtccgaatcaatatctcgtctgaaatatagaaagtatcttgcatgtcccttgctggatgatcttttggcagattcatccgttcgaaattgtaatgatcagattctacttcatatccttctacgatctgatagcccatacccacaaaaatatcttcaatttcttccatgatttgtgtcacgatatgacgtgtaccatgttttacttttctaccaggtagtgtcacgtctattgtttcttttgccaaagctgcatttaacgcttcttcttctaatacttgtttttttcgctcgatctcttctgtcaaaagatctcggatctcatttgcgaaacttccgacttttggtcgctcttctggacttagatctttcatcccacgtaatacttctgtgatcggtcctttttttcctaacgtttcaacacgtatttgatttaattcatttaaatcttgtgccgctgtgattttgacgagcgttgcttctttcaagctctctaattgtgcctgtagagacatgtgcttgttcctcctttaaattccaaatacaaaacaaaaagacctcattcctgttaaggaacgaggtcttcgcgttaccatcctaatttgcggataaatgacttacaccgcactcttacttcgttaacgacaattgccggtctgattttatcagacgaactcggaaagtgaacttcatttttcaaacacaggatctgctttcagtctgcgacagatctccctgaactggtttagccaaactactctttttcgtcatcgttctttacttattcgtatggactatagtttacaagattttttttacaaaatcaaccgcattcttcctctgtgacccatttttcgctccaaacttgtatttgacgcatcgctttttgcaagtctgctcctttttcagtcaagagatattctgaacggctcttttcgctacaggcaaagtttcgagtgactattccttctttttctaattccttcaagcgttcgactaatactcgatcactgaccatcgggatttttgccgcaagctcaacaaagcgttgcggaccgttttcgagtagtacatcgataatcaatccgttccatttttttcctaaaatagagaatgttttttcaaatttagggcataaaacgaattctgtctgtgttagctccatcatactcacctcttcccagagtatagcataatccttacaaaacataagtcaagtttgctcaattataattatttgttaatgtttataatttgtttcactcgaagcaaaattaggaaaacattttctactggcttattcaaagcttctgacattgcttgttggtaaagtcttagctgtccttgatatttttggacgattgcatctatttctgctggatcatccggatgtaaaataaaatctgttttaaaatcatagatattgagatgatctttttcttctaggtatccatcgacgattccgtggattaatagttcatcttcttgatttggatagtcttgaaatacttcgtcagcaggaagcagcatggaaaaaggttgttctcgttttacgttttctttgttggcaatcagctgttgaccaagttctgtttgaaagaaccatataatagaagaaacatctacttttttcgcgactttttcgtctactaaccgtttccttaccaattcctgtaatttttgatggatactctctgtagttggcatctctaatggcagtaattgtaacaaagcatgcgtagcagttccaacagcagctgctgacacttgccgatctttttgcaaaaattttggttctgctagttgttcttgcgtataacgaaattgacgggatgctgctttgttctgactgctttccagagtcaaacgtgattcttgtgtatcatctggatcttcgaataatcgtttgatttcagatacagattgataacttgtggtttgtgaagaagcttgataaggatattcatatgccagacgtttttgtaacgaatctgctaataaagtttcatcttctttcatctgctgatctaagttaaccagttctttttcagcaagcaactgtctttgttcaatgatcgattgctgattcatccatgaaatagaaaactgtgcatttgaatgttgaagaagagaagtcgaaatttcttcctctaagtatttctgcatttcaggatgacggatcaatccgtaaccaatccaattcatcaagctgcttctgcccttcaaacgtagcgcaggatcaaaaaccaactcctcatgatcagctgcttcagaccacgtttggatcatttgctctttatttttataggaaccgacaatgaaaagcttttgttctgcccgagtcaatcctacatacaatttacgcatttcttccgacaacaatttgttttgctttaccaatttgatggcttgaaacggtaacgtatcatataacactcgtgtttcaggatccatatagcgaattcctgctccaagtttttcttcaaaagcataccgattgcgcaagtcttgtaagttgaactcctttgtcatatctaacaaaaatacaactgggaattccaagcctttacttgcatggatcgtcataacgcgaacagcattatcttctattgaaatgactggttctgctaagtctttatctttttcttgcattttttcaatgaaacgcacgaactggtataatcctctgaaagaactttgctcgtaagctttggcacgatcaaccaatgcataaagattggcttgtctctgtgcccctgctggcagaccgaccacatactctagatatcccgtctcataatagatatcccataacaagtcagtgatcgaagaacggcgagcaagttctcgccaatgctctagttgcttgccaaaatgttccagcttagctgctaattcatcttcgtttgatgcttgataagcaagcacagcatcatagtaagtatgtgcacggtcagctaatcgaatgctggctaattctggttcaatcagacccacgatcggtgagcgcaatacagccgcaagcggaatatcttgatagggattatcgattaattgtagcagcgagatcatcgtgcgaatttctgtcgcttgaaaatagttttgagcatcattcatctctaatggaatatccaatgttttgaaaatctctaaaatcgttaagttgttcttctttgtaggtgtcaagagaacaatgtctttgtactctatcggacgacttttttttgattttttatcataaatcataaaggaggaatcaattaattgacgaatttttagtcctgtcataaaaagttcgccttctgttttgtcttccagtatatcatccgtcggaatctcaatctctgattcttcctgttctttttcatagatcatgatttccggctcaaactgttcattctctggaaagtctgaaaatccttggatcagtttggctgcttcgtcataattgatttgacccactgctggatccattagttgttcaaaaataagattcgtaaaagaaaggacttcttttctagagcggaagttctcagccaaaacgattcgacgtccgccttctttctttgagaaattctcgtatttcccgataaataaactaggatctgctaaacggaaagaatagatggattgtttgacatccccaaccatgaacatatttccttttgtatcatcaggttctcttagccagtataaaatggcttcttgtaattggttcacgtcttgatattcatctaccattacttctttgaatttttttcgataatgttttgaagcttcacttggcagccatgcatctttcgttttttctgtgagaatctgcaacgctaaatgttccagatcattgaaatccagcacacctttttcccgtttacgcatactgaaaccgtccatgaagctttgcgtgacttttgtcatttcttcgactaacggtagtgctttgtccgttaattcttccatttggcttggggaaacaggaaaataacttttacttatctgctgaatcagtttttttgctttatccctcatgcccttgacttcattggaaatttctttcaattctgctttccgactgctcttaaaagttgaaaaagttagttgttccaaaccagcataagcttcttctaaccgatcttgcgagaacgcttcatagatattcttgatctgctgttgttctccagctacttgctcatgcattttttctaatccttcaccttgtgctaactgagtcatctgttcatataattgtacacattggtatatatctgccaaaactaaaggacggatttgttcttgatataatcgagatttcgctagcccctcaggcaaacgataattatcgcttaactgttctagccattttttggggtcagggttggcacgggcaaactcataaagagaaaacaccagattcgtcaagccgtcatctgaacgatcattagaaaaattcattgttaattggaaaaatcgttcatcattttctgcataaagtgcttctctcagctcatcccacacatcctccttcatcaagatcgtttctgtttcatctgttaacatacgaaagactggatcaatatcaattaagtaataataacgtcgaataactgtcaggcaaaaagcatgtaaggttgagatattcgctgtgggcaataaaactaactgcttagtaaaatgctgtctacgtacagggtcactttcgctattgacggcttcttgtaatgcctcttgaattctttctttcatttctcttgcggcagcttcagtaaatgtcacaatcaataattcatcgatatcaaaacccatttttagtttttcaatcactcttcgaacaagcactgtagttttacctgatccggcagacgcagagactaatagattatctccttgatcaaaaatcgcttgccactgatcatctgtgaatcgttcattttgcggttttaaaggaatttgattcactcttcttcactccttttcaatattctacgcagtgcttcttccttatctattttctccagacggtggtaattattttctttcagcatcacatcaaacgtacagatgcttctgaatggacaaaattcgcaggcaatccgctgtttatctttataagctggatttagtttgatttctccggaagtaatcgcatctccagctaaccgcatattttcccgattatgcgccatgaatagttgcagttcttcttccgtgaaaaatttgtctttactgaaactacctttttggtattcatctttcgcattttttttcactggatagatcagtgattgttcttttgcttccagtgaatgatctagtacttctaaaagagcgggatcatcgacaaaaacgccatcataactaaattttttcaatgtattcttctctacatcatctgtctccgtcaatacaggattatgaacatgtaaataatatgatcctgctggtttaacagccgcctttccagtcaaacgtaccgcatccatcaatgctacgtccaggtacgtcaataattgcatagccatgccataataagcttctgtgacatcgaatgaacgtccgctagatttataatcaacgacgcttagccaagtatcttcttgttcagaagctacatcgattcgatcgattttccctcgaacatggagttttccaccattactcaacggtaattccagacctgtgataccttttgctccagcaatctgaccaaatagaatctctgtctgaagaggatgcatgcctgtatttttgctctgtttttgcaaagcccatgccactttttgaatcgtctgtcctaactggtagcggatatagttcattcttgcagaactatccaatatctcaaaccgaagttctccgaatacttcctgcagcactttttcagtaaagtctctacgctgcgtatcggacatattcactaaggataattggtttgaaaacagtagcttgaagaaacgatccaatgattcatgataaaaatcaccagttgctgctggagttagaccataaacagttcgttctttcaatttcaaaccaaattgcatgaagtatttgtattcacaattataaaaattctccatacgtgaaattgaagtataaatttcttttccataaagctcttccgccattttttctggcatcgaaacaggaacatttaaatgttcctgactttcaaaaatctgtaaagcaaaatttcgccatgacgaattcagtactaattctttgagcttttgccagtgctttggtacaggttttttttcatctaaagctaatcgataaatcctattgactgtattgattccgcttctgtaagtccctacataacaattagggtcgctttcgatcgtcaaatgctcttttctctcgacgggaacagataaatattctgtgattctacgcaaataaggagacatcttcagcgagccatctgtgtcatagctttgtgcataactaagatataatcgatctgttccggaaagaaaaacaagataggcttggaaaggctcaaaagagatactttcctttgatgggtcgaataaaaactgtccatctggcaaggcctgatttaatacttctcgttcttcactggacaacaatccttttgtctcttttcggtctggaaacacttgatcattcaaccctaatgcaaaagtgacggcagcttgatttggtcgaactaattccaaacgattgattcgcacttggtcgattgcggtagggattttaccataacttagattttctagaccactcgtaatgatttcttggaacagtgaccagtcaaaagccgattcaccataaattactacatattcatccaacagatcaatcagcgctccccatgtctgctcatggtttcttgccgcttctaagtttcctctgtctacttcctgattacgccaaaacaataattgttgctgtacgccactttggatcaaaaattgataaaaaacatttgcggcctcttgtcctgttttgcttttctttatttttttcaaaaatactggtacagctttctgaaataatcgtctaatcgtatttgactgttcttccaaatactgtacgtcttcaatctgttctgcttcaaaatcatacgccacaaactgccagtctttttcacgagtccaataagttccctgataattgtaagcaagtgctacattttcagtgatgtccagttttttcctgaattcatctcgctcttgtttccattcatcaagttcggtttctgcttccgtcgacagaaataattcagttttgaaaaaacgcataatatcacttagccgataagaatagcggtcaagagcgaacagactgttgatccattcgatcagcggatgattttccatcatttgttcttcatcgatataaaaaggaattgccatttcttgaaagatcggccgaaggatatttccatataaagacatattttttgtcagcacttggatatcacgataacggtagttttcttcactgactagtcgtctgatttcaacagctaattgtcggacttcttcagttggattttcagcttcccacaaatggagatgctcttgtccccctaatttgtgtactgccgctttcttttggctagatgtctcttcccacattgtttgcagcagttgaagctctgtcggacgagtctgctctggtgcaaatcggtccactaatatagggactttccgttctcttgcactttgaaaaagacggaaataaagctttccagtctcatgaaagagcgtaagtacttctggaagatccgctgtataaggacgatccagcaataaatcgacaaccaattgccccttttccatcattgcctgcagtaattgatactcttgaccattgattcgagaaaaaccactgacaataaatttgacgttgttgaaatcttgtgtctgcatataatttgctagtatagatagtgcatcttcatttgttagtgcacgttgagtcaattcgctgtcataagctgaaaaaatcagcttcaagtctttcattttaagttgctggtcttctgcattaggtgaatcaccaaataaaagcatcaggtcttctggttgaatatttcctgtacgcaattcactgtagagttcttgtaattgacgaataaaccctcttttattgatttctccgcgaaagattgttaattcttcctcatttttttctaaaatctgtcgcaagatcattgcagatcctgattctgataattcatttcctgtaagaagagttgtctgttgcagcaaataccaagccagacgataaaaactaaatacttgaacgtttgttgtgctgaaagctttttttccgcttcttcttcgcatctccgctaaaatttcttgttcctgttcgaatttgctgtagttgggaacaaggaaaaatacttggttacttgcatcctggtcgagccaagcggatgcttcgtcgatcaagacttgacggtgatcttttttcccgtttccaagaataaattgtaaagacatgcttttcctccttcaacacatgatacggtgctcctttattatatcaaaaaatactgaacatttgttctatattcttcaaattatatccttttaaggttctgacatttctacttttttaagtatacgcaaaaaacaggaactgctgcaaataagcaattcctgtctttatgttcattgattaatgaatagatcccattagttttttgattggttctttcacagtaaatagcaagataccaccgacgattgctactgcaccgataataccgaagtaggcagattctgttcccggtgtgtagaagcgtgcaatttgtgcattgattgcttgtgaagaagcatcagctaagaaccaaatagcgattgtttgtgattcaaatgctcgtggtgctaattttgttgtcacagacaaaccaactggtgaaagacacaattcagcaataaccacgatgaagaaacttcccaacaaccacaatggacttacttttccacttgtaccataaagcatacccggcaacatcaatagcaagtacgataatcctgcaaataaaagtccaagagagaatttcactactgtagatggttgacgttcaccaagtttcgtccacatcgttacgaatactggtgtcaaaataaagatgaaaattggattcaatgattgataccagcttgcttggatcgttacaccaaatagcgtagattgtgtacgttcactagcaaataaagctaagatagatgaaccttgttcttgtaatgaccagaaaatgattgctgcaaggaataatgggatataagcccatactcttggtttttcttcagcagttacatcttttgaagtcagcattttgataaagtaatacaacggtaagataatccccaatacactgattgtattgacaaaaaagtcaattgtcagatgaccagttagttgtgccccgccgaatactgcagcgataacaacaagtgcgatgatcaagttacggatgaatcctttacgttcttcagttgtcaaaggattcggcggtgttgtacccactccgtctaatgtcttgcgtccttggatgatgtattgtaataatccaaagaacatcccaatagcagctaaagagaaccctaaatgatagttatattcttgaccgattgtaccaacgattagtggtgctaataatgcccctaagttgacacccatgtaaaaaatcgaaaatcctgcatctcttcgcaagtcagtctttgaataaagatgtccgaccatgccagaaacatttggtttcaaaaaggcggttccgataataatcaatgccatcgaaacaaacaatgtacttacaccaaatggtaaagccaagacgatgtggccaagcataatgaaaactccaccgaagaatacagtgcgttttgctcctaacactcggtcagatacccatccgccgacgatactagacatgtagatcaaagatccgtagatcgacatgatagctaatgctgttgctcgtggtaatccaagtcccccgttggcaactgtatcgtacatataatagataagtaatgcacgcataccgtaataactaaatcgttcccacatctcagtgaagaacaaagttgacaatcccttcggctgcccgaagaagcccttgtcttgctgtttttccataatctataccccaattctttaaattttcagaaaatattatacatctttaccgaaaaatttaactaaaaaacttatttaagaaatataaactaattttctataaaaacaagtaatttttaatggcaatatcataaaaaaaagaagatagagatttaataattatatatcagctgtttttttcaaataagcaaaaattcctaaaacacaacaatgaaagcgataactaagaaaatccttacataacgatttttcttattaaaattgttttttgaacttcgcttattttttgtgagcatatctatttacttactttttgtaaggtgctatacttcatttcgtaatcaattaaaaaaatgcaaaacgcaaatcaaaggagaaattttattatgacaacttttactgacactttgaaaaaccgccgttcaatctatcatctaggacgtaatgtttcactttctaatgaagaattaacaactttgatcaaagaagcaattaaagaaagcccaactgctttcaatgctcaatcaacacgcgcagttatccttttcggagatgcacatgaaaaactttgggaaatcactgaagaagcacttcgcccattgactccagcagaagctttcccaaatacacaaaacaaattagctggtttcaaaaatggttatggtacagtattattcttcaaagatactgacgtggtaaaaggtctacaagaacaatttgaattatatgcagacaacttcccagattggtcagaacaatcaaacggaatcgcaacagctaatacttgggtagcattagttgataaaggattgggcgcaaacttgcaacattacaacccagttattgacgaagcagttgcaaaagaatggaatatcccttcaaactggaaactacgttcgcaattagtattcggttcaccagaaacaccggctggggaaaaagaatacatgaacgatgccgatcgcttccgcgtatttggataattttattctggatcaatcataatatcaatctctgcctcatcgtttaagcgttgggacaaaaatggaactaattcttctaatgatgcagaaaatttcagcatcggtcctcgccatccgtttcggaaaaaattcatttttacgattttagaaccttttggctgatataatacaattttattgatctcagaaaaaggaacaccttttttgtcaaagctattcaaaacaagtccttcttctgtgattcctctactgtccaacaaaaaactaataaaaatcattgctgacaagatcccttttgccaattcatctgctgtaggatgactgatgagtgtataccaaatgactagtgacactaagaagggtatcaccaagtagacccatcgatttcgcacagtccgataaataatttcttttcgaaccagccaaagaaataaaaacatcacaacaacgaataaaaacaatagaaccgtaaagaatgttaccatgacaactcgcctcgctttttcttctccagaaaataggaaaagaatactgatttaccttctcaaagaaattggacttgcagcacgccgcacgtccaattgttttctttattcaaatgtatcatattttgcaacaaccatgcttgctttttcatctaataattcttggtcctctgcagcacattgggcaactttgaccacggcgcagtttgtcatttttgatacaacttcaccaatgaccgtttttgtaaaaccaattggtttgcatgcatattgttctcctaaattaatcatttcttccgtcatcaaaatcctcctaaactgctggaacttttctccacattaccactgctatttctttggagatttaactcattgatttttatttacagttaaaaatcaaccttacaggcattatagcgtactgttttcgttttcacaattaaaacagctgttgtatttagaagaatttttttcaaaaaattaaaacatattccttaaaaactaattatttcctacatattaaaatataatacttccatttccaataaaaatacatttataataggaaagataaacagctgaaaagggagatttcaaatgaagaaaaaaacgttcaaaaaactattgtttctagggggcacagctgctcttttattaagcggtacaagttattacctacatatccattctccagaacatacaatgaacactgcacaaaaaagttcaacacaaaaaacgaaaaagacaaaagagaaagcagaagttttactagatgttccattagagagccagtttgattctccttctttagaaaatggctgtgaagtcacttcgctttctatgcttttatctttttatggttatgaaacaactaaaaaccagttagctgagcaattggattacgtccctgttttcaatgcagatgggactcatggcgatcctaatgaaggatttgttggtgatatcagtggcggagactgggctatgggcgtctatgttcccccagttgcctcccttgctcagcaaatcgtccaaacggattatcacacttttccaaaaaccgatgctcaactcgatgatatcaaaaaagcactatctaaaggaaatcctgtctggacttctgtgactatcaattttgaagtcccagatgaaactgattttatgacttggaccacaaataatggagaagtaagagtcactcctcttgttcatgcttgtgtggtcactggatatgacaaagaaaatatttatgtcaacgatccctatggtgtaaaaaatcgagcagtaccgatcaacgatttttcggcgattttcactgcaatgggtggacagatgctaactttggagaaaagctagtaattcaaacaaaaatcccttatactcaagataccaaacctttgaagggagcgtagataatggaaaaattcacacataaaaaaatggatccaaatgaaattccgattatttttgtccgtgactgcaagggaaatgttcaaggtaaagtctctattaatgagtggaacgagcgtcgcagacctgctaccctcaatgaactggaaatcaaattgtatcgtcaatctcttgtttattacgcagatcaagagtacgagaaagccaccgatttattgaaatttctaattgctcgaacagagtatactcgctttgaatatattgaacgtttagcaaacatttatcatattatgaatgaacctgtcaaagaatatcagttattggacaccgtcttgtcagtagcagaactgattgcccttcctgctggattagaaaagaaactagtacgccgccttttacgagtaaagcaacaactatccgatcaagaaaaataacttgcgtttttttaggaaagtgctatgattattttgttgaataaatgggatgtagccaaactggtaaggcacttgactctgaatcaagcaattgtaggttcgaaccctgccatcccaatttgatgtgcttgctgaaaaaatgaaccccctgtaaaagaacaatctttttgcagggggattattgtattatttttactacttgtatttagtttacataattaaattatgaataataaaatcgggcgtattcttaatacaaaaactgatttacccaataattgctaatgctttctccggaactttttctctaggaacttcctcatacgtttctatgtgtgctcctttattgctaattttcaaataatgattttcttttaacacagaaagaccattaaattcaaccgttcgttctttcccattggcatcagcagctttctgcacataccttgctgtaccatattcatttacttcctctggtttttgtgtctttacatagacctctcctttttcaactaatggatttagctgatcaagtataccagggatttctccataacttccttcagtataatatttcagtccaaatagcaaaataccactaatcgccgccagtccaatcaaatatttaatcactttcatctttctacctccttgttatatattcagtatatgggtcagttaaagaaattccatccgtcccaagttggagatttttctcctactttagaagcgagaatcgagtgtttttttagtaaaaatgatcgttatttgatattattgacgtgtggataaatcagtttttctcgttttgtccatgtaaaaaatcatgttgatagcaaaggatgtgttcaaaatgaatcaagaagaattatttcaaaaagtcaaggaaatgattaagaacggcaatttcgatggcgcaaaacgatttatcgaagaacataaagaacaattaggaccttataaagagaaagcccaaaatcttttaaaagatgtaaatatcgacagtgtcaaaaacaaatttaaaaatctattcaaataagtaaaactttcacttttgtaaaatcaaaggaggacaatgctgctgcatcgtcctcctttggttcttttctgaatacttcatactaaaataaacgtgtcggatcgtaatgataagtcacattgccgttcagtgaggcttttcccaccacatatttacgattctccaacttcagccacgcttctcgaaaagccattaattcttctctttttacatcaatcttttcgatttttccatcgatcaaatcttgaataagttgttcatatggattcatttttttcctccatctgctatctgctgtcaatcaataagttgtaaaaataggttcatatgcttttttggtatctagatcttctctgactttgactgtcgtataaataattttttctactgggatactataataacttccttcaccattattgaatcggtgaacgtctttctttgctaaaataccatttattttattcgtcagtacacgttgttcgacactgttacttacaacatagtaaatcacccgaatattattgattaaatgcaaatcgatttctaacactacatgatccatgaaaatcccactccttctttcactttgattatagcaagtttctcctctaatttcaaaatcgatacagattttaccggataaatccacaaaactgcttgcgccatttcgcacaaagtgttattttgtatcatggactttatttattggaggcaatagtatgatcgcgatcggtcaatttgttttttatattcctttttttattatgataagcattcttttctattacataaaatggacaaaaaagaagttttcagttttactggcctctttacctgctgtatattttacttatcaaattttttcttttaggcattgggaaacaacgtctgtattaataacacacatcatcgaattgacgctttcagtaatttttcttattatttggatctattttttatataagaatcagaattgaatccctcgcatgtttaaaaagaaaacgattaaagatgcagcaaatttctgccgatctttaatcgttttttctattctgttataccaaaaaaatgtttgaatcggtgaaggatcgttccttgttttaattctataaattcttgtgcgatcgggtacttttcttccaaattttctttgttcttttcgatcaggcttttcgcttcttcatattttttatctgcacatagtgcttttacttcctgtaatacttttcctgcttccatttgcctcaccctcttgccactttattgctttaagttttatttaagttatacgcattattctagtttcatcccaaataaccttttttcatttttactcctcgaactaatcagttttctaaaggctgattggttcgtcttttttatttttcctccatttcattctgctcttctgttaatttatctaatgctttgattgatgctgcggctcttgcataatcatagctgtataattccataaatttatcaggcagaacaaaccacgctggatgataaccgttagctgtgacagggaatcctttatcttgttggttatctccatcccatctcagagcaacacctttttttcctttccactttactaaagcgatcgagtatcccttctttgtttgtgtgccgtcttcaataattgctaaaatttctattttttcttttggcgcacggacttcttgaggacgaaccattttctattcctcccttatctcattacttcacgaccaacacactgcaaggggcatgtgatacgacataagaagcggtcgatccaactaatgcttgttgtatagcaccttttcctgtcgctcccataacgatcaaatcaatattttcttgtccagggatgacattggcaatcaaatttcttggatctccagtttcaactattgcgtggatctcagcaatgccgaactctttggcatcattgatttttttcagcatggctacttctgttctttgtttttcatctgcatagatttttgaaaaggcataggcactatgggtcagctcaactttgttgatgattgacacgataaataagtgggcttcattgtcctttgctaagtcaagggcttcagcgaacgctttgatcgattgtcttgatccgtcaactgctaccatgatgttctggtatcttttactcattggaaccgcctcctttttcttttattgtaacatctcaagcaaaaatacaaaaaatatacgcaatatgtaaataaaatgatgaacaaaagcaatttctttcaagttatttatacatttcttttctcatcagaacacctgttctaatcccattatttctgcattatgtgaaattcctcatcatttttcacatcgagcgaacatcattctgttatataaaaatgataactagttcggcacatttttggcacaaatacaaaataaccccctgtaccgcaaaggatacaggggttatttatacgttcctgactggaattgaaccagcgacctatcgcttaggaggcgattgctctatcctactgagctacaggaacaatttcaataaatcaattgtagcttgtttgttttttacttgcaagcttatctgctaaaaaaatcagcttataagttaggcaaaacgtttccactagtccttaacagatgataaactagaggtagaatgaaataatgtagggaggttctttccaatgaatgataagccaaaagaaaaagtatacgcagaacgcttagattcatctaaaaaaaatcgggaaaagattacgaaagaagcaatccaagaccacaaaaaagaaaaccctaaaacaaaagaaaacaaaaaattcaaatttacgaaaaaagaggatttactttaacattttccttcaaatgccaaatgaaaaacaaaagggtggtgacaaaaatattgtcatcacccgttttttatcaaaaatagtcattaagaattggctgttgctgtggcaagattgagcttaacgtttcttcatattcttttgtcacctgtattctttcttggaataccaactcttccactttacgataccctaataatagctgcgtgatatgttggatacttcctcgaacgattgggagttttgtttgttctacttttgagagatgattttttccattttcgattgttacttccacgattccttcattccatttcgcataatgatcttcttctatttgtagggcaaatgcagcttgtctctttttaaatggataattttccaaaaacaaagaaatatctacgatcctcgccatcatataaggtgtgatcattacagaagcaaatggattttctaatagataattttgatcattaccgccgtagccgcatgaatattcaaatgtttcaaaagcaccattgtgagaacttacgaagcgaacaaggctgcaaaaagcatcatgatccaaaaatccccactccgcaataataaaggaagacgttgcaagctgataaacgatatatcccgttgcttcctcattatcatcaaaatgcaaagcaaactggtaattgcctttttgcttgaatttatacgtataccaccagtcttcgcgcttcagaccagctcgttggttttccggcatctgttcataaattcttctgattgcagcttttgcatcttcaaaatccatacgctttatttttccagatttttttttgataaacggcacatcacgactgtttagttgataactgattttatcaaatgattgttcatagccatagcgccgatagaagggataggagaatggtgccagataagataagcttactttacgatcacggcaatcttcaaggatcttttccatgatctgattgatcccgccttgtccccttgcttctggataagaagcaacatagccaatgccggccattaggtactcttgtccgtaaaaattcactggaaaaggggtcgccatgacttgacttgttagccgatcctcctcatcaaaaaatccgtaattccaagaattctccgcaagtgtacgaaaacgttctcgcctttcaggtgtatctgccccattaaatgcataagtggctaaatcaaacatttcctcaatcgaagatacacctagctctcttactttgtttgtcattttgctgccccttcctacaaaaaagctagtgaggattcgcaggaaagatctatcttcctatgaaaaatttcttctagcttacttcatttttcaataactaaatagtaccatgtttcattgatttaatacgttgcttcgatcatatctaacatttttttgaaacgtctccgtttaaaatacatcaagattgttcctaaaagcatatcattcaacttttgaagcatgccataagactccattttttctgtgtaatgaacctcacaggtcgaatcgtccaatggtttgatttgataatgaacgacgaattcattcttcgttgtcgatgtacgaaacttataagactggttttcaatgacttcttcgatttttatgcgagcccggttattttgcgagaattgtttgacgtactccaaatttttcagctgttttctagttactgatttgccggtcgctttacgtacatcgaaaaggacagagtccataactttatcgtaaaaaaacgatgctggaatatttaattttttcgtgatttccattagttatttttctcctttgcttcttctcttttttttcccttcatgaagaaatagattcctaatcctgttagaaaaagacctgtgaccatactatacaaatcatacctttgcgaatgtggattcaaactatacaacacgatcaaagaaccaatactacataaaaataaaccgttttttatcatctcaaccatcctatctttttaaaccattttctaaacagctgttgattgaaaataaaggactgttccccaaggctgtgctttgatcagttcctttgcttttttagccgcaacttccggatcttctgcacttgtttcaaagaacagcttgattccttgtttttctttaaatgtaaaagtcattccttcttcattgtatccttctaacaattctttgatttcatcttgttgcattgcactggcaattgtaatcatttcagttcctcctcgaaaattcattatgaggaacgaaacttaaagcgttccgctcctcacgttcatcttattgttgttctcctgcggcagggtccattttgtttgcagagatgacaaatggtgcccaaatcaagaaagtcacgaccatacatactaatgttacgatcggtgcccgccaatccgcacctgttgctaagaatgacaataagaacggcggtactacccatgtgacttgctgcgataccggagcgactaggccaagataagtagctgtccatccaattgctgttgctactactggagcaatcaagaatgggataaacatgattgcattcaatacgattggcagaccaaacatcactggttcgttgatattgaagataccaggcccaatggataatttagctactgttagataatctgcacgtttagagaaaatcaagatagctatcagtaagacgatcgttccgcctgatccgccaaaccatgcaaaagcatcgaacgatccgcggacccacatataagcttttccatcttcgattgcatctaacacggctggtgtaccagtttttccgttataacctttttggaaaatatcaatattgattagttgtgcttgtccccagattccctctagcactggtgccaatacatttggtccatgaataccaaagaaccagaatacttgaacaaatactgtgacgatcaatactgctcccaacccttgagataatcctaggaatggttctgcaatatatttttgcaccaaatcaatgatcagttgcccatcagctacacgacctacgatataattgataatagcaatgacgtataaagcgatcgtcgctggtaaaatggctgcaaatgctttagatactgctggtggtactgaatcaggcattttgatcgtaatgttggcaagcatcaatttacaaaaaataatgactgaaatagctcccatgatcataactgtaaaataagcgtttccattcaaatgatctagttttagccaaccccataatccaactgacagtgtgccatctgcaatcgttgcaccaatctcagaactattgattgcatctgcgacatttgaaggaacattcacatctaatgctgctgataatgctggaccaaaggaaataccttgaatcaaggtagctaaaccaacgatccccccagctagatcatttactccataagctcgggcaagattatacccccaagaaaaggcaaagatcaatccggcgattgctagtgtaccgttccagacaaaaccattgattccgatgatgacattcaatacggcaaagattcctttgtctgctgctaaactgtcagcataggtactgttaaactgttgcggtaaatcacgaataattgcattgatcattacagcgactgatcccgccattgttgcgggcagtgtgccgataaaagcatcacgcaaagcaactaaatgtttttgcgctccgatttttgcggcaaccggcaggatgtatttctccatccaacttgatagtccgttcattttttacttcctcctataagttttttatataaagagagttctccttataacaaaataaaaaatccgttcaaaaatttttcttcttccgttcaaaaaagaagttgtatttattcgctgtatacgcgacgataaagttcgatgatttcttttgctaaatcagtaaacgcaatagatgtcattaagtgatcttgactgtgaacagtcaataatgtcacttgcatatgatttccttgtgcttcttgtgtcaacatgtctgtttgtgcatgatgcgcttgtataagtgattcttctgcatcagcgattttcctatccgctaactcaaaatcaccgattttagcagccgcaatcgcttccattgcatcgctctttgcattaccgccaaacatgattaaccccatgatggcttctagattttgttgatcttccacgttgttatacccccaactgcatacttgatttatttcattagattttctgcttgtgcaagaactttttctccgttcatcatgccatagtcttgcatattgatgacatctaatggaatacctttaggcgcaagtttttgttcaaattgagctttcataaaacgtacttgaggacctaataataatacatcgacattcttagattctaaattattatctgcatctgaggcagagaccgcaaaaatatcggcttccatccctttttcttctgctgctttttgcatttttgtgaccaataaactcgtactcatccctgctgaacaaactaacatgattgttttttttgccatttttaacactccttttatttttttacacttttatataacgcaagaagcatgccaataaaaaaaagagctgaaatagcgttttcatgctttttagctcttttttatagtgcgcacacagatgtttagtgtgtaaacagtatgattagtgtgttcatttttttattttattttcaagaaacatttgtgtaagaaatgcgatatcatcttctggaatttttacctgatattttcgttctagtgccatcaagtttgcccgaacgatatccatttccaaacgataaatttttgagaaaatagatagtttctcaaattgccgatgcgtttcttttttgatcaatccgtctagcatgaaggctaaatggatgacgatcccagtatctactcctggttctatgataatcgacaaatcggtctggatctgctgaactgttttttgcaatgagcggatcaattcatcaatagaaaagacatcacttaatgatcctgaaagtgaatcaacaattttagctgttggaatctcatcatcagctatacgctttaaaacattcaatttttcatcatcaaaaacgtcataggcggaaaaaaatgggatattttgataatcaacgtcaaccgttcctgcaattgctttgatctcatattcttccaataaggcatcaatgtgttttttgaatgattcgcgttctaaaaactgcatctggatcagttctactttgttttgattaatcactggcataatacgttgatacaatttggcagctactccctcaccagtaaaacatgtcacgatgacggcttttttacgctgtaaagtttcagacttttccgctttgaactgatcacgtacgattgattcaaaggaaagctggatattttgatagatgtcttctaagcttcttccaacacttgccatccgtatcgcttctatcacaatcatcgtacttgtcattgtgatagctttcgtccgaatgccagtctcttcataaatcaaatcactgaaggtgtttaatgatcccatatctgttaacaaaagcaagccattcgtcaaatgctcctgataatttttgacatattgtaacacttcttcatacattgtttgaacttccataaccagtggcatattaaaagctttccctacttttgttcctaatagttcttgcgccatctccaacatacttgaagcagtctgtctgccgtgcatcaatacgagaacatctactttgttttctttaacaggctcactttctcctaagttgatagaaagaaacatactgataaagccaatttcatcaaaaggaatctcgacttgttcttcttcttcaatgatcgtcgaaagatcgattgctacttgaaattccttcttaaaatttttccgtacgttattcaaatctgggtggacgatcatatgaccttctctcacacgatccaatgtactttgcagatgcaaagcaaaagcaaaacgagctttttcattataaatacggtctaaccgtttttcagccacatcatacaattgattggttaaccgccagatttcatctggcaaaagatctttgggaatcgaacttttagtcaattctttgacatatgtctggaaataagcatccacatcttttgaaatgagggtctctagatcaatgttctccacaccggtttcggaaagagaagtgactttttcctcaatatcgttatagacctgcatgtttcgttctggatcttgtgaccagacaacatcagcaaatcctggttcaaatgtcaaatactgacttttgctgtccatgaatcggtcgagacgttccggtatttccttgattttcagtaatcctttttgtacttgaagggaaagttcttcttttcgaatgattagctttttctcatgatgagtacggtaatgtaaaaaagattttgcacagactagtttcaagtctcgtttcacttgaccgatatttccttccgcatcataaagcatgaaggcaagaatcgcttctttttcgatatcgatacgttgattcaaacgattcgcttcttgtttgataaaaagagagatgatttcataacgctcatccagtgaacgtgaagcaagattcggcaaggtgattgccataggaatccgtcgattgaacgtagataagaaactttctgaagattcagtcgttgccccaatgatctgaacagatgcttcatgtacttgtgcactttctccaagcggacggtaaatacctttatcaatgaaagtaaacagcatttcctgcccttccggcggtaaacggtggatctcatctaaaaacaatataccgccgtctgctttggctattagaccgggactatcttgcgctgctcctgtgtaagccccttttttgatcccaaagatgtgtccaaagagcagttggggattttgagcataatccgcacaattgaaagaaacaaatggcgcatctgcagaaagcatctctgaatcgattgcaaaatgatacatacattcagcaaacatcgacttccctgtaccagtttctccaaaaataatcgtatgcaacccccgcggtggataaagaatcgcagcttttgcctgctgtatgctgacttttaaagaatcattttctccaacgagtgtttcaaaagtcacttgcgtagaagagtcgacatgcacttcatcagattttgacttttccgttggcaaagagtaaacgactggtcggccagcggtttttacaatatgatgggccttgtatagttcacttaaatatcggcttgcattgcttcgatcgatagttaagcgctcagctacatcacttgctgtcaatccttgttggttttctgtcaatagctgcaagatctcttcttgacgttctttcacataacccctcctctggcaaccaattttgttcccgttttcataatcatagcataaaaaggcgcttatttgcgccttgctcctttatttctctctttttttgatttatttttaactttttttcttattttttctttgttatattctgggttctgctcctttctagaaaaagttttcgcatactttttatttactgcaggagctgcatcttctttggttggctgctcagtttgcagcttacctccgtataaaaaaatctcttcaagtgttatatttgatggacgtaaaagccgttttaaatctcttagattattatcttgtacgagtgtaattactattccttcattacccattcgaccagttcttcccgaacgatgcaaataagcttcttcacttaacggaacttctgcattcactacataaggaagacctgtaatatctaaacctctagccgccacatctgtggtcaaaagtgctctgaccattttctttttgaattgttctagcgctgcttttcggagtagcttgttctgatcagaggccagacttcctaccggtacacctctatacagcaatttttcttccatcacgcctaattcagtcagttgattaaagaaaatcagaccatgaaaatcttctatatgcgtgagacgtctcaaatagtcatctttctttcgtatcggtacacgtaaaaagtaatgtctcagtccttttcgagaatcgtcctctgctgtcacgtcaattgtctcaaacgttttcccagtgattttttcaatgctttcaagggaacgatctgctgtcgctgaaaaaaaggctagctgatactctgttggagcttgatgaagaatttgatcaatgatttggctgttcccagcgtcaaatagctggtctgcttcatcaaataccattgttttcacttgatgtgcttttattttttttgctttcatcaattccaatattcttcctggtgtaccaatcaagatttctggttttttcttcaacccctcaatctgacgtttgacgttggctccgcccaccaaagattggactttcaactctttgtcttttccccattcacgtgcaacatctgctacttgaatagctagttcttgagaagaagcaaaaatgaccaacgcacttgcttcacctggttccacgtttagtagtagaggccaaagataagccagtgttttacctgaacctgtaggagaaaccgctactatactttgtttattacttagtggctgaaaaactgctcgttgaataagagaaggtgagataaaccctttatcctcatattttttctgccaattttcgggaaatacttgtacaaattcgttcattaaaaatcttcctcattatctgcatcgaatttgatgccgccattttttcttaaatcataaatcacttggttcacatttctagctagctcgatccactcttcatacaacaatccccaagctggatctttcggatgagccatgacattggcaaaatcctctgcttcatctgccattggattttctgcagctgttaccgccaaatcaatgatttctttatgctcgcgatcatgaaattgtgcttgttcaattgcattgactccattcatcactagcgttcctgagtcaaaataaatctctgacggtaaataagaatcaccgattttacctggctggatcgatacatcaaaattctcataacgtaagatcccccatccaagaccatctacaccagtagaaatctttcttgggaaataatggacttcttttggcattccaaaccaagcaacagctgcatatacaaggtaaacacctaaatccatcaatgcaccacctgagaaatgagtcgagaagatattcggttcttctccatctaatacctggtcatagcgcgaagaatatttcatatagctgaaatttgcaccgattatctcgtcttttaatggtaagtaatcggcaatctttttaaaacctgattcatggatatttcttgctgcttcaaaaaaatacacattgtgttcatttgccaaatggatgatttcatccatttcttttggcgtcgaaaaagctggcttttcaactatcacattttttcctgccaaaattgcttgcttagcttgactaaagtgaagactattcggagaagcaatataaatggtgtccatatgagtaatattgaaaaaagtcttcaaatctgttgcgaattcgatatccccttcataatgagaaccaaattcctgtgctttttccaaatgtctagaatataccgctgtcaattcatatttttttgtgcttaaagctgcttggacaaattgatgagtaatccaatttgttccgataatacctaagttgatcattattttaccttctttctattgtataggatcttcaaaagggatatctacatcaaatggaatggcctgcttgacagttacctcatctgccgatacttgacaattataggcgaggatttgaactccgctttgctgcgcatgtcgaaccatatcagctagtgctggttgcatttcttcatggatcgttgccagatgaagatgttcgaattgagcaataaacaagacataagcggcataaccatcttgtgcggcatacgttaattctcctatatgtttcaatcctctgagtgtgggcgcatcaggaaaagcaccaatcgctttattttcaagtgtcatacctttgacttcaacaaatgctttttgtccgaccaccgtctctaaataaatatcaaatttggagtgaagataagttacttcatgcttgtataccgtaaatggaccagttaatcctggtaaaaggatcgtgccgtctaaaataccatcaattgccagccgattaggcaattgactatcgatattaaaccagtcacccttcttttttacagcaatcagatcataggcggttttccgtttaggtccaggagcaaatacaatagccacttcagcgcctggtatcaggacctcttttcctctacctgtatttttgacatgcgcaataattatttctccgtcttttttcatacaatgtgctataaaccgattcgggcggtcaataaaaaaagctatttccacttgctgatacttcaaattatgtcacctttcttcctactatgtatcctatcataatttgtagaaaaacagtaaaaaaaccagtcgaaagtcttagagaaattttagcttttattcggtacaatgaaataaagaagaaagaatatgtctatgcgattattttctcataaaggagtgatttggtgataaaaaaaatgatctattttcttggttcactcattaccgttctctcaagttttatttacttgaaaaagaaaaaacaagcggaaaagtcagaaggactctcaaagtatcaaggtacatggttctttagtgatagccagcaaaaacaacaattgcagattacatctgattacacgtttttgatcaacggtcagtctcttggcacatctgtggtagaaatagatgaatatcgtttagtcgtacgtgatcagtatggtttttatcttatcttttcttatcccgaacaaactctttatgacgaatctgcagacacttcatataagttgttatctgaaaaatagatccctcccaatgtatatatatatcctttataaacgaaagaatgagtcttctctatcatctttcgttttttgttgtaaaaacgtctaaaaatcctttgttttttatttagaaaaatagtcaattaacgttttttttgttacacttactaatgatggttttttaccatgaaaggatgatcgaatatgacaccaaatcgagaagattatttgaaaatcattttagaactaggtggagatacaacgaaagtcaacaataaacaaatcgtatctagtctagatgtctcagctgcatctgtcagtgaaatgatttctaaacttgtgaaagaagagcttgtagaacattccccttatcaaggtgtacaattgactgcaagcggactgcaaaaagctagcagtctgattcgcaaacatcgcttatgggaagtttttttagttgaacatttagactatagctggaatgaagtccatgatgatgctgaagtattggaacatgtgacttcggaacatcttgcagatcatttagaaaactatttgaatcatcctgaacattgtcctcatggaggatcgattcctaaaaaagaggaagttgtccatgaagaacgccgacaaacattggagtcctatcctgtcggtacaaaagtgcgtatcgcacgagtgcttgatgaaaaagaattgttggattacttagtcactattgacctgaatatcaacgaagaatatgagatcgttgacatcgcagcttatgaaggaccgatcactatccaaaatgatagaaagaaaatccccgtcagcttcaaggcggccagcacgatttttgtcgataaaatataaaggagtgtatccacatgtctaatgaaaaaaatgtattgtttacgatattcggcggtacaggtgacctagcccagcgtaaattgtacccgtctttgttccgcctttacagaaaaggaaatttaggcgagcattttgctgtaatcggaaccgctcgccgtccctggagcgatgagcactaccgtgaagttgtcaaagaaacaatccgtgcattgaatccttcagatgaagaagcaactacctttgcaagccatttttactatcaatcccatgatgtaaatgattcaacgcattatcagacattaaaagaattgtctgaccgattagatggacactatcaattaaacggtaatcgtgtctattatttggctatggcacctcaattttttggaacgatcgtttctcatttgaaatcacaaaatattatgacaaaaaatggcttcaatcgtttgatcatagaaaaaccgttcggttctgattaccagtctgcttttgaattgaaccagcaaatcagagaagtattcccagaacaagatatttttaggattgatcattatttaggaaaagaaatgatccaaaacatctcagctatccgttttgccaataatatttttgaggctcaatggaacaatcgctatatcgacaatatccaaattacttttggcgaaaacctcggtgtagaagatcgcgggggctactacgatcatagtggcgcacttaaagacatggtgcaaaatcatattttacaggttgtagcattacttgcaatggaaccgccagtagcattttccgaaaaagaaatccgtacagaaaagatcaaagcattgaaagctatccgcatttataacgaagaagaagtgttagaaaacttcgttcgcgggcaatatgctcaaggtgaattggatggtgtacaattcaagggctatcgcgaagaagacaaagtggatgctcaatcagagactgaaacattcgtcgcaggcaaattcactatcgataacttccgttggtcaggtgttcctttctatgtacgtacaggcaaacgtttgactgaaaaagggactcggatcaacatcgtattcaaacaagttcctgttaatgtattcaaaacatctgtcgatgaaccatgtgacgaaacgacacttccacctaatgttctaacgatctatattcagccaactgaaggattttctttatccttgaatgggaaagaagtagggcaaggatttgaaacggaaccaatcaaattggaatttagaaatagtgcagaaatggttgaaaatagcccagaagcttacgaaaaattactattagatgcgttgaatggtgatggaacgaacttctctcattgggaagaagtcgctcaatcttggcatatcgtggatgtcattcgaaaagcttgggaccaaacacaaccggattttcccaactacaaagctggatcaatgggacctaaagcagctttcgaactacttgaaaaagacggattcgaatggatctggcaaccagataactggtatcgtgaacgtggaaaattaaacgattgataacaaaagggggtgtgacaaagaacatgtcacacccccttttcccttttacttttcttcgaatccttcagctacagcttcaggatagaagtcttcaacgatttttgcacaacgaccgcatagatgaggaagtttttcatctactcctacatctttacgaacttggcgacagcgatcgcaagtttccccgtctgctttttccactgtaatagcaacatcatcaaataccatagcgttatctggcacttgttcatctgctgccataacttcaaagtagtctggtgaaacgatcaataattgtgcaatatctgcatccaaagcttttaacatttcacgaacttgttgttttggataaacagttagttttgcttccaaagatttaccaatcaatttgctgtttcttgcttcttccaatgcttttaagacattatcacggaagtccatgaaagcagtccaggtatccatcaattcttcttggtttgcaaactcttcataaccaggaaactcgcttaactgaacgtactcctcttcttctttcaggaatgaccagatttcttctgctgtatgcggaatgataggagtcaataattttgtcaaagctacagctgtttgatagaaaacagtttgcatgcaacgacgttgataatcatcttctgcttcaatataaactacatctttagcaaaatccaggtagaatgacgatagatcaaccgtcaagaagttcataactgtacggtaaatatgcatgaagttatatttgtcgtacccttcttctcggatttctttgattacttggttcaatcgaacggtcatatatttgtctacagaacgtaaatcattgtacgaaacagtatcttttttaggatcgaaatcttctgtattcgctaataagaaacgcatcgtatttctgattttacgatatacttctgccacttgacttaagatatccatagaaacacgaacatctgcttcataatctacactagatacccataagcgaaggatatctgcaccaaattgtttgatcactttttctggtgcaatgatgtttcctaaagatttactcatcttacggccttcaccatctaaagcaaatccttgagaaataactgatttgtatggtgctacaccattgatagccacactagtcgtgatacttgagttgaaccagccacgatattggtctgatccttctaaatacatatctgctgggaatgataattctggtcgctgacgtaaaacagcttcatgagaagaaccagaatcaaaccagacatccatgatatctttttcttttgtaaattcgccattaggagaacctgggtgggtaaatccttcaggaagaagttctttcgcttctttttcaaaccagataattgatccatgttcagcaaataattttgccacatgttcgattgtttctggtgtgatgattgcttctccattttcagcatagaaaatcggaagtggtactccccatgcacgctgacgggaaattacccaatcgccgcggtcacggatcatattatacaaacgtgttttaccccatgggataacccactctactttttctacttcatccaaaatattctgacggaatttatcgatagatgcaaaccattgtggagttgcccgatagatcacaggctttttcgtccgccaatcgtgaggataactatgagtaaagaaatctagcttcagcaaagctcctttttcttttaatagatcagtgatcataggatttgctttgtcataaaagattccttcaaatccaggtgcttcttctgtaaacaatccttttgagtctacaggtgacactacagatagtttatatttgctaccagcgatatagtcatcttccccatgtcctggagcagtatggactaatccagtaccagcgtctaaagtaacatgatcgcctaaaatcacaagtgattcacgttcatagaatggatgacttgcagtcatatattccatttcttgtccagcaaattcttttagaactgttacattttcccaaccgatttctgattggactgtttctagcaaatctttcgctacgacaaacttacggccatcggcttccaccaatacatacgtaaattttggatttacagcaataccttggtttgctggcaatgtccatggtgttgtcgtccaaatgacaaaagctgtatcttcatcaagaatatctttgccgtctttgacattgaaagctacaaaaatagatggagattttacatctttatattcaatttcagcttccgctaaagaagactcacttgacggagaccagtaaattggtttcagtcctttgtaaatatagcctttttcagccattttaccaaatacgcgtacttgtgcagcttcataagaaggatctaatgtaacataaggatgttcccaatctcctgcaactcctaggcgtttgaaatctgctcgttgcttatctacttgggaaagtgcatattcacgacatttttccaagtattctgccatggacatttctttacgtttcacgcctttattagccaatacttgttcaatcggcaatccatgtgtatcccatcctggaacatatggtgcacgatagccagacattgattttgaacgaatgataatgtctttactgattttattcaatgaatgtcctaaatggatattaccattggcatatggaggtccatcatgaagaacaaagctaggttttccttcgttcaactcttgtcttttttggtagattcgattttcttcccattctttttgccactcgccttctcggtttggcaaattaccacgcatagggaattttgtttttcctaattgcaaggtttctttcattttcattcaaccatacactcctttgtttgttttccggacacaaaaaagcatgttcagccgcaagggacgaacatgccgtggtaccacccaaatttagttgcatctatctagtgcaaactctctgtgaccaataacgaggtcagccgctgcttcttactctaatttcggaaaagcaggtctcaagtagaggatctttcaccatgcagtgtcttaccgaacttccactctcatcggctcgctttaagaataacaaagtgcttttctgttctactcgttttcattttcaccaggcacgatcgagatatcaatagcctgtgtatcaaatgccgtcataggtgcttctatgactcctgtgtctgagtttacatcagtatcattttcattgtcaagctgttttgctaaaacttctttgatcacttcatggctgtcagtcacgtagctggagaatggttgtaaaatttcatcccattccggacttttcacttgttctaattgagactcaagcatcaagctgatacgttgatggaatactcgtgtttttttcttaagatcttcagtttctgtcgcaagctgtcttgctttttctgttgcatctgtcaagatttttcttgctttttcttctgcatcagttgttaattgatgtgcacgtttttcagcgttcgcaactaactcatctgctttgttttgtgcagaagtaacgatcacttcggattccttgcttgcacttgtttttactttatcagccgtatcttgagctacgatgattgattggttcaaagcatcttttaattcattgaagtactcaagtttttcttcagaatgtttgactgctttttctaattctcgatttctttgagtcaattcctcatagtcacgaacaactaaatctaagaaatcatctacttcgtcttgattatatccccgcatttttgtcgggaatgtcttattttggatatctaatggagttaaagccatgagtaaaccacctttttattttatttacgtaatacaccgaacagtaccctgtacttttcttttttcgtcttcccctcaagttcttggatctggactctgccataacctctgactgaaataatatctaatagttcaagtacaaaatcaggtcttgtattttctgtccagttcacttttactttaccagcttcgatcagctgcttggaccgctgtctggaaatattataaatctcagagatcacactgtctagtcgcatggaactaactgttcctctttcttgtgtccagctatctttcggcataatcatttctgtgtatttgattggttccaagcgtacagcaacctttccaatctttgttacttgtgcagcaacaaaatgatccacctcatttgcaataaatacttgccagcgatcaccgtccgagatgatatcgccaaagtaagagcgtttgatccccgttcccactaaagttccaaggattttcccatgacttaggctggcaaatttgctaggataatggatttcatacaatgctgtttcaaaatcttcctctacaggttcgtaataatcggggaaaatcaaacatctttttctttctgcctgttcatatccgccataaaacatgaaacgcaaatcactgctttgtcgaatcagtgtttctaaaatataggattgtcttgggtcaagaaattcggtcagatagggtgcatattgtccttgaacttgttcaatccaatcgcctaccgaatcgataaatgtacgttcatctgcccgaaagtgctggtatacatttgcatccaaaattttcccctcctatctattctgagaataaagattttgttgcttcaatcaataaactaaatggacagttatccatataacgatctgtgctaaaccttgtacggctaagttcaagatcaggattgcccctaaaattgtgaaatccaagggtccaatcctcaaaggcagacgatcgaacaaactgatatacggttcgcagatcttagctaataatcgtcctagccctgattgatacccgcctggaaaccaagagagcaatgcatataccatcaagataatgctatagaaataggctgcccgttgaagtaaatgaagtaatagtgcaatagtataaatcgtagttcctcctcttacagatcaaacaaattcgcatctgcaaaagattgagcggttgaactgtcaatctccatcccagtcggtgtacaaagaaaaatctcatctccaacacgtttgatatctccatctagtgcataaactgttcctgttagaaaatcaacgattcttctcgcttgtttttcttctactaaatgaaaattcactaaggttgcttctccagcaatgattcgtttagcaatcgccatagcttcagaataagctcttggttccattacagtgatttttccagcaagatttgctttaggttgtgtagaggttcttgaagctgttctttctttcgctacagtttttgtaggtgattgatgtagttcaattacttttttcttttcagccggctgaatactttcatgcgttacaggacgtgaagtcgccgttttttgtttttcatgagtattcgcagcagatacagaatgagttgattgattctgtgttgtattttttttagttggctgtacagccttttttgttgtttcaggataatcttggtattcgtactcttcctcatcagctaatccgaaaaaattagcaattgctcctctgtttaaaagcggcatttttgttcctcctttattcgtctttgaatagcgctgttcctacacggataaatgttgcaccttcttcaatcgcaatttgaaagtcttgactcatccccatacttaattcactacatggtgcatgggcataaccttttgcttgaacaagatcacgcaattctttcagcgtaccaaacactttatggatttgctcatcagaagcttctttaggcgccatagtcattaacccaacaaccttgatttttgtgcaggcagctaaagattccacaaacggtaaaagctcatctggtgaaattccatgttttgattcctcaccagaaacatttacttcaataaaacaggataattctttctctaaccgcttctggatttcttctgctaatcttaaactgtccaacgcatgaaagtaatcaatttcatttacaatcaattttacctttctgcgctgtaaattaccaattaaatgccactttatttcaggaaaatcaaataaatcttgtttcttttgtaatagtttatctactcggttttctgcacaattcataacgccagctctaaccaattcttcagcttgagcggattcaacagattttgttacagctactaatgtaacttctttcggatcacgatgaacaagagcacacgaatcctgaatttcttgcttgattttctgcaagttgtcagcaatcatgtgctcttcctctcctttattttttacgacggaaaaacggtggcgtatttaattcatcatcgccatgagattttgtttcttcgcggttgaatgtatcaaattcttttttttcgatattgtcaaaattggaatcatcaactctaggacgaacattttgttcacgtctgatatcccaatcgccaaaactgttttcttcttctgaagaagttggtttagcttgatccatatctaatacagtcttttgagcaggtgattgcatttgtgcttgtctagctggtcggctagacttgcgttccttttttgattcatcgatacctgttgcgatgaccgtcacacggatttcatcgcccatttcttcattgatagatgtacctagaatgatatttacatcgccagttgctgcatttgctacgatatctgaagcatcttgtgcttcgaacaatgtcatatccaaaccgcctgtgatgttaagaagtacttgttcagctccatcaatagatgtttcaagcaatggagaggagattgcttttttcgttgcttctactacgcgatcttctccactagccacaccgatccccatcaatgctgtaccttggttttccatcactgttttcacgtcagcaaagtcaaggttaacgtaacctggcgctgtgatcaaatcagagataccttgtacaccttgtcgtaaaacattatctgcttcacggaaagcttcaagcatcggtgtctttttatctacaacttctaataaacggttatttgagataattaataatgtatccacattttctttcaaacgagcgataccttctgcagcaaaacggccacgtttcggtccttcaaaagtgaatggacgtgtcacgacaccaacagtcaatgcgcccaattctttcgcgatacctgcaacgattggtgcagcacctgtaccggttcctccacccattcctgcagtgatgaaaatcatatctgcaccgtctaaagcttcgcgtaaggattgttcactttcttctgccgctttttgtccaacttctggctgagaaccagcacctaaaccacgagtatatttggggcctaattggataactgtttcagcttttgaattttttaatgcttgcacgtctgtgttggctgtaatgaattcaacacctttaacgttttcttcaatcattcggtttacagcatttccaccgccaccaccgactccgatgactttgattactgcgccgtcattgatattattatcaattgagaattccatatcttattcctcccaggatgaattaatcaaaaatatttgtaaagaaacccttgattttattttttacattttctccggactcttttggttccggctcatcgtagattgtttcttcaggtgcttcatagctctcatatgtgtttgttgtttcttgttcaactaccatttgacgagctgctgaggtttcacccgtaacagcaatttttgccaattgatacacttcactcaagtttgctgaataatccacgatacttattacatttgtaaataccgggtttctcagccccatgtgatttggaacatacaattttacatttacgccgaagatttcttgtgccaagtccacaacaccaggaagactagcagctccgcctgtcaatacgacgccacctggcaactctaatgcttcgatttggtccaatgcatcttttgctttgttgaaaatctgttccattcgagctgaaataatttctgacaagtagcgttcatcgactttcactggttctgactgaccaatcacatctactggaaattcttcatctggtgatgtccgttctgggtatgcatcaccgtagtttattttcaacgcttctgcattgttaaatgacgtatttaatacaatagagatatctttagtgacaaattcgccaccttcttggtcaagattggtaaacttcaattgcttatcatgcataacagccgttgttgtttggccgccacccatatcaatgacgatcgtaccaaaatctttttctccgtcagaaagaattgattcagtcagcgctaaaggagtaatcaccatttcgttgacgattaatccggcattttccacgcatttacgtatgttatggatgatcgttttaggtcctgtaaacaacagaccgtacatttctaatcttacgccgatcattccacgaggatctttgattccctcgaacccatcgacagtaaaatcttgtggcaatattgacacgatttgacgttcaggaggtattgaacgaacaagggcagctgaagccacatttctgacatcttcatcggtgatttcctttgaatctccgttaactgcaatcattccctggcaattttctacttcaagcatgtttgctggcaaaccgacacttacgcctttgatctggatacctgctttttcttctgcttgtcgtactgctcgttgtatcgcttggaccgttttatcgatatcaacgataatgcctcggttaatcccttctgattttgcgtttcctactccaataatattcatttggctgtcgatatattcagccacgacaactttaacagatgtcgttccaatatcaaggcctacatacattcctgtttttgccatgaatgggattccctcctacttactattccatatacaagcgaacaactagcgtccgttttaaaatatacttattaatagatatattcactgcttccaattctaccataaattactggtttttagaaagtacattcttactttttaaagttgttttatcaattttcatttaaacttgacggagttgtacttggattatcttctatttgacttgtttcacttgaatcatttgaatcagatgatccgtttgtgctagacgatccaggtgtttgtgcttcttgcgtttctgcctcttcacttgattcgtttgtttgatccgcattttcttcactttcagttgtttcttccgattggcccgattcttccgtttcttgagtgctaccgtaaggatgcgagaagataccaacttccatgtcgatcacacctttttcatccatatctttggctacttgcgaataatatttcatttggttcgcaagattattgatatttacaataacttgattgccgtcattcatattcaattggatcagatttttattgcttgctcttggcgtgtacttgatttcagaaattgctttttgtaattctgatgataactgattgtattgctttgttaattctttgatttttgcagagtctttgaactcttccaagatagggagattttttgtaggatttgctactttttcatctaatactgttccattttcaatcactgggtagtattgattgttttttgcgatcaaagcaatctctttatattctgttacatccaaatcgaattcattcatccctttgaaatgtatatttgctgtttcgattcttggctgtgcttttttaaggcgatcgatataagtagatcgatgaaaatactgtccccaaacattttctcctaatgacaattttgtatcagagatgatttcttggctgttgactgtcttattgcctgatactgcaactgcttgtaatttgctataaggagaaacataatagatcaaaaaaatcagcggtatacccaatacagtgatgatcaaagctaaccgacgaaatagtactttgtgccgttgactttttaaattgggcagccggttcaaaaaagaaccgttatatggcccaccgtttttcttttgcttgatctcttcaaaaaattcgatttttttctcggactggctttcttcttgctgttcctcttgaatcgttttttcttcttcagaatctgaaaggggtgtatctaatgttatgtcttctttttttggctcttggtttttcatctcttgttctgccagatattttcggttagccttttgccaaggagtcaaattgttttcatcagaagacggatgagacaatttttttggttcttttttcttactcactaagaccaccgcctttattttttgattatttgttttactaagtcataaagacgttttgaagcatcagggattccttgttctttagaagctcggcacatttgcttttgcaattcttcatcacccatgatttcgttgattgtctgacttagtgattcacctgttagttcattatctgcaatcatttttgctgctcctgcgtgaacaagactcattgcatttttagtctgatgatcattcgtaacatatgggctgggaaccaacactgccggtaaccccagagctgtgaattctgcgatcgaagttgcaccagcacgccccaccagcagatcactggaagccatgacctctgccatatttttgatataaggctggacactaatattttgtatttcaggatttattttatttaggatctcttcataatatctatctcctgaagcatacaaaacttggtaagaagaaggaatatattcacttaaaaaaactgatactgcttgattgattttaagtgctccttgactaccgccaaaaatcaagactgttttcttttctggatccaaaccaaatgttttcaaaatatctgattttttagtatctgctacttcttgtgctcgaggattacctacaagaactgctttgttttcaggaaaaaaggaagccgcatctttaaatgaaagagcgatccgatccacatatcggcttaaaaatttattggtaacacctggtacactgttttgttcatggataattgttggaatacccattttggctgcagcgtacactaccgctccggaaacatatcctccagtaccgataacgatatctggttgaaaatcactgaggattttttttgcttgacggatactcttaagaaacaatcggaccgtcttgatgttatgcatggaaatttttcgtttaaatccttgaatctccaaggtatggaaaggcattcctgtatcagggacgattttgttttctagacctcgttttgctcccacatacatgaattcagcattcggttcttgagtctttacataattgacaaaggcaagagctggataaatatgtccccctgttcctccgcctgtaaccaaaattttcattttttatcgctcgcttctactttttctattttaatcggttcacagcttccatgaatctgtttcctctagtttcaaaatttgggtattgatcccagctggcattcgctggtgataataaaactacatcaccatctgtactgttttctaatgctaaaggaactgcttgttctacagaatcggctgttactattgtctcgatgcctgctttttttccagcatccatcaacttttcttttgtttggccaaatacgaccattgctttgattccttttaatgaaggaattaattcatcaaatgtatttcctctgtctaatccgccagccaataacacgaccttagacgtttcaaatccacttagagccattttagtcgctaaaatattggttgcttttgaatcattataaaattttctgccttggatttctcctacatattgcgtacgatgtggtacgccatggaataaattcaacgtttctcgtatagcttcatttgatataccatacaattttgctacagaaatagcagctagtgcattttctacattatgcttacctggtacgccaagttcagatatttccattattttttcttttttatagtatattgagtaatcgtcagcatacacaccgtcttccaacacttcttttgtcgagaaaggcagtacacgtgcttttgttctttgcgctaattcttgtagttctgactgattccagttaaggatcagataatctttttctgtcatgtttttttgaaggttccatttagctttgacatattcttttcttgtaccatgataatcaatatgtgcttcatagatattggtaatcaccgctatatgagggcggaaatctgtgattcccatgagttgaaaactagataactccatcacgattttatcttctggtttcgcttcttgcgcgacaccacttgctggatacccaatatttcctgctaaacgtgcaattccttgatctgctcctgcattcagtagtagtcctgtcatcgttgttgtcgttgtttttccgttcgttcctgtaatcccaataattgggcattccgctacttcgtaagctagctcaacttccgtaattaccggaatacccatttcttgggcttttgctactaaaggatgactgtagggaatccctggatttttgaccatcaatgaaaattcttcatccaacaattcgattggatgactgcctgttattacttttatccctaaagaaagcagctcttgtgcttccggattttcgtcaaaaggttttccatcattaacggtgacaagtgcgcccaattcatgtaataatttggccgcacttactccgctttttgcgagtcctaagacaagcactttcttattttcatatgttgatatttttttcatttcccgtcatctcctaccaaacgatccataatgtgatcaacgaagtcacaatgctgatcaaccaaaaaactgtatcaatcttccactccgaccatccgcacatttcaaagtgatgatgaattggagacattttaaaaattcgttttcctgtaagcttaaaggaagtaacttgaagcatcacacttgctgtttccataacatagatcaaaccaatcaaaagcaatgtccattcttggtttagcattatagaaattgccgctaaaagtccgcccaacgctaatgaaccgacatctcccataaaaatcttggcaggttttctgttgtagacgaagaaacccagtaaacctcctaaaacacttaagcaaatgattaatacatcatactgatgctgatgccaagcaattagaccgtaagctgcaaaagagatacttcctaagccagcaactaatccatcgatgccatctgtcaggtttaccgcatttgaaaatccaacaagccagaagagagcgaaaataccataaatgattcctaaaggtagatctagtccgaagaaattcaatacacctggataaccttcagaacggtaaacaagataaaagatgattccccctagaatctgtccaatcaatttctgcttcgagttcagtcccatgtttcttttcttgaatatttttataaaatcatcaagaaagccgattactccgtataacgctaatacaaaaagcaagatgaaaagagtaggagttagctgtttttgccaagctccaacccaaattcctgtcaaaatagagccgatcagaaacactaagccgcccattgtaggagttccggctttgctattgtgccactttggtccctcctcacgaatcgcctgaccttgctttttcatttgaaagtaaccaataaatagcggcattgcggcaattgtcattgcacaactgctgacaatgggaatcaatgcttgtgtccattccatgctcttttctctcctatttctcttcttattcttctaaagtaaaactaagtttgtcttcagtgattttttcatatggagcaagttcttgtttgacacaataaccatctccatcaaaactaacttcaataccgaggattttccccagcttcatgatatctgcttttgaccatcctgttacgtcaggcatcagcttatcaccaccagtgtataggatcagtttttctccagagatcaactgatcaccgttggcagtagattgtttttgtacttttttaccattaccgatcactacaggttgcagtccacttttttgagcatcagctgctgcaacgtccgcttcaagattacgataatcggctacggatactttttctgtttttgtttctgtatctgaatcttcttcagtttctttaaaatccattgcccgtttcatcaatggatttgcgattttagccaaggccattcgatcatatgtcttagggtgtttcattgttagatacaagacatagtctggatcttcagaaggaaccatctccacaatcgaatacaggtaggctgtatctcctgtttgatatccccctgtatcagaagcgatttgggctgttcctgtttttgccgatacattgtatccaggtacactatatacaccataagcactaccgtagttttcgctttcgacaacatctctcatatattcacggactttttctgttgtttcttttgaaaaaggttgccctagaacttctgtttgagttgttcgctcttctccagtttggggatccaccactttgctgatatatcgaggttgaatcattgtaccgttattcgcaatagaagtgaaagctttcatcatttggaaattcgtcacacctaccgcttgtccataagcactcattgctcggtcgacaatatttgatgtaggtaaagcaccgtttacttcatcatctagtccagaatgagtactttgtccaaatcccagtttttgtaaatagttataccatcgtccacctaatcgctgttccagtatgaccatcccgacgttacttgaccatgaaagagcttgacgcatggtcagcacacctttttcaccaaagtcatggtcattgatcgtagcatcttctacttggatttttccagattggaaggtttcattctcgttgaattctccttcttcgatagcagctgcagtagtgaaaactttcatggttgatcctggttcataactatcttgtaccaagaaattacgccagatagcatcttttccagtcaatccttccattgtttcaggattgaaagtaggtcgttgtcccattgccaagatttctccggtttttgctttcatcaggactgctgtcaattcttctggctgatattcttcatttacttgatccatcagtgtttctaaataactttgtagtctgctgtctaaagtcgtgtagatatcttgtccgtcgacagctttttcttcttctgccactgtacctggcagaggattttgaaaattatctttttgataaataatcttaccatctttaccgctcaagatatcattgtaagcagactccaaacctagtttaccaactaagccattctcatctttgtctggaactgcgtatccaataaaatgagaagaaaagacgccatttggatacatccgagcctgatggtcgacaaagtaaagaccagcgacaccttcttttttcatgtccgcttcgatgttttgcttggtttcttgggagatatttttcccatagctaccaaattcaacttgatacagctctttttttgcgccgtcttctaaaatattcagtgcatcttttttgtctatagaaagattcttatgcaggatttctgctattttatcaaaattcttttcttcaacatacagttttttatccccagaggtatatgtttttgagagtatcgctttaattgaataagaggaggcatcttctgcgagcgccacaccgttacgatcataaatcgttcctctttttgcttttactacttcacttccttggtacaactgttttgttttttcagctaatgaggtaccagcaacatgacctccaataacgatatacgagaaacggacggcaaataaaaagaacaatccaatactcgtagcaaataaaatgatacctacttttttgcgattgttcatcggatttagatttttcttttccataaaccgccgaattttatttttaagactcatttacttcactttccttaaattgtcgtcattaatagacaatcctttttcttctgcgatttgtttaatccgttcagtacgagaaagttcgtttttttcttgttctaaactcgttttttcttgctttttatcattgatttctgtttgtattgacgtgatttctttttcagctccgctgatatttgtgcgcagcataactgttaaaacacataaagcaacaatagcaatcgccacgcttgccacagcaattttttccaaagcagaaatctgctttaatcgttttgccggtgattgtggaagaatgatttcttgattcgaagaagaatcaggcatttgttgttccggctgatccaccaattcaggtaaatcatattcgtaatcttgcattttctttaattctgccatcattctactcctctttcattcttattttttctgcaatacgtaactttgcactgcgtgatcgattgttttctgttagctcttcctctgaaggaaggattggtttacgagtaatgactttcagttctggttggaattcgtcaggtatgacaggaagtcccggtggtagatcttgtaccgtactatattctttaaacatacttttgacaattctgtcttccaatgaatggaatgtgattacgctgattcttccattgactttcaataaccggattgcctgttctaaagaggcctcttcggcaccgagttcgtcatttactgcaatccgcacagcttgaaaaattctttttgcaggatgcccgccttttcttcttgcgggagctgggatgacttgtttaatgatttcgacaagctcaccagttgtttggattggttttgtttttcgtactcgttcgatttcacgagcaatttgtttggaaaatttctcctcgccatagcggaagaaaatctttactaattcatggtaggaatattcattaattacgtgataagcggataaaggagctgactgatccatgcgcatatccaacggtgcatcttgatgataactaaatccacgttctgcttcatctagttgaggagaggaaacccctaagtcatacaaaataccatctaccttatctacatactcactcaagcgttcttctaattctctgaaattcgctttgataaatgtgaccatcccttgttcgacataagaagctaaacgcagcttggcatgatcgattgctttttgatcttggtcaaacgcatacaggtgccctttagaacttagttggcttaataaatattcactatgtccggcaccgccgagtgtacagtctacataaacgccatccggtttgatgttcaatccatctaccgtttctttcaacatgactgtatagtgttgaaatgtttcagtcattagtcagcctcttcctattcttatagtccgaaatcaatcatattttcagcaatttcgtcaaaattctcttctgcttctgcataaaaatcttcccatcgtgtctcatcccaaatttcaattcggttagatacaccgatgattacgcacccttttgtcaaagctgcataatttcttaacgtgcttggtatattgatccgtccttgtttatcaagttcgcattcagtggcagccgaatagaagaatcgcacaaaagtacgtgcgtcttttttagccaacggcatttcgttcagtttagcttccagattttcccattcgctcatcggatagccgaaaagacagccatccaatccgcgtgtcagaacaaacttttcgccaagttcttcacgaagttttgagggcacgattaaacgtccttttgcatcaatattatgttggaattcacccatcaacattgaaagccccccattcctccactaactaaaattagtctaccacaatcccccactttctaccaccttttctgggaaatccgggaacaactttttttattcataaacatttttttaaaaatcaagctgcaaaaagccttttaaaagactttttacagcttttctatttttttcataggtaagaaagtatgttcacaatgatcaagacagcgtacaagacgattgtcaacagaaaaaccaaacgccaagtcatcttgaaataacgcggataaatgatttcttcataataatatgcttgaaaaacagcaatacaaattcccattagcaaaacagaaataaagaaaaacggcaagatagaaattgtccctgtatttctagacaatgcatgcataccgccccacaaaaaaggaatcgccaaatcaggggcttttattttaaaacgacgatttaacgaaaataattttacaagaaattggcaaccaaacaaaacgattaccgggtaaatataccaaaacaagataagtggtgtgaatgtgcccatgaacgtaaactccttttttatcgttgcttcaagtatactgtatatactttacacaactgtttcattttatttaaatttatgcagttatattctatatcttacaaacacattccatgtattccaattccctatccgttataataaaagaaacaggcaacaggaggaaaatcatgatcaaatattttacattagataatgagaaactgcgtaataccggaaaggaaactgaccaaacgatctggtattgtgtagaacgtcctaatcaagaagagattcatcagctgacacatcaatttgaaattccgtcagattacatcacttccatattggacgatgcagaaaattcccgtacagaagaattcaatcaatcaaagttgacaaagccagcgttattattgttacaatatccttttgctaaaacaagtcctagcggttattttcaagtggatacatacccgctctctattattttgacgcccaaaaagaagcttatcacaattacgaatcatgaaccactgtttttaaagaaagtctttagccagacctttccaaaaagtgatatttcgcctaatctcaatatcttctttcaattcatttggcaggtcacactctcttacaacagttatttagctacgcttcaatctcaatgcgatactttggaagccaaacttcaagtatccactgaaaacaaacaactttatcaaatcatggatatccaaaaaagcctcgtttatttcagagaagcgacttctgctaatttagatgcattgaaagaactagcacaaaataaacttttccaagaaaatcatgctttgaaaaatcatttacgtgatgtattggtggaaacagagcaggcaatgactacttctcgcattcaattaaaactagtagaacaaatgaatcagactttttcagcaatcgtatcgaataatctgaataatattatgaaaattttaacttctttaacgattattttaactataccgacaatcgtcggcagtatctatggaatgaacattaagttacctattgctgaaagggatgatgcctttatatggctagttctattaacattatttatttgtatcgtaactacctattatttaaaaaaagggaagtttttataaaaaagccctcttgtggaaatggcaaaaagattgtacacttgaatcaactaattaatgacgaggttgaaaacaatgcgtgaaaaaaaacaaacaagtacttttgctaaagtaacaaaatttgtcatttggacaatgctgattttaacgattggatctgttgtattgactgctgtaatgagtgtcatgtaaaaataaaatatagctgtcagctgctgaaaaggacctgaaccactgcgaggtggctcaggtcctttttgcgagtttcaatagttcttttgcatgttcgagtgtgagttttgtaatctcacttccagccagcatacgtgcaatttcttcttctctttcttttgttttcaactctgaaacagaagtttgcgtacgtccatcaatcactgctttcacaatataatattgatagtcggcgactgcagcaacttgaggcagatgagtgatgcacaaaacttgagagtatttcgatatttgagaaattttatctgcgatggcttgtgcaactcttccgctcacacctgtatccacttcatcaaaaataatacttgtcacaccttgctcagaagaaaaaatagttttcaaagcaagcaacatccgagacagttcgccaccagaagcgactttcaccaaaggcttcagtggctctcctggattggtcgtaatgtaaaattcgatttggtcaaatccatcatgattcaattgtctattttcttcttttaagaaacgtacctcaaactcagtgttttccatatacagacttttcaattcatgcagaatggatttttccaattcttttgcgatttttttacgcgcttcatgaagatctgcggcttgttgctgaagtagaagctctttttgctctagttcctctttcattttgtccaattgaccttctgaaaaatcagaagaagctagctcttcggtgatttcgtcatagtaagccaatattgactcaatggattcgccgtatttacgtttcaactgtcggattaattctaaacgttgcgtcacttcttctaaacgactctcatctaactccaataaatcaatctgacgactcatatcgccgattgcatcttgcagcaaatagtaagcactttggatattttcataaattgcttcatactccacatctagatgggcgatcccttgcagttctgaaacggccaagccaacaccatctacactgttttgttcattattcgtcagtgctccgtaacctgcagctaatccatcagcaattttttgataattgctaagtttttctctttcttcttttaatttctcttcttctccgacttgcaaatcagcagcagctatttcttcttgctggaaatggagcatatctattctctgaacataggttttttcattttgctgcacttttcgtacccttttttccagctcacgataagagatatattcttgctgataactctttttcttctgttggaaagctacatctccaaaacgatccaataaagcaagatgtgattcaggctggagcagttcctgatgttcgttttgtccttggatatctactaaataactgccgattcttctcagattagctaatgtgatgatatggccattcactcgacaaacattttttccagttaaggacatatcccgtcgaacaatcagattgtcctcatctgtttcgatccctaattcaaccatcagttcagagaatccttcttgttttggtagttcaaacaacccttcaagcacacatttttctgctccttgacgtatataatcgcttgaacctcttcctcctgctaacagacctaaagcatcgataataatggatttacccgcaccagtctctccggtcagcgcggtcattccttcgtgaaaagaaagccgcaattccggaataatcgcaaagttagtaatactgatttcttgtatcatcacattcgctcctcaacttaaaggtaatgcaggaagtctttcttcaataaaactgcctggtcttcagttcgtgtaatcatcaaaacattatcgtcatcattgataatcgaaaataattctttcttgtaacgtttatcaatcaaatttgctgctgccgaagcatttcccggcaatgtttttaaaataacaaatttttccatttggtcaactgccacgaaagcgtcttttaatagtttttccaatttagtatttacatcttcgtttgtttcagctggtatgctataacggtagcctccatctgaggccggtaccttgatcagtttcagttcctttatatctctggaaatcgtagcttgagtaacagatattcctttgcttttcaggatttcaacaaattcttcctgctttcggatatcttgctcactcaacaatcgagtaatcaaacgatgccgatctttttttctcattacgtcttcgctccttagcatattcttcttaatcaatgatagcttatttccttggtataataaagaagaatccgcatacttctcacttgattttcacagttacaatttatttatggtcaaactgttcgtgtgcatttgaaaccacttctgccatattaatagctgaattgattgttccgctttcgggtactttcctcaagtgagccaagaactcgatatttccttctccccccgtgatcggagaataacttaattccagcacatcatatccaccttgtgccgcaaatgacaaaatgtcttctaaaactttttgatgggtctgagggtcacgaacaattccgtttttccctacagcttctctgcctgcttcgaattggggtttgattaaggcaatcacttctccctcttcttttaaaatagcatgtaatggaggcagcatcagttttagtgaaataaaagaaacatcgataacagcaacttctggaattcctaaggtaaagtcttcgggttttgcataacgaaaattcactctttccattacgacgactctaggatcttgtcttattttccaagctagctgattgtagccaacgtctaaagcataactcatttttgcgccattttgcaaagctgcatcagtaaatccgccagtggatgcaccaatatctaacaatgtttttccttcaacagatagatcaaatgctttgagtgctttttctaattttaatcccccccgagaaacataaggaagttttttacctttgactcttaattcactactcactggaattttttctcccggtttatcaaaccgctcgtttttttcgttgtaaatcaaaccagccatcactgaacgtttggcttgttctcttgtttcaaataatccttgtttgaccgctaatacatctacgcgttctttttccattcttttcctcatttctccacatcaaattgcttgatcatctggcgcatcagcccgccatcaaaagaaaaaacgtcctcttctaatttgtctatgatcttgttggcggataacagttcaatctccaacgcctcacgtgtcttttctaggcctaataaacgcgggtaagtatttttttccatacgttcatctttaccagctgttttccctaatgttttcgttgtaccaatcacatcgagtagatcatctcttatctgaaaagccaaacctaaatgttcggctaatcgttgaagtagcaatatgatttcttcaggttgcttcgctaatatgccaccagccagcaaggcataacgaatcaaatgccctgtctttctttcatgaataaatgctaattcttctaaagaaagctttttcgattcgccctcgatatctgcagcttgcccagcaaccataccttgtgatcccgcacaaacagctaattgctgaagcagcagaagcttaggagaattacctaagtgtgccatactgattagctggaatgctcctgtaagcaaaccatctccggccaatatagctaatgcttcgccgaatactttatgattggtaggttttcctctacgaagatcatcattgtccatcgcaggcaaatcatcgtggatcaaggaatacgtatgcaccatttctaaagcagctgctacttgatagacgggaacatcaataggctcatcaaaggaagcaacggccgttaaaagtaataagggacgtattcttttcccgcctgctttcactgaataactcatcgcatcatagagtcctctatccgttgtatgctcatctaaaaaagacaagatttctttttctacagcaggtagatgaatagctgaaaagtcagttaatctcatctcagctttcctcgtttccgtcaaaatcaacttcttcatttgattctgtcatcattttcgtcaaggtctcttctgctttagctaatgtatcttggcaatgtttgcttaattccattcctcgtttaaacgaatctagagctgattctaatggaacgtctccttgttctaactgcatgacaattttttctaattcttgcagtgactcttcaaaagttggattttccatatttttattctcctttgtctatctcttgtacttgtcctttaacgattccatcttgataatggatcgtcagcaaatccccttgatgaatctcggagacactttttactacttgatcatttaacgtcgtatagctgtagcctctccccatgattttcaatggactcaacaaatcaagagattgaacagcttgagcaaaacgctgctgctgttgtttcatatattgttggattttctcttctaagcgtttttctagataagcagtttcttggcgagctgctttaactcgataaagcggagccacttgttccaattggtggcttaatgcgatcgtttgtttttctttcgcatgataaatttgctgtgtagcttgatataatcgctgtttcaactggtctaatttgatggtctgaccttcatacaatctttcaggctgccgaaatacataggaacgtcgagcacgctcgaaccgttcttgtttgcgctggatctggcgtacaaacgcctgctgcaatctagcttgccgttcttgaatgcgcatcaactcttctgacaaaacaggaacagctaattctgcagctgctgttggagtggcagcccgaacatctgctactaaatcagcgatcgtggtatctgtttcatgtcctacagatgaaatcaccggcgtattagcttgataaatcgcccgagcaacccgctcttcattaaacggccataaatcctcaatcgaaccacccccacgaccgatgatcattgtatcgaaattgcccatctcttctactctctggatattcctgacaacattgtccgctgcttggtttccttgtacaactgttgggaacaaaaccaattggacaattggatatcttcttttcaccgtcgtgatgatatcgcggataaccgctccgcttggactggtaaggaccgcgattcgctttgggaaacgtggcagcatttttttaggcccttgaaaaaggccttccttcatcagcttttcttttcgttcttccaattcttgatataaagcacctattccatcaggctccatgtgctctacatagatttgataagaacctcccgcttcatataatgaaatacgcccaacgacaaggactttcattccttcttttggctggaatcgtaatttttggaatgctcctttgaacataatagcagatatttttgcatggtcatcttttaagctgaaatattgatgggcattggcacgtaaacggaaattcgagatttcgcctgttaaatatacgcgttctaaataaggatcggcatcaaatttacgtttcaaatacctcgttaatgtagtgacagttaaatattcttgtgccatctattcacctgctccaaaagcttcggcagattttacggtttgatacatcagcatcgtgatagtcattggccctacaccctttggcacaggagtgatccagcctgcaataggctccacttcatcaaatttcacatcaccgatcagcttaccgttagcatcacggttcatccctacatctatcactacagcacctggttttacgaattcttttgtgacaaaatgtccacgtcctattgctacgactaaaatatctgcttcttgtgccagttcagccagattttcggttttagaatgagcaacagtaacagttgcatctgccatcaagagtagctgagccatcggtttaccgacgatattgcttcgtccgataactactgctcgtttacccgccggatcgatagaataagcttcaaacattttcatgatgccgtatggagtacaaggaatcttgtccggtttacccgcaaggagtctgcctaaattcatcggatggaaaccgtctacgtctttttcagggcggatagctaacaggatcttttcttcatctatatgctttggcaatggtaattggaccaatataccatgaaaactaggatcttgattgtatttttcaatttctgcaagtagttcgtcttcagaaatcgtctcaggataacgctctaccaatgaatggattccgatttcttttgctacacgttctttatttcttacatagatttggctggctggattttcccctaccaataaaacgactaatccgggatggataccattatctttcaatttttggattttttcagcaatctctgcctgcattttttcagctaattcttttccgttaatcaattctgccatctaaccactcccagatattttttgtgttttcattctaccatagaattttcccgatttataacaggtttatgatgattcatagaaaaaagctaggacttacgccccagcttctagttctttcaatacattggataaaacaccgttgacgaatttacgtgaacggtcatcactaaatgtttttgccaactcgattgcttcatttaaagcaacagccgctggtacatctgtcacataagtcatttcaaaaatcgcgatacgcaagatcaccaaatccatttttgagatccgattgatgtgccaattgtttttcaaatgtttttcgatcactttatccaattcatctttttttgcacagacaccgccaactagcgtatcaagataaacaggaacaaactctgattcatcttcgttgatcatgtcgcggtggtctaattcgattgcgttgaaaatcgcatcttcttttgttaggtctgcattgaagtctaatggaaataaagcctgcaatgccatttcccgaatctcgtgtcttgataattctttattcattctcttcctcttcgtcttcaaaaagttcttcgattgttggttgttctaatttttcaggaacaacagctactacatggatattgacttcagataaatcgatatccgtcatgaaaaggacttgctggctgacccgttcctgcatttccattgctactttaggaactgaaacaccatattctagataacagtaaagatctactttcaagccatcttcctcgtttgctaagtaaacaccttttccgtgagctgcacgtcctaataattcagtgacattgctggcaaaagttccgcgcattccgtatacgccttctactttagaagctgcaatcccgataattacttcgatgacttcaggagcgatcacgatctctcctaaatcttggtttgcgtttaaaatcaaatttttttcatctgccatttatttattcctccctttgcctaagcacgagatacatccgaattctctatgatgcggcatagtgatcacgtggtaagaaaactgccgccgatcagctgcaaactgctatgaattggagaaaacacccaactttattatctcttacagcttaaaagttcttctatagtgtatcattaaatcgagtgattttctataacaaagtctgtgaacactgatttttacgcttacttcttctattgatgaaactataagatgatcaattcttttggtgaacgagtcaacacacgatttccatcttctgtgatcaacaagtcatcctcaatacgtactccaccgattcctggtaagtagatccctggttcatcagtgatcacatttcctggtacaaattgcttttctgcacgagaagaaacgtttggtccttcgtggatctctaaaccgatcccatgtcctgtagaatgtccaaatgcttccccgtaaccatgttttgaaatataatctctagcaactgcgtctaattggacaccagtcattcctggttttgcagcatcaataactgctaattgagcatctaagactatttgataaatttcttttaatttttccccaggatcaccaatagcgaatgtacgtgtcatatcggaaacgtacccttcgtaatagcagccaaagtccaatgtgatcaagtcgccttgttcgatgatttttttgcttgctacaccatgcggcatagccgaacgcaatccgctagcaacgatcgtatcaaaagaaacacctgaagcgccaagagaacgcatataaaagtctagttgatttgcgacttcaatctcagtcatgcccggttggatcattttcaggatgtgatcatatgccatatccgcaatatgacatgctttttcgataatggcgatttcttcttcatctttcacttctctgagttcttcgatcatctgtgaaacaggtactaattccgcatcgatgatttcttctaaaaccgaatattctaaaaatgagactgttgtttcctcaaaagctaatgagtgcagttcttctttgcgtactaagtttgctacctcatcaaaaataggtccgacatttttaataatttcaaacccttgagcctgcgctgccgcctgctcggtataacgaaaatcagtaataaaaaatgctttttccaaagtaataacagctaaacctgtcgtacctgtaaagttcgttaagtaacgaagattgtacggactggtaaccaaaaatgaatccaaattttcttcttgcatttttttgcgcaatttttctacacgtagcatcataatgaaactccctctttctttgcacgcttttttccattatagcaaacttttcttcgtacacgacagttaaataaaaatttccggaaaacttctttttattttaaataaataaagccaaaaaggagtcacagtctcgctgcaactccttttagtttactattttgtaaaaacttatgatcgttttccaaagaaaaatgagacaactgctaccaaaatcactgcgcctaaaatagatggaataagtgccatacctgcagcttttggtccccattcgccgaaaatcgcttgtccaatacttgaaccgactagtccagcaatgatattcgttacacagcccatcgaatttcctttactggtgatcgcacctgcaattgctccgatcacggctccaacaatcaatgtccataaccaactcataatataacctccttctttgctaatcaattttagcatatgggatttaaaggggacaaataattggttttgctatttcatattttcttctgcaaagtaaaaaaataaagaaaacctcctcttagaagttttctttattttttacttgcgtttaaacatactacgaataccacgtttcactacatcaaagaaactcaatgattgtaccattctatcttcatctacatattctctgatcgcacgaagcacttttttaggttctttggaagaaaatgtgtatgtaccattttttttcgtttgaatggcatatcgaggaatccattttccctttagcatgactgatgctagtacataatccacttcttcccatggaatttggatatatttgcgtctatctcgcgcatggtaaaactcaaaaccattatcacctatcatgatttgcccgtaatctgtcagacccgtaaacgaagtagcatcaattaccaagtctacttttgtattgattgattgaaccattttctccctccagatatttgtttatgaacagtatactatataaaaaaagctcgggacaacgcccgagctatatttttatggattataaaagtccgatgacgtgtccaacaacaccgactacgaataaaccaaggatgataacgattggagaaacctttttcttaagcaaccacatacataacaatgttaatcctaatgcagctaaaccaggaatcaattggtctaagttgtcttgtaatgttgttaccttttcaggagaaagggctaagccattattaacttgttcaaatgcactcttgattccttcaccacctgaaggcaatttatcccattcgatgtaagcacctttatctaattttacagttgatacaactggtaagaatttgattgatacccatctttgtacaagggcagctaatacgaacatccctaaaattgaagcaccttttgttacgtcttgtaacaatccgccagaaaggtcatcagtaattttagaaccagctttgtagccaaattcttgtgtataccacatgaatgcccaacgaataatgttccaacctaagaagaagatgattggtccaaggatatttcctcccatagctaatgaagcacctagtgcacctagcattggacgtactgtaaaccagaacactgggtcaccaacaccagctaaaggacccatcatacctactttaaccccttgaatcgctacatcatcaacaggcgcgccattcgcacgttcttcttccagagccaatgtaacccctaaaattggagaagcaatgtatgggtgtgtattaaagaattccaagtgacgttttaatgctgcagaacgttcttcttttgttttgtataattttttgattgctggaatcatagaaaatgcccagccaccgttttgcatacgttcgtagttccatgaaccttgaatgaaggtagagcgccacgcaacagctaaacgatctttttttgataatttgattttttcttctgccattttattttcctccttcaagattaatagtcattcaaaatgtcgcctaaagggtcaccagagttgcttccgcctccattatttgatgaaccacccattttagaaaggttcaagtaaataagagctaatgcaacacctaaagcacctagagcaatcaatgttaattgagaaattgcagctacaacgaaaccaataacgaagaatggccatacttcttttgtagccatcatgttgattaccaaagcgtaacctacagctacgaccattcccccaccgatagccataccatctgttaaccatgctggcattgattcaaggaatgattgcacagtttgtgctgggataaatagcaacgctgctgctgggaccgcgatacgaaccccttgtaaacatacagcaatgatgtgccacatttcaaccttacggatgtttccttcttcagcagccgcatccatcaaatgaacgattggaacagcgattgtacgtacgatcattgttaagaacaaccctgcaacagccaaaggaacggcaatcgcgatcgcagaaggaacacctttaacaccttgtccacctaaaactaaaataattgctgatgctactgatgctaatgcagcatctggtgctacagcggcaccgatatttgcccaacctaaagcgatcatctgaagcgtaccgccaagtacgataccagcttcgaggttaccggtaactaaaccgatcaatgtacatgccactagtggttgatgaaattgaaattcatcaagaataccttccataccagctagaaaggcaactaatacgactaaaattattgaaataatagacatgataagcctcctataaattttaatattatttattacgcttttgctaattcagcttttgcttttttcaaaatatcatccatgttatcgcgtgaatcattaggtactttacgtacatcgaatttcacacctttttgttcaagcttctcaaacgcttcaacgtcttcttgtcccatagacaatactttacttacaacgactttaccaaccgaatgcgccattgacccaacatttaattctttgatgtctacgccaccttcaacagctgtcaatacgtcttcaggattttcaaataaaagcaatgctttggtatttccaaaacgagggtcttttgctacttcgatcattttgctaataggaataacatttgcttttacacctggaggagcagcttgttcgattagtctcttacgcagatcatcctttgatactgcatctgaaacaacgataatacggtttggttgcactgcttttgtccaagctgtcgcaacttgtccatgtaacagacgtgagtcaacacgtgctaatacatatttgatttttccgtctccgaccacagttccttctggaagtgctcctttaggttgtgcgtcttcaactgctgctttcggtgcttctgccggttctaattcttccggttttacttttacaccgtcttttgctgtttcaatgatgtgtgctgcaatttcatgagcagattccattgaaaagcgtgatgcgtaggcttcaatcaacattggtaaattcaaaccgctgacgattgcccatttatctttgtgctcttcgaataatgtgtttgattgattgaacggtgttccgccccataaatcaactaagaataacacttcgtcttgattatcaaaagaagcaaccgcttcttccaatttggctctcaagtcatctggaccttcacttggtttcaaaatcacggctttgacgttttcttgttcgccaaagatcattgaaccggattgtaagattccttcagcaaattgtccatgacttgctaggataatccctaccatatttatacctcctatttacttttgttgtaacaaattcaaaaatattaataattgctaaccattacaacagaattatttgaccttttccaacaaccattcttgctacacctttttgattttcgctagtagttccatcaaaaggattttcctgtcagcaggtacttttcgaatctctaactccacttcttgactgttcaagtaacgaaaggaatcaatatcttgttgatttactgaaacaaaattggtaatcattgatttgccttcagtaaaactcataccgccgatattcaacgacttcaactgtacaccgcagcggacaaccgcttcaacatcttggggattggtgaataaaagcatcacttttgctcgtgataataatccactatgatagatttgaatcattttctgcacggttattacatttgctgtgatccccggcggtgcagcttcttttagtagaaactttctcaatttatcttgagcgactacatcgctgatcacaatgatacgttcaacacctgtttgcttcgaccaaactgttgcgacttgcccgtggattaaacgatcatctatacgtgccaatcgaatatccatctgcaaaactccttcttcctcactacttcacagaaacccctatcatttctgtgtgaacaaccacctcctagcacacactactataagcaaaaagcgtgccaacttttttacgatacactaattgaatttaaaggattcttaaccaatacacaaaaacgatacactataaaagtgtatcgtttttgtgtattcatggcacagtgtattcttttttatctaactgattatggactagacgtagcagataatacatttcttctatcggcacttttacttttatctgatcttccaacagaacaactgaggctgccaattggctataaagaggatcattcgttgtatttgtcaattcgttttcttccacagtcaatggttcattccgaataatacgttcgatcattcctgctgtgtgcatcactaggttgattttgaatccatattcttcatcgccgattcccgtcgtctgagagatttgtgtagaaaattgccacattggatcgattaacttactaccattaataaagatgaagttatcagagataaactcaacacacgtatttttagctgactcttcatctagggagatgaattcagtttcctccaattctgattccatcagcaactgatccaaaatgacttcgatattttgatcaataaaacgttctaaaggaataaatggggcttggatattcaaatcagtaatcccagtagtagctatgatctgatattctttttggataactggcagttcttctttcacttccacaatcgacaaagctagaacttctaattctgtttcttgacgcttgtttaccgctcgttcgatcaattctttgattctttgtgctgtaccttcgccagatgcgcagatagccaaaacagcttttttcttatgaataggttttgcttcctgaacagattctacagaagatatttctgcgtaacctcgaaaatttttcaatgattcatgcaacatatctagatctgtccctaatactgagacctttcgtacagtttccaaaactagagaagttgttaccatatcaacagtacgtactggaattccagtgtctctttgaatttgcgaattaaacgacgcaagggaccccatatctactaagagtatgaccccgcttccttcatctacttcttgtacattgcgttcaattcggtccaatgctgttttcggatccatatccaaaggcatgtctactgctcgtacgttctctgcatctaacaactgttggacaacctgaaccatactgcttgctgtactgtttccgtgagccgcaacgactacaccgattctgccgcttgcttggttcgcccgtaacgagacgagtagaacagtcaagtagtagtcttcactttctggaatatccacttgaaaatacgtttctatataactacgcacttctttcgcaacagcatattcatctggaaaatcaaatgccatctcacggatattatcattcgtatgccgttcttctcctaaattgatttttttcaaaaacgaactgatatgcaagctcatagcataaataaagttttgctgaaactcatatggtaaagatcttttgaccattacataaatctgattggtcacttctatgatttttggatctacaaattctgctaatttgctatctgcattaaaagaaaacccatggtctttataaaaagacttcagatggatattgatatctgtagaaataaagtgattgattgcttcttggtccaacccatccgacttcagcaaagctgctttatctccgatgatatcatatagattataaggtaattcataggagtctgattggattttcatgatcgtatcgtttggtgctacagttatctttggctccaatattttagaaagctctgccattgcactgcggttgcttgctaattgaatcaatccgctacgaatcccttctgtcaaatcatcaatcgtaatcgatatttcgggagattgcatatgatttagaaatcctcgtgcgcatactaactggatattcgacttcaattgacctatattcccataggtcacactgccgatcaatgcttttgctacatcttctgtcaaagaaatctttcgctgcgtgcggtttgcttcgtgggcaatcatgatttttactaaatcgactttctcatttgcaggacgtttttcaaaagccggaagtttgatattgattgggatacgccgaacaaaagtttctaatagagaagaacctgggtcttctgtggtcgcacctacgatccgtacatttgcttcatgggatttcgttgtttccccaagacgactgtaagttccatgatccataaagtaaaagatcatttcttgaccttcaggcggcaaccggtgaatctcatccaaaaacagcataccgccatccgcttgatcgataatccccattttttcttcatctgcgcctgtaaaagcaccttttgcgtacccaaataaatgactcatcaaaagctcagggttattggcataatcagcacaattgaaaacaatcagttccgtttcctcatctattacatgatgcgcttttgcaaaatgatacatcgcgtgtgcaaaataagtctttcctgatccggtaggtcctgtaatcaaacaatttaatcctcttggcggatacaaaatcgcagcttttgcctgttccactgaatttttcatgctgccgttagctccaatgatttttgcaaagatatccttagtatctatttggagtgtatttttttcttcagagaccggcgtttctttgtaactgactacatgttttgtaactggctttacgtgcgtaacgagtgtttgatatatgtaacgtactggtcgtccgtctgtctttatcagttttccttcgcgcactagctgattcagatctttactgctatttgttcgctgaatccctaacacttcagcaatttcctgtgttgttactccttgatcatattctgcctttgttaaatgagcggttttttctttgacatacatataaattcggtcaatgcgttttgccaatggtatcgctccttttctatagactgttgtacttaggcttcaaaacataatactatgtatttatttctgtttcgtcaactatttacctgattttgttttgttgataacacgcggatagatagaaatgttcaatttaaaagaacgaaaaatcccgatacgatttttataatggaaacaagaaaaagaacactgttgaccatatatttatttcactgatagcaaacaatatagcttccatcaattgaaaacgatagttatcaaaacatcctgattacaagatggcaaaaaaatattaagtgtaaaaagacaaagtaaacttcgtagcctccactacaacttttatttttataaacaaaaaaaggctgtgacaaaagtcttgtcacaacctctttaatcacaagattcaattaagcttcttgagctactggataaacagacacttgttttttgttacggcctttacgttcgaaacgtactacgccatcaacttttgcaaataaagtgtcgtctccaccgatacccacgtttacacctggatagatttttgtaccgcgttgacggtaaagaattgatccacctgtaactgtttgtccatcagcacgtttagcacctagacgttttgattctgagtcacggccgttagatgtagaaccgccaccttttttgtgggcaaataattgtagattcatagataacaacatggtctgcacctcctatttatcattaattgttttaatttggatatattctgagttttcagcttctatcgattgtaatcctaataaaagattttctaatagaatctcagcaatattgttttgttcttgtgtcattcctgaagtgacttcggtataaagataaccgccttcttcttcattcatttcaacaatcggctcaaaaccggctaatgaggcaatcccgttgacagtgctgatcgctaacgcagaaacacccgcacaaacgatatcacttccataaggaccagcatcagcatgcccggtcaaagtgaatgaaacgatctgacctgcgtcatttcgcttaaatgttcctttgatcatatataggccttctttctcaaacgctattaagcgttgatcgcgtcgataaccacttttgtatatggttgacgatgaccttgtttacggtgtgaatgttttttaggtttgtatttgaaagtaacgactttcttttgtttgccgtgtttttcaacagtaccttcaacagttgcacctgcaacagttggagcgcctacttttgtagattcgccgcctactaagataacttcgtcaaaaacaactttttctcctgcttcaacgtcaagtttttcaacatagattgcttgtcccacttcaacttttacttgtttaccaccagttttaataattgcgtacatgctataaagcacctccttctgatatacttagactcgccatccgaagtgacagcatatgctgtgcttattacttgttctgagcggttgtagctgtggagtccacaattacaacagtactagcttaccagaacagcaatcgttagtcaactaaatttaaaatcaaaaagtaaaacaaaaattcaagcaatacttctgcttttctgtcctctcagttctaccaaataaaatagtcgcattgtgtttcttttattcttataataaaagaaaaaggaggagcataaatggaatacccaaaagaactgatacaagaagcttctttaagaatgaacggccgtcctgtagaaggatttatcgctgggcaaggacctcttcatcctaaactgatgctcgtgggagaagccccagggaaaacagagattgatacgcatgttccttttagcggtcaagctggaaaagaattgatgcaggcactttcttcaactggcttaacacgagaagaggtgtatatcaccagtgctgtaaggagccgcccgtatcgcgtgactcatcggatcaataaacggacacaacagtcagaaactgtttatccaaatcggacacctactcgttccgaagtatttgcgcatgcaccaatattggattacgaactgatgaaggtccagccaaaattaattgcgacacttggaaacattggtcttcaacgtttacttggcaaagaatatacggttaccaaaaatcatggtcaactctatacagggcctgtcttacaattaacagaacaaaaggatgcctacgaatggtcagaaaaaaactatcgaattcttccactttttcatccagcagctattttctacaatcgctcccttgtacctgttatccatcaagactggcaagtactagcttcacttttacagcaagattaaaaagaacagacaagaccataaaatcttcagtttacagtcttgtctgttctttttcattgttttaatggctaattgcagtatatttcgcatgtaaagctgtcaacgcatgagcaactgtttgatgttgatgcgtgaatgtatgttcccacaagtgagaaagttgtttttctacttctggctgcaaggaagtatagataatcgtttgtcctctttgctctgctttttcttgaaattcatcaaaaactgcacgtgccgtcaaatcaatacttggtacgcctcgcatggagaaaatgacaccatcgtgatgatttagttcttccaatttatttttgagtttttctgaagacataaaaaacagtggaccactaatatacactactgtccagttattcagcttttccgtttctggcagccccattctttgccaatcgatcgtttctaatgaaatcgtgatagcagcgcttttgacaacaaaaaatacacagccgccgatcaccccgatcacgatagcaatacttaaatcaaagataactgtacaaatcatcgtaaggataaacaatagaactgctgaccaatatttattagtaaatagctccttgatcgtttcccattcattcatacgccaagccgtcacgatcaaaacacctgcaagtgctggcattggaatctgtgacatcactggcgcaaaaacaagcatggagagcagtaagacaactgcatgtatcataccagctaatctagtttgtgcaccagatttgatggccacgcttgtacgggcgatggccgcagtagcaggaatcccgccaaagaaaggaagcaacagatttccaattccttgcgccattaattcttgattgctatctaagggcttatttgccattcggccagccgaagcaccacatagcaagctttcaatcattcctaataaagcaatgctaatagctggaactgccacttgttgcaaggcagaaaagctaaaatctcccatattcaaacgattactactgatcaatgtttgtggaatcttacccacagttgctactggtaaatggaacaatagcataactgctgttgccaaaatgatagacagcagcgaactaggcattcgtttcgcccatttttttggatagataaacatccctaaaatgactagccctcccatgatcaaagaggctgtgtttatcggaaatcctatcgtttgataactacttagtttttcaataacgtttgtaccttccgagtgaacaccaaataaattatcgatctgacctaatgcaataatgatagcaatacctgaagtaaaccccgtaattacgggtgctgggataaaagaagtcagtgttcctaatcggaaaagtcctgctgcaagtaaaaatagacccgctaaaaaagtagcaagcaatacaccttgcattccctttgttgccgcaatagacatcaagatagctgccatcgcacctgtcggacctgatatttgataaaaaccgcctgataaaccgccaatgacgataccggcaatgatagccgtaatcaaacctgcggccgcatcagctccgcttgacaccccaaaagccaaggctaaaggcaatgctacagcagctactgtgatcccagccaaaagatctttctgaaatcttgaaagatcataacctgaaaattctttttttagtgaggaaacataatttttgaacacctatctaactcctttttcatgaaattttctaaaataccattcattagaatatcatatttcatgagataaagtaatatttttcacaaagtttcctgttagataaattcttattttttctatatttataagaaaatagaaagcaatgccaacagagctagcccaccttgtttgagtaaaatccaacgatcgctagtcaaactgccatataatgcaacaaaaaaaatagatattaatagcatacttgtgatttctttagatgcggaagaaagataagctccataaagtagtcccactcctaatagtccattgtacactccttggttcttaaacaatgtttgaacagattttctgcttaactcttctttactcattttaaaaaccctacttgtcgtgtcagaatcagttctcaccgtttcgatatacatgatataaaaaaattcaattgcaactagagtcactaaaattttcgatagtatcgtcatatcttcttcctcttttctgatgagttttatttttttgctccttataattgtactcgataaggatgtttttttattttatttgcctttgaaaacaaacaatattggcacaaaaaacaaagaaaaaccgttagaaacctcagtttctaacggttttttagcgtcacaggagggattcgaacccccgaccgtccgcttagaaggcggatgctctatccagctgagctactatgacaagaatcagcggaacattaataattatagataattaaattgcttctgtcaatacgaaatagttatttaattagcaaataatgaattattttggcccaactactaaatcaatcttttaaaacgagacattctccttcagctgttctaaggttatcaatggaaaacaggagctacattgacttcatgctactcctgtttatttagattttctgtatcctttaattgacttacaaatatagaaacttttacatcaagttcaaattgagccctcgattcaatcgattatctacaggctgccataatcatgtatcacaactcgattgtttctgattcctttgtcattaagatcacaccatcacctaatggcaagattgtcgatgtcaaatcgggatgatccatcacaacacgaagaaattcatttaatttacgatggatagctcgtttgccacggggaatctcttcatctgggagcaagatcgttcctccttggaagatgtcatctaccatcaaaacgccaccttttcttaacaaacgtaagcattcaggtaaaaattcaatatattttgattttgcactatccataaaaataaagtcatacggaccagacaactccggcaagatatctgctgcttgaccttcaagcaaagtcactttatctgtcagtcctagacgttcatagttttttttagctttctcgatcatgacatcgaaacgatcaattgtcgtaacatgagcgttttctccgattgtcgtggccatgacacttgatgaaaaaccgatagctgctccgatctccaagattcgttcaggctgaagctgtccaagtaaaaatttcaaaaatacaactgtttcatggggaataactggtacttctgctacatgagcttcttcttccagtttgcctagctcacccggtaattttttttgctgggtacgcataaaatccaatagttcttctttgactacaggacgatgcatcatttcattgcgcatactactcctcctcttcacacattatacgaacaactgactaaatctacaagctgcatgagtgttttctcgtgtttcatgttcagaagagtcgttggatctctggaatacatttatgtttttaacattcttacaaaaatttctgtgttcgtctccgcttctttttcaactctacgaaggtattccatgctgtgattcctgttaggcaaaaagcaatcgtaaagaataacccctgaatccatgcaaatgccgtttttgaaaggactagtccaatatatggaatctgaaagatgggactaccgataatatttctcttttttactactccaggctcaatataagtctttgtatcagcttttgtataaaaatcttcgtggttgttttcaacggctattacgcgacgcgtcgagattttttttcctgaattttcataatatgtaataatatctccgactaaaatctcatttgtatttttcggtcgtacatatatcagatttccttgtgcataatatggactcatttctttgtcctcaataatataaggagtcaaaccaaaaattcggggaaccaagacgacgagaagaataagaattaaaaatataatcaacgttatagaacttataaaagttatttttttgtaatcaggcatcgttttcaacttctttctttattcaatccttcttaatcatataataacgataaatttttttcaaattatagctgtaaaaatgtttccctttaataattacatgtttctaattctatttcctcatctttatctcattttttattataaataattgacgttagtttaaaaaacgtttaccctaacattacaagttttagaaaggaatacctttatggctttttttaataacatatataataaaaaagaatctttttatttacgtataaagtggagcacaatcattatattatcattgttatttttaacaggaattgcttatttcttttattttatttttctcctgcggacagcaatcaaatgaaagaaataaaagattcgtgggttttctatacaaaagatgatcctgattttaagtttgacagcaagtacactcgtacgattcctaccgtggataaagacgaaacattcattatggaaacgacacttgaaaaaccgttggacgaagcaaatttactaatcaaaggaaaccatcaatggattactgtatatctaggcgaaaagattttataccaacggaaagattatcaggaagaaagcaatcccggactctcattggctgtgatagatttaccagcaaattatatcggaaaaaaattgacccttacagtctcatctccttatcagaactatgctggactgccaccgaaagtttatctaggaacaactggaccattgattagttttatttattcacaatcagtgccgcaagtattgacgatgataatcgctgtttttatcgctatagggacctttttctatacgatctacttgatgtataaacaaaaacgtcttgaatactcacttattctcttaagttgctttgctttggcattaggatttgaagctgtatcagaagatattttaagtggtattctttttgaaccattcgttcattcttttttatctcatttatttattatcttaacgtcagctttcatcatctgctactattggagccgaatgttttactataaaaaatggtacggaattttttgtacgttccaacttttgatttttatcggcgttctgctttatgcaacttttactcctgcagaacttcctgaattaatgccgattgctaatattgctagtgttataagcactttagtcacttcacttgcatgcattggcgaagcatataagaataaccgtttttatgtagcttgtacaccttggatcgtcttggtagccattatccattgcttgatttacatccaaacggcattaggtatctatcaaacaacgatcaattggtctacgattttatatattatcattctaatcgttattatcagctacaatctaatcgatcacatcttaaataccgacaaagatcggagacaagtagatttcttaaaaatcaaaaatgatttgttggagcaacattatgagcagcttcgacagcatatccaagaagtaaatacacttcgcctggaatttgtccaagagatggagaatctgcaagatttaatgcatacggaccaaacaaaagctaaaaactatgtggaaaagatattagaagaagcaaaaaatttcgaaatgctgtgttctttttgcaaccaccaggtgacaaatcttatcttagcgcgttaccagaagttagctgccaaacggaatattcagataaccttccaagcagatcttcccgaagaacttcctatcaacgatgacgatctggctcaacttttgatccacgctttagagcattcctttagagaaactcatgccatcgaaaatccactgtatcgaaaaatttatttgtcgatacacgaacaagaggaacatttcgtcatttgttgcgaacatagtgcacattacgatacaaacctatttagtcgaggcatcacagaagaattagatgatcaggaacgttttgacttaatgatgatgaaagacgtagcggatcgttacacaggaacactaacgcaggaaaaagatacttttattgatcggatcactgttcaactctctcgaaattacccgaatcctgtataaaaaatagcggaatccatatatgtggattccgctattttttattttcaataaagtaaggtaagcaattcttctggttctatcgcaccaaaatatttcttcacatcaatttggctgactatttttgatagagatgctttatcatatttctgtccaaccaattttttttccacgtcagagatatctcctagtccgaagaaatcgccaaagatttttgcttctttgatcattccttctgagacattcaaatggacttcaatcgaaccgatagaaaaacgtttttggcgagagaaattgaaatctggagacttcccgtaattccaatcccaatttcgataatattcctcagagattcgattgatttttttccaatcttcatcagtcaattcgtacgtttttacttcttctactgactctacgccgaaaattttcaacaagatttcttgacgaaattcttctgttgtcattttttgcttttcttctggaagaaatggtttgatattcgttacacgagaacggatcgatttgattccttttgattcgattttgtctttttttacttttaatgcattgactacttcattgatatcagagtcgaacataattgttccatgagcaaacatccgaccgttggtagcatacatcgcgttgccagaaaatttcatgccatcaatgactagatcatttcggcctttcaattccgccccagcaacacccaattcatgaagtgcttggatgattggctgtgttactttcgcaaagtcacggaatgaatccccatcatcaggcatgataaaactaaagttcaggtttccaaaatcatggtagacagctccgcctccacttaagcgacggacaacatgaatgccattttcttccacataatctcgattgatttcttcaagcgtattttggtttctgccgatgatgattgaaggttcattgatataaaagagcaaaataggttcatctaaaggcatttcttgcagcaaatattgttcaattgctaaattgattcttgggtcgtggttttcatttggtacaaaaatcatgttcttcctcctaaatgttaaacactttgtcaactgcagcaagttctacatcaatccctttgcctgctgccttttgcgcttcatttttcaattgttctaaatcaccaaactgaggtaggtgtgtaagtacaagtttctttacgttagctgatttcgcaagttctccagcttcttttgaagtgaaatgggcatgatgatgttcatttccttcaaaaagataggtatctgctagaaacaaatcagcatctttcgcaaaatcagcgaaactttccaaataacctgaatcacctgtaaatacgaatactttccccgttgtttcttctacgatacgcatggcgtaacatactactggatggattgtttccataaaagtaatcagaaaaggaccaatttttaattcttcagcttcaaaataaggatgtccttttgagacattttccatcgtcaattcttcaaagtgaatggaatcttttgtgtgtccataaattgaaagcaatgtctccggatttctcttaggatgaagttgccagtaatactgtaatacaccaaggtcagcaatatgatcatgatgataatggctaaggatcacagcatctagatcaagtggatcaaggtgttcttgtaatttgatcagcgtagcactacctgcatcgatcaacaaattgaactcgtcagattgaagcaaataacctgttgtcccttgatttttataaggatacgctcctaagcatcctaaaacagttaatttcatcgtacattccccctcaaagatttatcctaccacaaaagttatttttttgatgaataaactgcttacatgctaagtaaaataggcgtctggacctcctttttcaatccgtgcttgttcataaaattctgcaactgacacattcacataaacaatgacccacaaaagaccgatgaacaaagcgattgctcctagcaaataccagccgataaaagacagctgcaacaaaatatacgtaccaattctatcttttaataaaaaccagccatatttcaaacattgaataaccgacaaatcaggatagtcgaactttgtccatgcagcaaattggaataaaccgccaacaatactcatgatgagtgctgaaacaaaaatcatccctatcatcgataaaacaaagctgatatcaagaaaatcttctggcatgacacccgtaggtaccgcatttgaactgaaaagcagctgcatataagtactcactccgctgattaaaaacatgggcagaaagattaaactgttgagtagccagttgatgactgaattgatcaaattgatgccaagtatcgaaccaaaatactttctttggaaaactgaaaataaaaggttactttttggtctgccaccccgtacaactactagcgcaatgtaaaacaatgcatagttgaatgcgaataaaagtaaattatcgactagaaaactcaataagtgctgctgcatgctttcttccggaaaaggactgaaaccgtcaaaaaagttctggatgacgctcgtaaatattatagataagaaaacaagccaagtattgattccccattgattttccaaagaaactcgtgcttttttccgatattcagaaataggtattctattattcattattcataactccgaattttttcaactgtttcactatcaagccgtttcactaattctgtgactagtttcactgtattcaaataatcatcttcatgaatcactgatgtatgggaatgcagataacgaacaggaacggtaatggctacagacggaacaccatctcttgtcaaatgcatttgtcctgcatcagttcctccgccagaaatcactgtatattggaatggaatatccatttcctctgctacatcaataacaaaattcaataattttttatgcgggatcatagatgcatcaaaaatcaaaatctgtgggccttttcctaaaatcgaatctgcttcttttggtgtcattcctggagtgtctcctgctgtaccagtatctaaagcaaaagcaatatcgggatttacaaggtgtgtacttgttcgagcacctcgcaagcctacttcttcttgcacatcgcttcctgcgaataaaacatttgggtgtgcttctttagatagattctctaatactcgcagagaaacagctgtcccgatacgattatcccatgcttttgccagtaaatatttactgccattcattcgtttgtattcaatatatggagtgaccatatctccaggacgtatgccccactctttggcttcttcttggcttgatgcgccaatatcaatgaacatatcctttatttcataaggtttatttcttacttgaggtgttaaaacatgtggtggtttggaaccaatcacaccgtggacgattttcccttcacgtgttttgatttcaacttgctgagcaagcatgacttgcccccaccaacctccaagagtttggaattccaagaatcctttttcggttatttttgttaccataaaaccaacttcgtccatatgtccagaaataaagaccttggggcctccgccagcaccatgtttggcaatcacactgcctaaaccgtcataaaaaatatcatcagcgaatggtttggcatattctctgaatacttctcttacctcttcttcatttccaggtactccttttgcagaagttaaatcaataagtagctgttcttcttttgtatccaaatgttttcccccatttctatattcatattgtgattataccattgcttatgatttttgttcaggcaaacttggtatttttatcttttattcagaatattcaaaaataaagaaaacaagcgagcaacactcgcctgttttctttattttaattgtagtttatctggtatttgatgttgccaagatttgctaaaaaaagcatcgtcaagatgatacttactagcagtaatatgattttcttctaaaaacggtctgatctgttgatctgcagccaaccagcctttccagcctagatggatcgtgtcttccataaaatagttggtacccgcttgattgacaaaatcagctattcgattgaatccttggctatttaattgaaatttgatctttttggcaaatccttgtaacatttcttgagatagtccggtataatcgctccatttctcgttaaccggtgggatgatgaacaatacttcgttatggttttttgctaattgatccaagaccagctgaaaatcagaaaattctggcgaaaaacgataatcccaatttttttgtgactgtttgagctctggctcgtgggctcggatacgatgcgtataaaaatcgtttttcaacccgaatggattattcgtcgtttctcgttctccaatttgatttgctaaaatggataattctgtttcttggtattgttttggtaatcgttttgactcatgatcgattttttgctgtcgatctttcaacccaatattgctgaatacttcatcctctctcttcagcatgttccattggctgcgcagctgattcaaagattcaggtaaaggtagcttcccttttttgatcgtttgcagaatcgccgtcaacgtatcattctcttttacttttgagaaagttaataatcttctagctaaatagcgatcagcaggcgttactttcttcattgaaaacaaccagtcgtatgtttgaagttcagaataatacgtattaaagtaatcagtttttacaccatttttaacgaaccactgaggagaaataataaagacgactttcttgtttttcatagcatctcctgcagaacgcatcatcatatattggcttaacgattgtgtcccgggtgctcccagcaaaaatggacgatagtttcgctggtatttttctgccagaacagacggatgaaatggactgattctgcttaattcacttgagccaaaaaaaggaatatattgtttttcagataatgcataattttttatcgcatctcctttcaacacgttcactgacatggaagaagaggcacgtctaatcgtttctggattagagatatctacttgataggaggaggtaaaaaacacaaacagtaagccaacagctaaaacaaccgggccgaaaatagcaaaaagtttctttttcatactcaacccttcaatgcagttgcttgttgaatgattttattcggtgtgctccaatcctctcgctcgaattcagatacagggacttggatatccagctctccgtctagctcgactaataattgcacagatgctaaagaatcaagcaacccttcatcaaatagatcaatatcacgattttttcttacttcatctgttcctgttatttcttctaagattgataaaatttgttcttccattttccttttctcctttgttatataaattaatatgtcactattcgttagctaaaaaaaagtttatctaaaaatcctgaaaaaatcaggaagctaaaacatactgcttgaaatgtcaaaaatacggctaagccatgcgtaaatttgttagaaggcaactgctctttatgcttcttcttaaatcggatccatgcatctgtcagacagatcagacaagcatgatacagtccatatacgatgtagtaccacgtcaatccatgccatatacccattagaagaaacaaagcaaaataaccgatatttgacattacgatcttgcttttaaaaaattttttcttcatcatgaagaacatcaatcgcatatatacataatcacggaaccaaaaggacagcgtcatatgccaacgattccagaattctttgatattccatgataaaaaaggtttattgaaattgattggtgtctgataccccatcatgtagcttgtaccgactgcaaataagctatagccagcaaaatcaaaaaacaaatacatactgtacacgtacatataacctactaatgcccatgaaataccaccatgctgtaaggcaatgcgtcccactacaggaagcagtacttgaccaaaataataaccgataatgaatttatataaaaaaccgacaaaaatattttggacgccttttcccaaaagatcaacatatttatcacgaacaggcggatggagctgatctttttcaaatctcctatagcgatcgattggtccagaagagattgttggaaagaacagcagaaactggatataacgaaatggcttatatgttttgatcatgccatctcttatttccatgatcatttgtacagatttaaaggttaaataagagattcctaaaaaaccaagtaacgatgcttttccatgttcaaaaaaaggagtcactttcgttaaaaacagtggaattatcgctaaaataacggcggcaaaaaaccatcctgtctgatttttcctttgccgataaacaaaatagccccatacaagtatcgtctgccacaaaacatacccaatcagcgccgctccctgttgccaataattacctccaaagctgacaaataaaaagaaaagtgtcactgctgattgataaactggtaatcttttttcccatatcaataaagatagaacgatcggtacaagcgcaatggctaaaagaaaaaaataaaacggctctgcataagggatcatatgaggtaacatcattcaggattcacctcagctgttaatttttttcgattgatttttccattaactgtctgaggcagcagatcgacataatggaacttctgaggaatcatataatccatcacaacttctagtaattgttctttgatagatttagtcaactgaaaatccggctgtttcgttttgttttctaatacgacaaaagcaaccagctgctgtacttttgttccttggtattttggtacgacgacagcttgtttgattcggttgtcttggagcagataatgttcgatatccccgagttcaatccggtatccatgtaatttgacctgctgatccatacgtccttcataaaataaaagcccatcttcatctagtctacctgcatcccctgtatggtaacttgctaagtcattttgacaaaagaacgcagcagctgtcttttcgggattgttcaggtaaccttttgatacgcttggtcctgcaataatgatttcacccgtttctccttttgaaacaggtttgccttcttggacaatagaaactttcgtgtctttttttacgtagccaatcggtagtcggtcataactatctagtacatgctggtcaatctgaatacttgaaatagctacagttgcttctgttggaccgtaagtattatatatccgtgcatttgggaatcgatcaagtagactttctgcagtttttttcgtcaattcttctccgcaaaataaaaacatgtccaattccggcacattttctccattgaatgtaggttccatcaagcaaatatccataaatgatggagtagaaacccatacattcaacttcaaggctggcaatgtcgcgaataattgacgaaagtcttgaacaactgctttatttaacggcttcagcattccgccagaaactaatgcaggataaatagaaaataccgataaatcaaaagaaaatggcgcttgggctaagaaatgcataccaggcttgatcccaaagtcttccatcgtccattgaacaaagctgactagattatcatgactgatttgtacgccttttggttctccagtagtaccagaagtaaaaataatataaaaattttctgtaccttttacgctatttctgggataaaatcctactggtatcttcttgatttcttgaaattctttttttgttatgacaggaaccgaaggaatatcttctatccagtccccgatactgataaccatagatggtttagccacccgaaagatcgacaggatacgctccttgggtgtatgctcttcaatcggcaaataggcatggccagatttgacaacccctagaaatgagacaatcatttcaaactccaaattgccaaaaacgacaattggtccatcaccttctacctttttttctaaataataagcaagtgcgtctgatgcttgtttcaattcaccaaaagtatgcgtctcatccgcctgataagcaactcgatcaggttcatttattccccaatcatcgattgcttcaataatcgttttgatttccatactcttcctcctaaaattcgttatagataaaagttcctccttgaatatttttatagtgatacagataaatcaggaacagcagtactgcactataaaaaattgttcgaatgatgaattttccccaataattcaattttggattagaacgccatttgttcattggattccctcctcatataacctcacacaaagtgtaactaattttgacaaaaagaaacatgtgtctagcttacagaaaccgtttttttactaacagttttgtcacatagcttttataaaaatagcacatcaaatcactgcttttttctttataatttctcgtacttttaaaaaataataaaaaaagaacggggagaaaaaaatgaataaaaaaatgattgtcacgggaatgagtgtactgttactcgttactgcgggaatagggattttcgggaacggaaaactagtcaaagccgaagaagtcgcacaaaaaccaagtgaagtgacgattacattacacaaaaaaggtttctcatctgttccggaagaacgaccgaatagcggattggtttctacggattttggtgaagaaaatattccaggagtcgattttgatttgtttgacgtaacggaagtatattacgatttgattcgagataatcctttaacaccggaacgagaagacggtcttaattctgccgaagcgattgaatggattcaaaaacggcacacagaaagttggtttttaaaatatcgactgacaagtattgacaaacaaacaacgaatgaagctggagaagcggtattttctaccgtccaagtgacggaagaagcaccttcttctagagataaagtctatcttttcttagaaacttattcgccagctcatatttccagaatcgcgtctccaatggttgttatgatgccagtgatgatgcctgatatggtggatggtgtgtgggatggttctacatggaaagacacatacaatacagatgtgcatttgtatccgaaaaacgaaatcagagaagcagataaacagatgaatgtagaggaaagcgaccttagacaagtaacgattattaatgaagctggagaacaagaaacgatttcttatattgatctagaaagaggaaaaacggcttcttacacgatcacagcacctattccttatttcatcgattctgtccttgaaaacggaagcgctgttatcaaaaattacaaaatcacagatacgcctacagttggtctaacttattatgatcaggaaatagaagtgcgagccggcgagacgattttaacaaaaggacaagattatatagtagaagtagtaaacaacgggtttgtcgtgacgattttgacagaagaaaatggagtagccaaagtagatactttaggtagattagcagatgcacgtggaggagatttaacgatcacgtataatttgaaggtttcaacagaactagaagcggatgatttccataacaacacagcggttattgaaatcggacgaaatgatgaatttgattatgaagaaggagtagagccgccagagaaagtcacaacaggtggaagaaagtttgaaaaatatgatgcatcaagcagtgaattgcttaaagatgcaagattcgaattgtggaatgaagaccgttctgaatacgcaatattttataaaggggagtcgcctttagctgtttatgaatcaggagcagatagaattgagtgggcaacaagcggacaagcaacagaatttgtcgcagatggaaatggatactttgaggttcaagggttagattatggaacctatcaaatgaaagagaccatggcgccagaaggttatgtacttccaacaggtgaggcagcctttactgaatttatcatctcttatggaagctataatgaagaaattcagatcgtaggagtagaaaatccagggccagaaagagtaccgaatatgaaacgcgggtcacttcctgctactggtgggaacgggctcttggcattcttactaatcggaataagtttgatgattggagcgtacagctggtaccgtaaatctaaaatgaagtctgaagtataagcaacaaaaataagctgcagcaatcggttttataaaggttgctgcagtttttttaaataagaaggtgaagaaaatgaaaaagaaaacaggtaatagacctcaaaaccaaatcagtcttttattacaattatttatggcagtgatgtttcttgccggagctgcagtttttacatatccatttttagcagatgctctcagcaattatttggatcaaagaaggatcgagaattatcaaaagcagcttgaacgcgataaagaagaaaaacatgagcaacaattagcagtgcatgaaaagaaaaatcagacgcttgctcatacatcagtaatcccaggaatgggacgagtcaaagatccttttgagcaagcggttagaaatgtccaaaatccaggaaaagaatattacgaacaacatatgatcggagccatctatattccgaaaatcaatgttagcttgcctttatttgatgaaacgaatgatcttttgttagatagaggagcgacagtcctgcaaggcacctcttttccaactggaggagagagtacacattccgtgattaccgcccatagcggtattgctgagaaaaaactctttacggatcttgaagaaatggagcaagatgaccgattctatcttgaagtgtatggtcggatgctcgcttatgaagtcgttgagaaaattgttgtccttccaacaaaaacaaatacattagcaatcagagaaaagcaggatctagtcacacttatcacttgtacaccttacaccgtgaacactcaccgattactagtgacaggaaggcgagttccctttacagaagaagtctcttcaaagatagaacagacaaaaaaataccatctttatcgattacttatactccttctaggtatattgctagtgctaacgcttttcggttattggtgttattggaaatttaaaagacaaaaataactaaggaaaaataacagatcatagaccaattgttaagaataacataataaatttaagctgtattgaaaagacaaaagcgattaaatcgcatatttccagttttttttaaacgtttgctaaaatgacattttccaggtaagccaacttgtttcacaagggcttctttgatattgtagtagcaagaagaaagatggagggattttttatggcaaaaatcatggtagtcgaagacgaagagatcattcgacaattgatcatggaggaacttgagaaatggcaatttgaaacctttggaacgaccgatttcaatcaagtgttctcagactttgaaagagaagaaccacagcttgtattactagatattaatcttcccgttttggatggctattattggtgtcaaaaaatacgtgaagtatcgaaagtaccgatcatttttatctccagcaggaatacgaatatggatatgatcatggctatgaacatgggggcagatgattttgtgacaaaacctttccaaatcgatatactgattgcaaaaatcaatgcattacttcgccgttcttacaactacacagaattatctagtgaaatgatgagccacaatggcattacgttgaatgttgacaacggaagtatggaaatcaacggagagatcattgatttgagcaaaaatgaatatcgtctattatttattttgatgaagcacaatggaaagatcttaagtcgggaaaaattgctgcgagcactgtgggatgacgaacgatttgtagatgacaatacattgacagtcaacatcaatcggttacgccgaaaaatcgaacaggcaggtatccaaggatatatcgaaacaaaagtaggacagggatatatcgttccctgaaaggatgagcggttaagatgaatttttttaaatatttgaaagatcagtggacattgatcttgggatggctgttttttattgcattgacgatctttgtgatgtggctggcgccaaacatcaaagtggatttgagcacaattgcttatttagctttgattgagggcgtctttctgattttttatctgctgggtggttacttgagcaagagaagatggtggggaaaattagccgacatacaaaaaacttcccctttgcaaaactatttgagcggtggacgaacagaagaagaaaaactggtagaagaatatatcaatcagctgatccgtgaacaccaagaagtaatgcaatcagcaatcagtaatcaacaagaccaaaaagattatattgactcatgggtccatgaaatcaaagtgccactttccgcttctaaattgctagttcgttcgatcgagttcgatattgacgatcaaaagtatacattactagaaaatgaattatcaaaaatcgatgaatacgtagaacaagttttgtattatgcaagactcgacagtttctcgcgggactacctcatccaagaatatggactaaaaggaatcattcagcctgtgatacgcagtcaggcaaattattttatccaaaaaaatattcgctacgagattgttggtgaggatcatactgttttgaccgatgctaaatggatcgcttttatcttcaaccaattgcttagtaatgccatcaaatatacgccggatcacggaaacatcattgtgagcatagaaaaggaagcacaaggagtcagcctttcagttaaagattcagggatcggtatcccagcggaagacttgaaacggatctttgataagggatttactgggagaaatggtcgacttagcaaaacacattcaacaggattaggactttatttagcaaaaaatctggccgaaaaattaggtatccatttgacggctgaatcaactgaaggaaaagggacaacaatgactttatttttcccaatcttaaatttttataatgaaaaacgttagaaaatcgttagaaacgaaaaaaagtgcttgtgttgttaacgttttcgctgataagtttcttatcatgtgaaataaaaggagattggttatggaaattttaatagcattagtccctatgttggcatggggtagtattggtttagtaagtggtaaaattggtggcgatgccaatcaacaaacactaggaatgacgatcggtgcatttctgttttctttagttgtctttttcgttgttagtcctgtaatcaccccttggattttcttgatcggatttttatccggcttagcttggagtgttggacaaaatggacagttccatggaatgaagtacatgggtgtttctgtagggttaccattgtctactggttttcaattaattttgaatacgattgcgggagccgttttcttccatgaatggacacaaacgaaagattatgtatacggtattattgctttagctcttcttgtaagcggtgcgtatttgactgcccgacaagatgacgaaggaaaaatagatacagataataaaatgcttgattttggtaagggttttagagcattgatcttctctacgattggttatggtgtatatactatcatcgtcaactgggcgaatttggatgcgatgtcaattatcttacctcaaagtatcggaatgatcttaggcgcaagcttctttgctttccgtaaagttaaagtcgatcagtttgtgtggaaaaacatgatctgtggattattatggggcttaggaaacatctgcatgcttctaacagtcaaatcacttggtttagctgttggcttctcactttcacaaatggggatcattatctctactttaggtgggattttcatccttggcgaaagaaaaacgaaaaaagagctcatttatgttattgttggttgccttttagtcattttaggtggtatccttttagggtatatgaaaacagtttaatcgctgttttccaacctaaaatggggaggaacttcaatggatttgtttcgtaagaaagagatcaatctcaatcatacgagtgagatgaaaaaagaactaaaaacgtctgatttgatcatgcttggaattggtgcgatcatcggtacgggaatatttgtggtgacaggggttgcggccaatcaaaatgctggtccagcactgtcactttcatttgtcttagctgcaatcgttgtcattttgtctggactaagtttcgcagaatttgcttcgcgagtgccagtgattggtgggccatatgcctatctgtatgttgtatttggtgaatttgctgcctggctgacagggtggttgttgatcggggaatttttactagcagtttcctctgttgcttccggatggtctggctatatgcaaggttttttgaaaagtttaggggccgaacttccaaaagcattaactggcgggtacaatccggaaaatggtacatacattgacttgattgcggtgctcgtagtgatattcgtcacttacatcgtgtcgcttgaagccaagaaagcattacgtttgaataatgccatggtatatgtcaaatttggtatcatcgcgttgtttatcattgtaggaatatttttcgttaaacctgataactggcagccattcatgccttttggtttttccggtgtgctagatggtgcagctcttgtgttttttgctttcttgggatttgatgccgttgcaatggcagccgaggaagtcaaaaacccgcaaaaagatgtgccaagaggaatcattggttcgatactgattgctactgtcctttacatcatcgtgacgctgatcttgacaggaatcgttccgtatactgaactaggagtcaatgacccagtggcttttgcaatgaggtatgtaggacatggaacagtgggcgcggtgatcgctgtaggggcaattttaacgctactgacagtaacgatctcgatgatgtattcacttgctcgtttactgtttgctgtcagcaaggatggcttacttcctaagtttatgacagaaatcgatcaaaagcatcgtacaccgaaaaaagcgacttatgccgctggtgtggcagctgtattctttgccggatttttcccattgaatgtattagcggaactaacgaatatcatggcgctcgcctatttgatgcttgttagtctaggcttactgaagttgagaaaaatgtttggaaaaccaaaagctggagaattcaaagtgccattcgttccgctattgccaatcatttccatcttgacttgtattgtattgatgcttcgtctgcaaactgtgacatggatcgtgttcggtatcgtaatgattattggactgatcatttattttggctatggctatggacacagcaagatgaatgagaaatagactccaatggagaagttagaagaaagataagaaaaacgcccatcaacagttgtaataaactgttgttgggcgtttgttttagtaacaagcgaaaggtgatctattgggttaaatccaacagtttttgtttcagatcttcttccatgtgtccaagctctacttctgcatgacgacgtttttcttttccttctttttggatacgcaatgtctcttggattgtttcgatcaaatcattttgagtggtttgaagggtctcgatatccacgattccacgttcattttctttcgctgtttcgatggctgagattttcagcatttctgaatttttcttcaataagtcgtttgttgtttcagagacttggcgttgagcagttactgcatctttttgacgaagcaaggtcaatgcgatcacgacttggtttttccacagcggaatggctgtagcgatagatgcttggatcttttcagccaaggcctgatttgtgttttggatcaaacggatttgtggtgcttgctggatcgtgatctgtctagctaagcgaagatcatgcgtacgtttatccagacgatctaggaattgcgtgtaatcattggcaatctgaacatccatctgatcgccagtttcttctgctcttttcatcgcttctggaatgatcgttgtttgaagttcttccattttcaattctccagcagcgatataaatattcagtgcatcaaagtagtctttgtttttctggtaaagctgttctaacatcagattatcttttagcagaccgtctttttctttatctaatttcactgaaatcttgtcaatttgtgcaccaatcttttgatattttgctgtcacttcatagatcgattgtttgaccttcccgaagacacgctggaagatgttcccttctccggcacgcagttcgtcaggattggcttcttggagacgatacatcagttcagttaaggaatctcctacaggaccaatatcttgtgcttgcacatgattcaacatcgattgtgagaattcacttaattttgcttgggcagccgatccgtagctgatgacagactgtgcatcattagcatcgatttttgctgctagctgtttagcttgttcttggcgttccgccggtagtttgtcaattaaacgagcagctgtctgttgctcttggagctgatcaatctccgcttgttgtgaagtggtcagcgtatctgttggagttgaaaacgggttgttcaataaatcttcaagtgtatcgttaactggtgtaacatcttttgtttcagtcggtttatgatccataaaaaattcctccttgttgaatctgttctcgattcttacatgaatgtctctactttagaaaaagtactcgaaacagccagacatcatctgaatgttccgagtcttcttttatgaacaaaagagttaatccttttgttctggttcatatttattatcacgctttaagctctgtttcgcaacagatatctctacatcgatatcatctagatcctcagcaacgaatttttgataatcttgtgcgattaaagctgacagctggtcgataatctgcgcgctttcttctagtttttcataggtctgtttgtttttgatctcatggtcattgatctcattatacttatttgtcaaatcaactagattcggcagatgcgtataaagaaactgacttgcttcatgcagtcggtttggttctttcaccaattctttgaataaagcttttgctgctttgactggatcatggcggagatcgattgctttaagtttggctgtctgctgcatattcatttgcaattgattgatctcattttttgtttgattcattgtttgtcgaaaaaatgaaatttcattcgctgtcataccgcttttttcatagtgagtttcaagttcgtcagtcagtgcaggaatttcttcttgttttccctttttcctgcgcgaaccaaagagtccccacaaaactaaaactacacctatcaataaaagtcctagaacaaaagaaaaactattgtttcggacaaagagaaatagcaagaccaatgctagaagccacggccaatttcgttttatcataataaaccctccatgtcatttatcgttgagtattgaattcttttcgttattcgattacatacttattttagcatacggactactagaaagagtatcggactaaagaaggattttctatatttagagaaaatctaaggtttatctatggtaaactaataaggagtttttgagaaaaattgaaaaatgaaaaaaaagcagttatgattacaaagaaagcaggagaagatatgctgaacaatgagcaatttgaagaaaaaacaatcagtcgcaaagaaatctatagcggaaaaattattgatgttgctgtagacgaagttcgtttgccagatggaggaacttcgaagagagaactggtatttcatcctggcggtgttgggatcattgcttttgacgaacaagatcgtctgcttcttgtcaaacaatttcgaaaacctttagaaaaagtgattttggagattccagctggaaaaatcgatccaggagaaggacaaaatcccgaaatgacagcagctagagaattagaagaagaaactggctatcgtgcgaagtcgctgagccatcttacttcgatgtatctttcaccaggttttgctaatgaagtccttcatatttatcatgcacaaggggtagagaaggtcgagaatcctttagcacaagatgaagacgaagtactggagttgtatcatctaactcttgaagaggcgcaacaagcgatgaaagatcagttgatttgtgatgcaaagacgatttatgcgattcaatactgggaactattgaccaaaggaaagtagagggatcggcttatggccaaaggaccgcttattacgcgaagcgaacttcgcaagcgacaacaagcacaagcaagcgagtcattaaaaaaacagcgaaaagcagaaacagcttatcagcaagaagaaaaaaagattgctagcttttatcgtaaagaaagcaaaaagaataaaccaatcacgaaaacaaggatcagcgaacgggaaaagacgaccaaatggaactcttttttgatgaaatctcttattattgttatcctaatgttatgtgtggtttttttagcaatcgcatttatatagaaagaaggaattaaaaagatgaaaatcggtattatcggcgcaatggaagaagaagtaaaaattttgagagagaacctaagcgaaccattatcatgggaacgcgcaggcgctttatttatttcaggttcattaggtaaccacgaagtgatcgtcgtacgttccggtataggaaaagtcttagcatctattaccacaagtctgttgatccaacaatacggcgtgaacatggtgatcaatacaggttcagctggcggaatcggtgaaggcttacaagtaggtgacatcgttatatcagacaaagtagcttattttgatgcagatgcaacaggatttggctacaaaccaggacaattaccaggaatgcctctatattatgaagcaagcacatatttgcgcagtgaaatggttaaagcagcaaaagcaacgaatttgaacgcaaaggaaggattgatcgttacaggtgatacatttgtcgactcgccagataaaatcaaagaaatattaacgaatttccctgaagcattagcttgcgaaatggaaggagccgctgttggacaaacagctcgtcagttcaatatcccatttttgatcgtacgtgcaatgagcgacacagcagatcactcggcgacacaaagctttgacgaatttatcgaagacgcaggcaaacgatcagcagaaatggtgatcgaatttgtcaaacatctcgtataaggaggactaagatgaacgcattgatctcgattgactacacatatgattttgttgcagaggatggaaagctgactactgggacagcaggacaagtaattgaaaaaaagctgactgctcatacaaagaagtttattgatcaaaaggattttgtcgtttttgccattgatgcgcatgatccaaaagattcctttcatccggagaaccgcttatttcctccgcataatgtgataggaacgggtggacgggaattgtacggctctttaaaaagtttataccaagactatgagcaagaggaaaatgtttattggatagacaaacggcattattccgcttttagtggaacagatctagacatccgtttgcgagaacgccagatcacagatatttatttgaccggcgtatgtacagatatctgtgtgttgcatacagcagtcgatgcgtataatcttggatacaaactccatattttcaaagatgccgtggcaagtttcgatcccgttggacatgaatgggcattgagacattttgaatccacactaggcgcagaaattttataaaaaaacaaagtgatttgataaaataaaaagcacaaaataataaaagaagagcataaaacaaacgactttgttttacgctcttttttatacgttattttaaaaaaatattattctttttacgttaataaatctctttattatcaacaacttaagttatattttttctttttataaaatacacttattataattttgttttttattgacagtgaaaataaattaggcaatactttaagtaaacgctttctaatttgttgcgggaggaatacacttgttaaaaaaacgtataaaatacagtgcgctaatgatgaatctccttatgctcagtaccccggttttaatttctgtcgttgaagttgctgctaacgaacaacagtctgtgaacgaagaaaatgcacacgtgaacattgaagggatgtcaacaatggaggaagtaccaagaactagtgaagatatggatacggaagaaggaaatgatcctatgatgaaagaatcagaaaatgaaaagacaaaaaagcaatctgaagaagcaaatgaagagtggaaaggggttgttttcggagaaagcacaagtgctagtaggtatgccattgaaccattagaagacggcgtgcggctctcttccacgaataatggcggaaaattccagtcaagcggatcagatggaatgacctattattatcaagcaatccccaaagacatcaactttaggatgcgggcgacgatcgaaatagaatcttggacctatacgaatgcccaagaaggatttgctttaatggtaagagacgcagtaccaaaagatcatttgtttgggcaggcattttattcaaattcatttgccatactaggcagtcggatcgaatatgtctgggactcggatagacaagaagtggtcaacacgagcggcagcaaatatacgatgcgacttggattagggacacgggcaatcacaggaatatcatctgaagatccgcaagctgcgccagctcctgggagtgtctcagtggaaacaacaccttcagagacttcagcagggttcttggaaaaagaaacaggttcttataatatattcggaaacggtcatgggaatctgtttccggccacgaactcgattactaaactggacgtagagatgaaaaaaacgaatactggtttagaggcatattattacgatcctgaaacaggagaagaaatggcttctgacatcatgtatgactgggaaaaattatacgcttcagatgaatcggttatttatgcaggatttgctgcagcaaggaatatgacgatcaaggtagaaggaatcgaagtggcttactcagatcctgcgacagatcctcctggacaagaaaggcccattcgcttgattgatccgatttacactgtggcctctagtaatcattcaggaaaccaagaccatactatgtcctttagagcaaatgctgacggattattaacaatcaaaaatcaagcaacaggagaggtacttgagaacgcaaaagacttggcaatcactgcaaatcgggaatttgattatcagacaaaactgatggaaggaacgaacgaatttactttcagttttacaccagataaaaactatccgccagaagaatacgtagagatggctagttatgaaacaaaagagattctgcatacagttgactaccgtaaacctaactattcgacagtttatgtaacaccggaagggtcagatacaggaaacggaagcagacaaaatacgttatctctgacgcaagcattgagatacgcatatgctgggcagacaatcgtcctggctcctggaacttattcctttgaaagaggattgacgattccaaaaggagttaacgggacaagagaaaacccgattcaattgattgcagagaaaaatccagaaaacaagcgacctgtacttgattttaaaggaactggaaatgggatgacactgtttagtcattactgggttttacgtgggtttgacgttacaaatagtgccgctatgcaaaaaggattgcagatttctggaaaccataatttgattgaagagatccatgcttatcggaatggaaatacaggaatccaaatcagtggtagctcaaatgatcctttcgaagcatggccagcgcataacttagtcaagaactgtacatcttttgaaaatgccgatccaggatttgaagatgccgatggatttgcggccaaactgacaataggagaagggaatgtatttgacggttgtatcgcttatcataatgcagatgatggttgggatctttttgctaaaaatgaaacaggttcaatcgggaaagtagtcatcaaaaactcagttgcttatcgaaacggttgggtaccgggagttgaaggagaagggaacggtaatggattcaaaatgggtggttcctctttatcgggccctcatgaattgatcaatattttgtctttcgaaaatcttgcaaaaggaatcgattccaatagcggaacagatattatcgtcaatagcagtacaagttttaataacggttcatataatgtggctctttatacctcttcggcaggaaacacagacttccatgcttctggtatcttatctttccgaacagaaaatcttgagatgagagagcagatccgcccattgaatcaaaacgaagatcaaatctatcactcgttgaactactattggaatgaacgagagaaacaatcagaaaatactcttggacataccgtatcaaaagattggatcgaatctctaaatacacattcgcaagaagggcagcagcctgttactcgctatgcgaatggaagcatccatgtccatggattgatgcaaatcaaaccggagaatcgtcaaacagaaaagggaagagtagatggtcttccactatctgtaggtgctacttttgacggagaaacctcaccgtcttcggagtatccagaatatgcaatcgtacaagaaccaaatcagacaaaaccaaacgaacaaaataatccgattattatacaagaagcaaatggtgtggcggagaatgcagaaggaaatatcattgaactgaagccttttacagtttttgtgtcaactttcacaccaaatcaaggaacgcctgtctttgaagatatgcgttatttcccagaaaagatccaaatcgttgaaacacagtcaagtgctcaattttctaatcataccgctattttttcagcaccttcaaaaggagaatatacgctagaagtcacttatcgttcggaaatatttgatggggaaaaatggtctgctcatacagaatctgttacccagcaaaaagcgatcactgtgcgagaaactgccgatgtgcccccgggaaatgacaaaccagaaagagaaaatccaggaaatgaatcaccaaatggaaaaccaaatggaaaaccttctcatccggataggacagcaaaagaaagtgaaaaaaatggcactcaaggactcccaaaaacgggagaatttaataacccgttgctagcattagctggaggaattttgttaatcggtgtagttgtttatgtcatgaaacagcgaaaaaataagtggaatttctccttttatgatgtaaaacaattgactgaggaaagtaaaaatagaaggaaatgagaccaatagatgtctcacttccttctatctttttatagatgaggttctccttgctgcttttgattggctgttcttattacttgatgcaggacagctttttcacaacctctccactaaacggtgttcaatcagctgacccttggtattagctcaacaaacggcaaaatatgaggaactatttttccgtttttttctctaatactcaggtcaggacgctgatttcacaatctctcgataaacggtgttcaaaagccagtttctcggtagtaagtcaaatttatgcaaaaatgtggaaagccattttcacaaaatttttcttactacttgaaactaagcggctttttcacaacctctgatatacggtgttcaaaagcagtttctcggtagtaagtcaaatttatgcaaaaacgtggaaagccattttcacaaaatttttcttactacttgaaactaagcagctttttcacaacctctgatatacggtgttcaaaagccagtttctcggtagtaagtcaaatttatgcaaaaatgtggaaagccattttcacaaaatttttcttactacttgaaactaagcggctttttcacaacctctgatacatggtattccagaagtaacttcttcgaaaaataagccgaaatgtcacaaaaatttgagaagaaattttcctaaattccttcttatttcttgaagctggccacttctggcacaacctcttaccagattcgcactcttttttctggcgctagatacatagcgtcttgttccgtgataccaaatgtttcatagaattcgtcaaggttttttggttgcacgtttgctcggagtttagcaggggcatggacatcgatttgcagtaaaagttgttggtattctttttttgcttttgtacgccaaatcgttgcccaattgacaaagaattcctcgatagaaagatctgattccgtttttgctgcttccaatgcacagcttagaccgcctgcatcagcaatattttccgaaacggttaattttccgtttacttttccgtcagcaaaaggcagaccatcgaattcttcgatcattgcttgtgctttgttttgaaattgtgtaagatcttcttctgtccaccagttgttcaagttgccatattcgtcaaataaagcgccgttattatcaaatgcatgggaaatctcatgagcgataacagctccgattccaccataattagcagagcttgattgttctagactgtaaaatggtgcttgaaggatcgctgccggaaagacgatcacattccgaaacggatgataataagcattgaccgtgtcagcactcatttcccattctgaacgatccactggtttgttccatttgctgaaacgatcttttaatgtgagtttgctgaaaacaagagtatttgaaagcaaagtaccaccctgatctgcaggtactgttttgaactggtcgaataatgctgggatcttatcggggtagcctacttggatacctaagttatttaattttatgacggctttttcttttgttgcatccccaagccagtcattttcttctagacgttttttataaacggcgatcatttttttcaccatttgttctacgtcttttttagcagcttcgccaaaatatttttttccgtagtaatcgccaactacttgatcgaattgtccagaggcaaggtaatacgctgcttttttctgaggcattgcttcgtctgttccagacaatacgcgagaatagattccgctgacttggcggaattcttctgatagataaccactaagagaacgtactgttttaatgatcatccagcttttgaataacggaaaatgagcttctgtcaggatgtcattcaaatgatcgaagtacactggatcagttacgatcactttatctggagttgtcccaatcaaacccgtgacaagttttttcaagtccagtttatctgtgtattgaataaatgtatcaaaagattgcggattatacattttgctgtaatctgcgttttcttctgcactttttacatgaggagcaatcaatttatcaaattgcactgcttgttccgtgattgcttctgcctgacttttttctttgccggcaagctctaataactgaacagccatatcaaagaaaacgcctattagttgtgcaccgttgggatggtctgatgcataatacgtcttatctggaaggaataaagaaggcggataagcaaagaaggcgttcgtttgcgcattcttcatatctgcatctacatccagattaaatggcaatggtaatgtatccaacagccattctggaaattgcttattcaattcgtcgaaagactgcaatgattcaactttttcgattataggttgaagtggttgagcatgcaactcatttcttcggtcataatcgtttgccagttgataatatgcaaggaaatgtttcattttttctgaagacactttttctggatgggcaagcagatcgtctgtttctcccatcaaaagttggtcgatcccgtcaactaaatcttggaaaccgcctgtagctggtttatctgcagggatttttgctgttttttgccattcttcattgactgcttcatagaaatcttgtttcaatcgttctttgttcattcatcgatcgctccttttttgtttcgtgtgcccattatcttacaaaatgaaggaattaacaaatagaacataaaaaattgaaaattcgaacaatcaaactgatttgtttttttcaatccttcacttataatgaaaaaaaggaggcgatcccaactgaatcaagtagtggataaacctttatatttcaaagtagataaaaaaattaaaaaattagccagcactcagcagctgcagtcaagaaaaagtaaattgctttttttagctctggtttttgaagatcaaagttatgtgattatcgatcaatcaggacatccggtagaatattctccagcaaaatatacttatcaagagggtctttcttgtaaaaaatggaagctgatcaatgaagagccaatcgagttatctagatggatcaacagaaaagaagatattcccgttttgatcgaagaaaaaaggtcaggaaaggaactcgcaaattgctggatgggattgccagaagaacgttttttgaggtataagaaatgggctaccccctcaggctatctttgtggtacttacgcggcagcagttctccttgcctattatcaagactatcgtaaggggtggatgcttccaaatgagattcgcaagaaaaatacggctgattcgttggttttgacgaaggcattgcgtagccagatccaaccactaggacttcctacgattccttttcaggttagtacagggatttctagttttttaaagaagaatggcaatcatgagcgtgcacgagcaactcttctaggttcatggcagcgagctacaaaacgtatacgtgaaggcaaacctgtgatgattggtattttgaaagtacttggcagtacatatggcaatcattgggtgacagcgtacgcttattttgaaactgaaacaggagaacgttattacaaagtacacgacaactggggcgattatcataaagtcattcctgccagttggagtaacggaacagtttcacttccttaagaatttgctgaaattaacagaaaatcttggaaaaatatgttaaactatcgaagaatagagaagttttggggaggactacatgagtaataagtatcaggatgacacgttgaagatttttagtttgaatggcaaccgtccattagctgaaaaaatcgcgaaagtgttcggaacagaattaggtaaaagcgtcgtgaagcaatttagtgatggcgagatttccatcaatatcgaagaaagtattcgaggggatcatgtgtatatcgttcaatcaacgaatgcacctgtcaatgactactatatggaactactgatcatgatcgatgcaatgaagcgagcaagtgcgaaaacgatcaatgtcgtattgccttactatgggtatgctaggcaagaccgcacggcgaaacctcatgaaccgatcactgcgaaattgatcgctaacttgatcgaagaagcaggggcaactcgagtactgactttagatctgcacacggttcaagtacaaggattctttgatattcctgtagataatttatttacgatgccgttgtttgctcattattaccgtcaattaggtctgacgggagatgacatcgtagttgtttcgccaaaaaacagcggtgttcagcgtgcacgtagtctttcagaatatttgaacagcacattagccatcgtagatcatgcagatgatgcttcaactgagggtggttatgtgatcggtgatgttcaaggaaagacatgtatcatggtagatgatatcttgaacacaggagaaacgcttgcacgagcagcaaatgtattaaaagaaaacggcgcaaaagaagtatatgcctgtgcgtcacatggattattgtccgatcatgcgaaaagtattttagacaatgcaccaatcaaagatatttgtatcactgattctgttttcacagaagaaaatcgtcatccagaaaacttaacaatcgttacatgttcagaattaatgggtgaagcggtcaaacgcatccatgaaaatacaccgatgagtccgttattccgtctggaagaaaaagaattcgaataaacaaaaaaaagagggaaagaagttgtgacagaagtgagcagcttcaaggagctgcgacaagacttttgtcacagctccttttttctatgcccatgaaacgtcctctagacaaaaatgagctcttctttggtttgttcgctattttatgctagaatgtgcctagcaataatttggaagggatgaatgaagtgaaaactatttatctggatcatgcggcaactacccccatgcatccacaagtaattgaagcgatgacggcaatcatgcaagacacgtttggaaatccttcaagcatacatggatttggtcgccacgcgcatgaaaaattggaaacagcaagacaaatcattgcagacagtctgcaagcaaaacctcacgagatcatctttaacagtgggggaacagaaggggataatacagctatcttagaaacagcgttctcgcgtcaaaaagaaggcagacatctaatcactacagctatcgaacatcctgctgttcttaataccatgaaatatttagagacaaaggggtttgacgttacatatctgcctgtagatgaaaaagggaatctgtcgatcgaagaggtcaaaaaagcgttacgagaagatacgatcttggtctctgtgatgtacgggaacaatgaaatcggaaatttgatgccaatcaaagaaatcggtgaacttttagcggatcatccagcttatttccatacagatgcggtacaagcgtacggaaaccaaacgatccatccagaagaattaggaatcgatttattaagtatctctgctcataaaatcaatgggccaaaaggcgtcggtttcttatataaacgagacggagtaaatatccctgcattgcttttaggcggggagcaggaagaaaagcggcgtgcaggtacagaaaatttagcagggatctggggtatggcaaaagcagttgaactgctgtcacctgaagaacgtgaagcacgtaacaacaaatataaaggattccagcaattgattcttgatacattagaagcaaacgaaatcccttatcaagtaaatggtgatttaacgaataaactccctcatgtgttgaatcttcgcttaattggcgaagcaaatgatttgctactgatgaagcttgatcttaatggggtcgctatttctactggttcagcttgtacagcaggaaatatcgagccttcacacgtattagaagcaatgtatggagaagatacaccgatactaaaagaatccatccgtatcagctttggtttgggaaataccgaagacgacatccagtatttccttgatcaattagttcgtgctgtcaaaaaataactagtgaagtcattcttatatgaacagatgtctgagagaacgccttcattttttagggaacttaactgaaaaacctagtaaaaatcaggataaacttttataataaagagaaactaattttatcgaggtgaaaatcatggcatttgaaacaacagcaacggtactgggcgcaccaattagctatcgtttgcatcctgatgcaaaaagatatacattgcgcgataatggatttacagaaacaaacggaggcaattatcaattgatccgaccattagatgccacgccgcaaagcaaagaaggattcaaattaaaaatcactgtatcaaaagatattcaaacattgaaaatgtcgatcactacagcaaatggattgaaagcagtcaatattttcaaagatccaaaacagaaaatgagccaagataaattttattttctgatggatgggatgattagccgtgggttattcgaaaaagtcgaatgatctgtggatataaaaagacaactagttttgaaacggcctattgttagatgactaactttgtaaggacgacgcaaattagttgtcttttttatttttaaatttaacacatgttgttatttttaatattttgctgatttattgtttctaagtaaagaaatttaaattgaaacgattgttatttagggaaaaaggtattttttgaaaaaagaatcccgtataatgattgttgtgcaaacgctatacaaaatgaaaaagaaaagagggatgtttatggaaaatgaacagtcggtcgttttaacgaattggaagagaaattatttgttctttttatcgggacagtttttgtcaggaatcactagtatggttgtccaatatgcgatcatctggtatttgacaagagaaaccggttcggcgacaattttgagttttgctactttactaggaatgattcccatggttttactaagcccatttgtaggaccgctagtggatcgctgggataaaaaagctcttttgattgtcacggatattattgtagcaattttcgcgcttattttagcagtagtcggaacgatttcagaatccttcccgatttggctagtttttgtgtctttgtttatgcgttcggtcgcacaaacattccaaatgccaacgatccagtcgattatgccgacaatcgttccatcttctcacataacaaggacgaatggacagttaggaatggtccaatcagcgaatttcatcattgcgccagctctaggtgcggctttgttttcagtcgttcctgtcaattaccttattttattagatgtattgggggcagtttttggtgtcggcttattgatttttgtgaagatcccaaaagtttctcctgaaatattggaagttccgcttactatttttaaagatgcaaaatttgggctgcagcaattgatggataacaaagggttatggtacataacgatcaatggtgcatttgtgatgctgttgttcatgccagcaatcagtctgtatccattgatgacgctagattactttggtggttccgttggacaggcgggagcagtggaagtagtctacgcagtcggaatgctcttaggcggtgcactgatcagttttataggaacatggaaagaccgaatgaaacctattattatagcctacatcattatgggcctgacgatcggtgcaagcggattggttccaaacgatagtcaagggttcttgtactttcttatcttgaatgcaggagcaggttgtgcaacgccatatttcaatacactgctgatggcaatgatccagcagagttatgaatcgaatgttttaggtcgtgtcttagggaacttcaactctttgatgaacctggcaggtccaattggattattatttgcaggaccattagctgatcgtttaggggtagaaaaaatgttcttgttttctggaatcgggattttattatgcggaatcgttttatttttaacgtcagctgctcgaaattatgataaagaattacagaaaaaactggtaaaagaacaccatgagcaaaaagacgaatagtatggaatggagttgtgacagaagtcttgttacaactccatttctgatcctaatgttcctgtggcaataagcctactcaaatgaaaaatatgagtaattatctttatttgtttaatacttgatatagggcagttttttcacgacctatcgtacttcctctttgcttcatagatttctttgatttgttgctcagataacggagtgccaaatggtagtttttcctttaagagttccctttccggtgcgtctacgcctacattgacatcgttcttgataggtacgctgtaatgatggatatgtccatgaagattgcggatagtgtcgttaggcccgagcaacatcggataatgagtcaagtaatattgttgatggtcgaatttaacgatggcacctacatcataaaaataaaatttgggacttccgtcagtaagcctaggatcatttttttctaaataacggaaaaaagcgcgactgtcatggttccctttgatcaagtggattgttccttgcagttgagtgaccagttccaaaatttctgcatttgctttttcatattgcggatgcatagcaaggtcgcctagatgataaacatggtcggtttcttttattactgcattccagctagtgatcaactgttggttcatttcatccacatttgcaaagagccgcggagcaaagtcgttttttcctaataagcgttcatggaaaaagtgcatatcactggtaaagtaattcatgtatcttttgcctcccttttttcttagagtaaacaaaatcacttatctgagcaactcataacatctaaaaagaaaaggttgtaaatgagacgtgtagctttaagcgataagaagcaattttgaaaaatagtttttcacaatttataaaattattccttattgccgaaaggctggccctttttatgagtatgccaattttttatatcgaatgctcaaaagatgagtgattttttggttgactatcatgtttgtgtactgaataggtccagtagaacagtatttttacgacttgataattaagggatgaaattttcagaaatatgacgtataatgtaaaatactgaaaagttgcgaccttcaactcgtagatgtttcagaatctaattgaaatgatggtgatatcatgacagacaacagcaaaacacgcgttgtcgtagggatgagcggcggtgtcgactcatctgtaacagcacttttgttaaaggaacaaggatacgacgtgatcggaatattcatgaaaaattgggatgacacggacgaaaacggtgtatgcacggccacggaagattataaggatgtagcgaaagtagctgctcaaatcgggattccttattactctgtgaattttgaaaaagaatattgggatcgtgtatttgaatatttcctagccgaataccgcgcaggacgtacacctaacccagacgtgatgtgcaacaaagaaatcaaattcaaagcattcttggattatgcaatggatcttggcgccgattatgtagctactggacattatgcgcaagtcactcgcgatgaaaacggcgtggtccacatgcttcgtggagtagacaataataaagatcaaacttacttccttagccaattatcacaagaacagctttcaaaaacgatgttccctctaggcggcatggaaaaatcagaagtacgggcaattgctgaacgcgcaggccttgcgactgctaagaaaaaagattcaacgggaatctgttttattggtgaaaagaacttcaaacaatttttgagcaactatctgccagcaaaaaaaggaaatatggtcactcttgatggtgaagtcaaagggcaacatgctggcttgatgtattatacgattggtcaacgtcaaggactagggatcggtggcggaggagattcgcaagaaccctggtttgttgtaggaaaagatctagcgacaaacacattatatgtggggcaagggttccatcatcctgcattgtatgccacaagcttggatgcaagtgaaatccactttacgacgaatgaaccaatgccaaaagaattcaagtgtacagcgaaattccgttatcgtcagcaagacgttcctgtgacagttcgcttattggatgataatcgtgcagaagtcgtattcgacgaacctgtacgtgcaatcactcctggacaagcagttgtattttatgatggaatggaatgtctgggtggtggtttgatcgaccacgcatatcaagaaacaaaagttttacaatacgtttaagcgatattaaatgaatcaaaacagctatggctaacaaaagaaacaccttttcttttggatagcatagctgttttttttgcaataaaattaatttttattcattttatacttgaaatacttgtgtaaaaagttcataatatccaataatatgaataaagttgctttttgttaagcaagagcagttgcaaaatagaaggaaatcttttgcaagtgatttgttcaattttataagtgagggtgatggaaatggaaaagaaatcaacgggtattagcaaatggggactggttgctctggttgtcagttcgtcaatcggaagcggtgtgtttgggatcacaagtgatctggctagttctgcagctccagggccagcgatcctttcatggataatcgttgggattggtattttagctttggtattatcgctgaatcatttaggagaaaaacgtccagatctagatggtggtattttcggttacgcggaagcttcatttggtaaattaggtggcttcatcagtggttggggttactggttgtctgcgtggctgggaaatgttgcttttgcaacgatgctgatgagcgccatgggagaatttttcccgatattcaaaggtggacaaaatgttccttctattttatttgcaagtatttttatttggggtctgactttattagtaaacaatggagttgaaggagcgagcgtcatcaatacaatcgtgacgatctgtaaattagtgccattattcctatttttaatatttgtatttatcgcatttaaagttaatatattcactgctgatttttggggtaacgtatctgataatctagtgaatggaacagggcagcaaggaacgatctggttgcagattaaaggttgtttgatggttatgatgtgggtctttgtagggatcgaaggcgcaagtgttttagccaaccgcgcgaagaaacgttcagaagcccagcaagcatcgatcattggtctgctttgtttattgtttatctatatccttgcttcgatcttgccatacggcgtcttatctcaagaagagttagcaactatttcacaacctgctatggcaaatattttaaaaggaatcgtgggaaattggggagcagcgctgatcaatatcggcttgattatttcgatcattggttcttggttgtcttggacgatgctcccagcagaaacaacgatgttgatggctcgagacggtctgttgccgaaaggtttgggaaaaacgaataaaaaaaatgccccaacttattcgttagttgttactgcaatcttgactaatctattcttattgactttcttagttactgattatgcctatcaatttgcctattctttatgtacagcggcaattttgatttgttatctacttgtcgggatctatcaagtccagttttctttaaaagaaggaatcaaaaaacaagtagtgatcggtgggattgctgtagtttttgaattgatgggcatcattttagcaggattttcttatgtccttttatgtagtattgcctatcttcctggtttttgcttctactggatcgcttgtcgtgaaaccaaacatcaaattacgggaaaagaaaaagtaatgattgggctgatttgtgtggccgcactgctttcaatcgggttgcttgctgtaggctggatcaagatataagggggaaagaaacatgaaaatcgcaaatttcggtgtagaagaatggctaaataaatgggaaaagaaagcggtatatgatattgcacaaagctcgatcgaagcattgacattagacgaactcgttggcttagatgggactagcgtaagtgaatttttcgaaaaacgcaaaaacgaaccattggactatggctggatcgaaggatcagatgttttcaaacaagaagtcgcttctctttatcaaaccgtcgatccggaaaacatcttacaaacgaatggagcgactggtgctaatcttttagctctatacgcgttagtggaagcaggagaccatgttgtttcgatgcttcctacttatcagcaattatatgacatccccaaatctttaggtgccgctgttgactttgttcatttgaaggaagaagaagattggcagtttgatttagaacagctagaagccttagtcaaacctgaaacaaaaatcatctgtttgaatagtgcaaacaatcctacaggcacattgctagatcggaaaactttagaaaaaatcgcagaaattgctcgtacagtagatgcatatgtattgatagatgaagtatatgcgcctttaacggataaaggtgaattcttgtcgatcgtagatgtctatgaaaaaggtatagcaaccaattccctatccaaaacctactccattccaggtattcgtattggctggacagctactggacctgagttggcagaagtttttcgaaagtatcgagactacacgatgatttgcggcggagtcctgtcagatgatcttgctgtacatgcattgaagaataaagaaaaaatattggagcgaaacaaaaagatcattacagagaaccttgtgattttaaaacaatgggtagccaatgaaccgaaagttgaacttgtcgctcccaattacgtctctacttctttcattaaattagccatcgaagaagatgaccagacattttgtatcaatttattagaagaaacaggagtactattagtaccaggaagtgcctttgatttaccgaagcatgcccgactaggttactgttgtaaaaaagaaaccttggaaaagggattattcctcttatctgagttcttgaaaaaacaggcctaaacaaaaacactgcaaggacagtctgtgacaactgttcaagcagtgtttttcatttacgcttattgtctatgagaaggagagtgccctgaagatatggagactcctgaagctttttcttctgcagtttcttgctgatggatctcttgtgtattgtgtcgtacaagcaagaagttgaccaaaacaagaagagaagtcgaaagaaagacgccacgataaccaaatgcactggaaacactggagccgatcataggccctactacgttaccagttgcttggaaagattggttataactgaagatccgtccagcagcttgatgaggcgaatattttgtgatcaatgcttggacagcagggagcagacaagcatcagagataccaatcaaaaaacgtaaggcagctaattgccaaacattcgtgacgaatgccattgggatataaaccagaatcgcaaaacccaaaccaatcgcaagtattctttcactcccaatcttgtcacctaagcgaccaaatcttggagcggctatcaaagtggcaatcccaggtatcgaagcgatgattccgctgatcaacgtaacattcccatgtccatgcagcaattggcgaatgtacagactgatgattggactaatggaattgttggatgcttggatgatcatcgttgtgacgaacataccgatgacgacgtgtggatatttcaagtctttgaaaatctgtttggcagaaaccatgttttcttttttcactgggacaaatttttcatggacgaaaaacagactcaacaagaagacgaaaaataagatgatccctgtaatgaaaaaggtagggcgatagccaaacgctgaagcagagatcccgccaagaagcggtccaagtaatgttcctgtaacagaaccagttgctaaggttccaagaacttgaccacttttttcttttggcgtcccagttgcgacaagggcagtggcattactgatataaccagaaaaaatcccttgaagcagacgcaatgcgactaattgatacacactagtcacgcaacccatcaaagaaatgacgattgccattcctaatgaagcacgcaacagcatcaattttcttcctttttggtcggctaattttccccaccaaggagagatcagcgtagtcaccaagaaagtagatgaaaaagtcaatccgctccaaaagttcaattgtgacgtactataattacctaacgtatctatgtaaagtgacataaaaggcatgactaaactaaatccgataccagccataaatgttccaaaccataagacaaacaagttttgttcccaagtttctcttttcctaaataatttttcctttattcttgcagccaattagactccttctttctgaaaattttcatctacagctctttattataaactacaatatgtagtttatcaatgaaagtctcttttttctctttctttttcgtggtaaactgaaagagtgaaggatttattttatgagaggaaacatgaaaatgaaaaaaagaaatctgtctcaagagaaaatcatcgactgctttcgagaactagcagaagagatggatgttcagcaaataacctttcagcatttagcaaaacgcttggatatcaaggctccctcgctgtataaccatttcaaaaatattcgtgatgtcaaaacagcgctaacagcgaaacttctgcaggaacttaatgaccagctgcgtcgggctcttgtgggaaaaagtggtcaggaagcactgcagatctatgcagaaacttatcgatcctttgctttttcaaatcaagcagtgtatgagttactgatcagtgtgccccacaccaatgaagcagttttattagagggaatccatgaaacgaaccagatcattttgcagatctttgaggcttttcaattaacgaaagaagaaaaagtccaccgaagcagagaattacgtagtatgatccacggctatctttccttgcgttttttaggatactttacaaaagaaccgacaatcgatccagaggacagctatttttggatgatcaatgactttatcgctactttgccttaaacaatcagattcatttatatcattttcaagatgttcattaaatgatccttttataagagaaaattcttgcaactttcttgaaaagtgactaagatgagtctagaaaagctgaaagaaggagcacgagtatgtatcaagtaattaccatgttcggggacaatgagccttggtggttttttgaagactgggaagaagatattgaagaagaagaaacattcgagtctttcgaagaagcacgacaagcgtacgaaaaacaatggaacgaaatccatcaaaattatgaatatatcaatgcaaaaagtaactttctcagcgccttttggaatgacggagatgagcgctggtgtgaagagtgtgacgatgatttacagcaatacaagggacttgcgttgttgaaaaatcatcagcccatcacagtagaaagcagaaaggaattttatgaaacaactaattctagcggaaaaaccaagcgttgcgaaagacctaagcaaggtgcttggtgctaatcaaaagcacaaaaattattatgaaggacccaaggtgatcgttacttgggcccttggtcatttattaggattgaaaatgccggaagatctgaataaggaatggcagagctggcaaatggacacgttgccaatgatccctaaaaaactaggaatcaaaccacttcctaaaacaggacatcaattaaaagcaatcaagcagctggctcagcgaaaagatgtctcagaagcagtcattgcgacagatgccggaagagaaggggaacttgttgctcgctggatcttagagtatgtgcatttcaataaaccagtgaagcggttatggatctcttctcaaacagataaagcaatcaaaactggattcaagcaactaagacctgcgaaagaatatgatgcattgtatgaatctgctcttgcccgggcaaaagcggactggctggtaggattgaatgtgaccagagccttaactgtgaagtacgcggataatttatcagcaggccgtgtgcagacaccgacactagcattagtgagagaccaagaaaagaaaatcgagcagttccgtccacaaacgtatttcacgatcacgttgcaagctggaaaagaacaagccaaaatgcttcaaaaaaatcaatttgctttaaaaacacaagaagaagcacaaaaacttgttcaattgatcagtacaagcaaaggaactgtcacagaagtccaagaaaaattaaaaacggaatctgcgccattgccttatgatttaacagagatccaaagagaagccaatcaacgctatggctattctgcaaagaaaacattaagtcttgtacaaagtttgtatgagacccataagatcgttacttatccgcgtacagacagcaaatatctgacaaatgacatgaaaagtacgatgaaagaacgattgcaagcagtcagcgactttgctcctgaggtcaagcagtatttgaaaaacggagccatcgtccaacagacaaaagtattccaagacagtaaagtgaccgatcaccatgcacttttgccaactgaaaacagagcacgttatgaaaaattaagtaatgaagagcaaaaaatctatcaaatgattgtctctcgttttttaggactgtttgctcaaccccataaagtcagccaaacaaaagttacggttgaatttggtaaagaacgattcatttttcggcaaaatcgtgtcgtccaagcaggatggaaaggcgaaactgaaactgagacggaaacagtcaaatgggaaaaaggaatgagaatcaatcccgatttcaccatcaaaaaagaactatctgcaccgcctaaaccattgtcagaagcaagcttgcttggtcaaatggaaaaatacagtctgggaaccccagctacgcgtgcagagattatcgagaaactaatcaaatctgaactgatggaacgtacccctcaaggactgcaagtatctcctaaaggtaagcaattattagtattggtaaatccctctttagtaacaccagatttgacagaaagctgggaaaaagaccttgaagctattgctgcaggaaagaaacaagcaggaaccttcttgaatggaatcgaaaaagaaacaaaacgcttggtgaatgagatcaaatcaagcaaacaagaatatcaagatttctcgattacccaaaagaaatgcccagaatgtggggccaatctgcgcgagaaaaacacacgtgacggcaaaatctatgtctgcaccaattcagattgcaactaccgcagaagaaaagatccaaaagtctctaatcatcgatgcccgcaatgtcaccggaaaatggaaatcatcgaaggtaaaaacggtgcttatttccgttgtaaatacgatggaacgacagaaaaaatgcttgataaaaaagagcagaagaagaaaatgaccaaacatgaagaacgacgcttgctgaaaaaatatgcacaagcagaagaaccagaagaaagcccattagcagcagcactaaaagcagcaatgaagaagtaataagatatgaaagaggttgtgatagaagtggtcagcttcaagaaataagaaggaatttacgaaaattgcttctcaaatttttgtgaaatttcggcttatttccgaagaagctacttctggaacaccatttattcggaaaaaaggactgtgacaagacttttgtcacagtcctttttcatttaaaaaaatgtttacttcatttgacgtatattattggtgaggcttcaattcatttggcttcactttttctgtttctcttatgatataaacaggacgctgtttcgtttctaagaagattttcccgatatatttcccgatgattccaagacataacaattggattccaccaatgaacaggaagatcgagaccatggaaggccatcctgatgtaggatcaccaaacaacaatgcccgcaaaataatgaacaaaattgcaataccagaaccgacacaagacaaagcgccgataaatgaagcaatcgttaacggtgcatccgagaagttcacgataccatcaatcgagtagttgaataatttccagaaggaccaagatgtttcgccagccacacgttcgcggttttcataagaaatatattctgttttaaatccgacccagctaaataatccttttgaaaatcggttgtattctgttaattctaggacggcatccaccatttgacgagtcatcaagcggaaatcacgagcgccatcgaccatttctgtatcgctgattttattgatcaactggtagaattttttcgcaaagaaactgcgtatcgcaggctcgccttcacgagtcgaacgccgggtgccgacactatcgacatcagaagtagtgatccggttgatcatctcaggaagcagttcgggcggatcttgcagatcaacatccatcacggtcactaaatctcctgtagaagcttgcaatccagcgtacagagccgcttctttcccaaaatttctggaaaatgagacaaagcggacataaggataagctgaggctagcttcttgattgctgctaacgtaccgtcttttgatccgtcgtcaataaacaaatattcgaactcatgggcacctttgaatttttcaacctcatcaaaaaaaagaggaacagttttttcttcattaaaacatgggacaacaattgatactttcatcgtttctatcctttcaatcgtatgtttatatatggtttacattcaaaatttaataaaccttaaataacaccttttaaatttgattttatggaaaagaacagctattctttggtaaactaacgtatttagtttaccatgtttcctcggtttatcaaacttttaagaacaatttttattagttggcaagtagttttggatagagaaaaaggaggaagttccagtctattgaccaggagcaaacaaaatgaaaatacacacacctatcggctttttatggttagatgcagatgaatccggattgactgctgtatcttttcagccaatttcagaaagcgaatcagcgaatcagcaaattttaacgcgcacacaagaacagtttgaagaatattttgcgggaaaaagaaaagaatttgatgttcctttatctataaagagaggtacgccttttcagcaaaatgtctggaaagctttgtcgaccattccttatggagaaatccgaacgtataaagaagtagctgttgctgttgatagtcccaaagctgtgcgagcgattggacaggcaaatcgaaccaatccattgccaatcgttattccttgtcatcgagtgatcgggcaaaatggaaaactgacaggatatatgggaaacgcaatagatggggttgaaatcaaacgccaattgttgttagaaggatatctgcaaaattaaaaacagttgtgattcgaacattgttccatgcgagaatcacaactgttttttcatgttcattctaaactttgatcagccaaataaatagtaaagccatcactgtttggagaagcccgacagctaatccataagataagaagcgtgtaccttctttcatgaattttgcaaagtctaaacgcagaccaattgccgctaaagcagtgatctcaaaccagctgctgataaaatgtgccgattggtcaataactacaggtaaagaaaacaagctgttgaccaaacaaaagatcacaaaccctaatacataccaaggaagcggtaattttcgttttttctgcgtatcagttggcgtttcaaacagagctggttgtttcttgtgcatgaatttttcaaacagatagacaacaacaacgagcatcataatacgtagaatcttaaatagcatggcgaattcgacaacagaattgtcaagtaagcttgccccagcgactacttgaccaaccgattggagtgtgccacccaaaagtgcacttttttcaatgagatttccaccaaacaactgtaatccaagaaaagggagagtcaacatcatcacagtacccagtagattgactagtgtgatgatctgtcctttttcttcctctttcgcatggatggaaggggcgatcgaagcaatagcagaagaaccacaaacagcgtttcctccagccatcatcaaagaagaagtatcgctgaattgcagttttttaccaatcaagtaagcaccgatgatagtgactgacatttgcagtaacacaaaaacaattccttttacaccaatttgagcaatcgtttgagctgtgacagttgcacctagtaaaaaaacagagaattctaatagtttgctttcagcaaattttgtgccgattgctagaacaggctgtttaaaaaaagtatttcctaataaaatacccaataaaatagcaatagtcgctccacctaactgtggcagataaatagcaagaagcctgctgaaggcagcgatggcaaaagaaagcagtaacccgggtaagatttcgcggaccgctgaatcctttacagattttattggatgtgacaatgatttcatttgatcggttcctttcgtcaataaatactaaaagcatactcgaacatagtagcactaaaccagtattttgacaaaagaacaagaggtcgtgacaaaagtcttgtcacgacctcttgtttcgaataaacggtgttcaaaagccagtttctcggtattaagccaaatttatgcaaaaatgtggaaagccattttcacaaaatttttcttaatactcgaaactaagcggctttttcacgacctcttggtaaacggtgttcaaaagcttgcatctgcggtaataagcccaaccagtacaaaaacatgaacagctgtttttgtttggccgttcttattacttgatgcagaacagctttttcacaacctattgaatcgattattaagcgatttttttagaaacaaattttccatgtttgctatgttctttaattaagaaacgtacgtaatgagcaagaacgtagaagacaactacacttgcaaacagacattccgcaacttttaagaaatccaatacgctactatagatacctaaactgttgaagtaatgaacagtagtaaatatagctgttgcagagataacaagcgggaatgtaaaggctgcatagcttggataaaaacgaagcttgaacaaacgtggaagcatagacagcacaacgaaatacaatacttgagataaagcgaacaatgctacgacaagataaaaattaggttcagcaaagtttttaagataacctgttaggcaaagagaaccaggtgctgcaacgatcgtaatcagcggacgtgtcggatgagccatatttcttacgaaaaagacacgtttgatgatgatcggcaataagaacgcatagcagatcaatgaaatccaaaagaaaatttttccaataagcgggaagaagttcccggcagttacagtgatgaccccaaatccaacgtaaatgataaaccagcttggataaattgcttcaattgaaagatcagctttgataacatggtgataattgaaataaaagacaaggatcacttggaagataacagcgcacagccaaatgaatttgacaattggtgcaatactttcatatgaaacaaaataagtacaaataaccatgagtgacatcgtaaaagttggtgaaacggaggcgatgattggatcatgcaacgtttgtttcgtgtgttcgaataagataaacaatttaacaaaaatgaatatcataagaatcatagagataccgccagttagattgcctaaagcaacatggtgatagtctttaaacagatttccaagggaagctaacccaaggatcaacccgcagatcgggatcggaataattttcaaaaagttcttcatatataatattctcctttttatttaatagattttagtaccaagatgaacgaatacattgtaaaatgaataggaatgtatgattacgagcaagcagacagctgattgtcttcatctaagttactagttggatcagcaactgttttgttgtacatttctattatagatggttttttgtatatttaaatcaaatagtttttatagtaattatcataaaaagttatggaagtggtgccatgtttaagttattaacgacttttcgagcagtatatgaaacaagaaatttttccagagcagcagaagtactgtttttatctcaaccagcagtctcgaatcaaatcaaacagttggagcgggaattgaatatcgatctttttcaacgtaacggaagaaaagagatgcttccaactaagcaagccgacttattatatgaacggacactggttttgttagaagaatgggaagaaactcagcaaaaattgctcaatgaacaaaatgaagaagaagtatgtcggatcgttgcttcccacacctttgctgtctatcttttgcctcagttgatgaaacatctgatcaaaaggtttcctaaagtgcattttgagatcgaaatcgctaattctcatgaatcattagaacaagtagcgaaacatgaatccgattttggttttatcgaaaagccattagagacttccggcgtacaaagatactctttgatggaagaccagctagtcatcgctggggacccaaaaagcaaattgtggcttgtaagagaagcaaactctggtgtttttcattacacgcagcgttattttgaagagatgaatatccaagataagaagatgatcgtgaaaagtaacgatgtaattgttgcgttgctgaaggaaggaatcggtcgctcgattttgtctaagcgctctgttccagaaaatgtgccaatgactccgttgaatttccatcgatatttttatttcatccaacgaaccaatctggtttctgatcagctgctagagattgccgaagagatccttcgatacaatgaaagcacagaaacttctcacagcgaggagaatctcagttggtagataattgcatgtatcaaaaaaagttctatgatacactaaagataagcagtaggcttttgtactgcatttgctcaagcaactgcacaaacggaaagttaatttttcccaaatgtctatggaaagactttccattatctaactggaccgctataataatcagcagtatggtttttaagaaaagggatgaaacatggaaaaaaaattaaaagcttcgaacgataatcgtattgattatggcgtgattttaccagtctttctgttatgtttgattggtctgctctcattatatgtagcacttagccatgatccgaacaatccagcagtcttgaaaggcgtagggatgcaagttgtctggtatttagttggagcggcagcaatcgttgtcatcatgcatttgaattccaaatggatctggaaactgactccttacctttatggtttggggttagtggtaatgggactcttgctcaaattctatgatcagaatttagctgcttcaacagggtctaaaaactggtttcgattcggtgcgtttactttccagccagcagagttgatgaagattgcgtacatcttgatgatggcactgatcgtaactaaacataatacgcaagtaaaagaacggacgatgaaatcggacttttggctgattgggaagctcttgatcgtgacaataccggttttagcattgatcatggcccaagatgactttggaacgatgcttgtctttcttgcgatctttggcgggattttcttgatgtctggaatctcttggcgcatcatcgcacctgtagtaatcttggcagtagtcgttggagcaggaacgatcttcttggttacgactgaaggcggaagagacttgctttacaaagttggcttcaaatcttatcagtttgcacgtattgattcatggctggaccctttccatgatacgtcaggaatgagttatcagccggcccaaggacttttggcaattggtaccggtggcttgtttggtaaaggattcaacgtaagcaatatttatgtgcctgttcgtgagtccgatatgatttttaccgttatcggtgaaaacttcggctttatcggtggtgcattcgtcattttcttgtattttattttaatctatcgtatgattcgggtgtgtttcgatacgaataatgaattttacgcctatatcgcaagcggtttgatcatgatgctgctgttccatgtctttgagaatattggagcaaatatcggattacttcctttaacagggatcccattgcctttcattagccaaggaggatcttcgattttagggaacatgatcggtatcgggttgatattatcgatgagataccaaaatgaagcacctgcaagatcttcaaggaggtaagaaaattgtacaccttttactggtacccgaaatgttcaacatgcaaaaaagccaaagcgtggttagaccagcatggcgttagttatcaaactgttgatatgatcaaagaagtaccgaaggcctcaacgattgagacttggctagaaacgagtcaagtaccaatccgtcgcctgttcaacacaagcgggatgaaatatcgggaacttggactgaaagatcaagtaggcgagtttacggcttcaaaagcgagccaagtcttatcgacagatggtatgctgatcaagcgaccactgatcttacgagaggaccagcttgttgcaattggattcaatgaaaaaatttatgaaggagaactgatataaaatggcaggcaagcatttgaagaaaaaggacaacctttggatcttatttaatggaaaagaatactgtgttggtttgacaaatgaagcgcaagaagaacttggagacatcacgtttgccaatctgccaaaagcaggacaatcgctaaaaaaagatgaacctctgatcgaagttgaagcggaaaaagcggtcaatgaatttgccagcccgctaacgggtacagtttcttctgttaatgataaaatcggtgaagatatcaatatcttgaatgattcagatgaaatgaatgcgtggatcttaagtttcaaagatgttgatccaaaagaatttgacgaattataaaatcagaaaatcacttgaaaaaagttgacactgattcttccagttgctataatcataagcaatcctatatgaaacgagaaagctttgaaaagaagagtacatgtcacggacgtttgaagagagccctgtttgctgaaaatgggtaacgaaaatgagatggaagatggtcttagagcagagtaagcgagcgtaagcaaacttactacgggagtgcccgttacagcgcgacagtatacggaaagaatctaagtccaagtactggaagaggctgttattgcgaagtaacggtaaatcaaggtggtaacacggaagttcaagctttcgtccttttgcttaaggcaagagggcgaaggcttttttgtttgaaaaatcataagagaaagatgtgaatggcatgtcattaatccaactaacgaatgtcaaaaagacattcaatgggaaaaacggaaacatccaagccgtcaatgacgtttcactaaacgttgaaaaaggggatatttatggaatcgtcggctattctggcgcaggaaaaagtacattagtccgtctcctgaatggacttgagcttcccacgagcggcgaagtgatcgtaaacgatcaagatattacaaaattaaaaaacaaagaattacgtacattccgaaagaaaatcggtatgatcttccagcatttcaacctgttatggtcaagaactgtacttgaaaatatccagctgccgctggaattagctggcgtaccaaagagcaaacgtaaagaacgggcagaagaactgttgcgtttagtcgggttagaaggacgcggacaagcatatccttcacaactttccggcggacagaaacaacgcgtcggtatcgcacgagcattggcaaatgatcctgagatcctgctttgtgatgaggctactagcgcattggacccgcaaacaacagaagaagtattagacttattgttagcgatcaataagaaattgaatttgaccatcgtcttgatcacacatgaaatgaatgtgatccgtaaaatctgcaacaaagtcgctgtgatggagttggggaaagtcgtagaagaaggagacgtattgactgtcttcagacaaccgaaaaaagaagtaaccaaacgctttgtacaacaagacatcgaaccagaagctgattcgacagaactattagctgaactcatcaaagaaaatccaagcggccgtttggcaactttgacctttagcgaaagaaatgccaacgagccagtcatttcccaagcgattcgacgctataacatcgatgtcaacgttgtgtatggaaagatcaaacaagtgaaagaaggttcctttggttcattgactgtcttgatgactggtgaaaccaaagaattagatcaagcagaagtgttcatcaaagaacaaggagtaggaattgaggtgatccatcgtggataaaagcttttcagaaacatatctagattttaaacaaatcaacccggaaacgatgaatcaggctatccttgatacactatatatgacattaatctcaatggtcttagtgacgatcatcggattagttttgggattgatcctttactctattggacgcaaaaacaaaccgtatgctcgaatcatttatggaatcgtatcgatcatcagtaatattttccggtcaacgccatttatgatcctgatggttttgatcattccatttactaaagcaatcgtaggcactatgctaggtgcgcaagcagccattccagctcttgttttatccgcagcaccattttatgcccgtctagtagagattgcttttcgtgaagtcagccctggtgtactggaagcagcagatgcaatgggagcaagttactgggaaatcatctggaaggtcttgatacctgaaagtattcccgcattgatttctggattaacagttacaacgatctcgatgatcggatttactgcgatggccggcgcgatcggcgcaggtggacttggaggtcttgcttggcaggaaggctaccagcgtggtaatctgacagtgacattcgttgcgactttaattattttactaatcgtatttatcgttcaaggaatcggtgatttcttaactaagaaaacagacaaaagataataggatatagggggatgtaggatatgaaaaagaaaatttttggattagcagcagcgcttttgctgactgtaggattagcagcatgcggtaacaacagcgacagcaaagattcagcaaataaagcagacgacacgacattgaaagtcggcgcttcaccgacaccgcacgcagagattttggaacatgtgaaaccattattgaaagatgaaggaatcgatcttgaaatcgtcaaattcgatgactatgtattaccgaaccaatctttggaagaaggcgacattgatgccaattacttccagcatattccttatttgaacaaagaaatcaaagaaaaaggatatgactttgtcaatgccggtgctgtccacatcgaaccaatgggcttgtactctaaaaaagtcaaagatgtttccgaattaaaagatggtgcaacaatcattacttcaaattctgaatcagactggggacgcatcatcacaattctacaagatgctggcttagtcaaagtcaaagatggagtagatctggaaacagcaacattcgatgatattgaagaaaaccctaagaacttgaagttcaaccatacgatcgacccatcacttttagcttctacgtaccaaaatgatgaaggtgacctagttgcaatcaacgcaaacttcgcttacggcgcagggttgaatccattagaagatgccgtattgcttgaaaaggacaactctccttacgtgaatattattgcgactcgtaaaggtgatgaagacagtgacaaaatcaaaaaactgattgaagtgcttcaccgcaaagaagtccaagaatggatcacagacaaatggggcggctctgttaaaccagtaaaggctgatgcaaaataaggtatggaacaaaaaagatgagaaataagtctgtaatggcttatttctcatcttttttatacctattctaatttagaaatcaaaattgtttaataataaataaaagatatttgattttagtaaggaaggtcattgcgcttcattctcaattagtctaaaatgagtgagaacgaaagagaatttgggggtataatgcatgtctgtcttagaaataaaaaatctacatgtgtcgatcgaggaaaaagaaatccttaaaggcgtaaacctaacaatgaaaaccggagaaatccatgccatcatgggacctaacggcacaggaaaatctaccttatctgccgctatcatgggcaatccaaactatgaagtaacagaaggcgaaattttgtttgacgggaaaaatgttttagacttggaagtagatgaacgtgcgcgacttggcttatttttagctatgcaatatccaagtgagataccaggtatcacgaatgcggaattcatgcgtgcagcgatcaatgcgaaacgtgatgaaaacgacaaaatttctgttatggcatttttgaaaaagttagatgaaaaaatggctttactaaatatgccagaagaaatggctgaacgttatctgaacgaaggtttttctggcggagaaaagaaacggaatgagatcctgcaattgttgatgttagaaccaacatttgcaattttagacgaaatcgattcaggtctggatatcgatgctttgaaagtcgttgctaaaggagtaaatgaaatgcgcggagacaatttcggtgcattgatcatcacccactatcaacgattattgaactatatcacccctgatgtcgttcacatcatgatggaaggccgagtagtcatgacagggaatgctgacctagctaaacgtctggaagcagaaggctacgctggtatcagtaaagaattaggaatcgactataaagaagaagaagcgtaagggggagcaagaatgaaagaaaaaaactggctcgattatcttgacgcggtaaatgatttttctttaagtaaaggcgaacctgattggatgagaaccttccgtcaagacgcactagcgaaagcaaatgaactgccattgccgcatatcgatcgggtgaaattccatcgctggtcgttatttgatgtgaaagaaacacaaaccatcagtgaaacaggcacgattccggcatttgatgcaatgaaagacaatcctgtgcttgtccaacaaggttcatggacgatttttgaacaactgcctgtggaattagcagaaaaaggagtcatttttaccgacttgttcactgcaatgatcgaatatccagaactagtccaagaatattatatgaaaaaagcagtaaacatgaacgaagaccaattgactgcactccatgtagcttttatgaacagcggtattttcctgtatgtgcctaaaaatgtcgtgatcgatgaaccactcgagtccttattcattcaagatggcgcatccgatgagcacttcttcaagcatgtgttgatcgtggcagatgaacatagtgaattttcttatctggaacgtttccagacaaccaaagaacaagtagcaaaatcatcaggtaatatcatcgtggaagtcatcgctaaagctggttcaaaaatcaaatattcagccgtagatcaattaggagaaaatattacttcttatatgaatcgccgtgggcacattttacgagatgcttctgtcgactgggcaattggtgtcatgaatgacggtcatgtgatcgctgactttgactcagatttagcaggagaaggtgcacacgcagaagtcaaaatcgtggcaatcagctcgggcagacaaatccaaggaatcgatacgcgagtaaccaataaagcccctcatacgatcgggcatattttgcaacacggagtgatccgagaaaaaggaacattgacctttaatggtatcggccacatcttgaaagggacaaaaggtgcagatgcccaacaagaaagtcgtgtcttgatgctttctgataaagcacgtggtgatgcgaatcctattcttttgatcgatgaaaacgaagtaactgctggacatgctgccagtgtaggacgagttgatccagaagaaatgtactatctgatgagtcgaggattgcataaagaagaagcagagcgcttagtgattcgaggattcctcggttctgtcttaacagcaatccctgtagaacaagttcggaaagaattagtcgaagtaatcgaagggaagttgaatggatgatcgatgctaaaaagctacgcaatgattttcctatcttatttcaagacgtcaatgatgaacctttagtttatctggataatgcagcgacgacccaaaagccaaaacaagtactccaggcattagcgcactattacgaacacgataacgccaatgttcatcgcggtgtccatacgttagcagaacgcgcgacccatgattatgaacaagcaagagaaaaagtacgggcgttcatccatgcaaaagaaacagcagaagtgctgtttactcgtggtacgacgacaagcttgaattgggtagccagaagcttcggcgaccgctatatcaaagcaggagacgagatagtgctctcttacatggaacatcattctaatgttatcccgtggcagcagttggcaaaacgaacaggtgctgtcttgaaatatatcgaactaacagaagaaggcttcctggatatggaggatgcagcgaaaaagattacggacaaaaccaaaatcgtctccattgctcatgtatccaatgtcttaggtgtcatcaatcctgttcaagaattagctgaacttgtccatgaaaacggcggggtcatcgtagtagatggtgctcaatctgccccgcacatgaccattgatgttcaagcactagactgtgatttctttgctttcagcggacacaaaatgtgcggaccaacaggtatcggtgttttatatggtaaacgaaaatggttagaagaaatggaacctgttgaatttggtggcgaaatgatcgattttgtcgaattatacgacagtacatggaaagaactaccttggaaattcgaagcagggacaccaaatatcgctggcgctatcgcattaggtcatgcaatcgattatttgcaagaactcggcatggacaatatccatcgatatgaagaagaactagccgcttatgtgttgccaaaattacaagcaatcgatggattgactgtttatggtccgcaagacccgaattttcggacaggagtcattgcgttcaatttggatgggttacatccccatgatgtcgcgacagctttagacatggaaggggtagccgttagagcaggtcatcattgtgcgcaaccgctattgaagtaccttgaagtatcagcgactgctcgcgccagcttttatttctacaacacaacgcaagacgccgaccgtttagttgaagcaatcatggcaacaaaggagttttttcaacatgggactatctaaattagacaatttataccgtcaagtgatcttggatcattcttcccatccacatcatcgtggaagcttgactgactcgacaagcaagatcgaattgaacaaccccacatgtggagatgtgatcgaattgcaagttgatgtaaaagatggaatcatcaaaaatatcgcctttgacggcagcggctgttccatcagtacagcaagtgcctcgatgatgacagatgccgtcattggaaaatcaatagaagaagcagaacatttaactgtagactttctacagcttgtccaaggaaaagaagtcaaagatcccgaccaattaggcgatgctgctatgcttggtggtgtagctaaatttcccgctcggatcaaatgtgcgacacttgcctggaaagcactaggaaaagcaatggaaaacgatggtaccgcagctttccatcattaccacaaggaagaggagtgagaacatgggcgtaccagaactagaagaatataaattcgggtttcacgatgatgtcgaaccggttttcagtacaggagaaggcttgacagaagaagtgatccgtgagatgtcaagaatcaaaggcgaaccagaatggatgcttgaattccgtctgaaatctctagaaacatttaacaaaatgccaatgcaaacatggggccccgacctttcagacatcgatttcgatgccatcaaatattaccaaaaaccaagtgacaaacccgctcgtgactgggaagacgtaccagaaaaaatcaaagatacatttgaaaagattggtatcccagaagcagaacgagcttatctagccggtgcttccgcacaatatgaatcagaagtcgtgtaccataatatgaaagatgaattcgaaaagttaggaatcgtctttactgacactgactctgctttgaaagaataccctgaattattcaaagagtacttttcaaaacttgtaccgccaactgacaacaaattagcagcgctgaattcagccgtatggtcaggtggcacctttatttacgtgccaaaaggtgtcaaagtcgatgttccattacaaacttacttccggatcaatgcggaaaacacggggcaattcgaacgtacgctgatcatcgttgacgaaggagcaagcatccactatgtcgaaggttgtacggcacctacttattcaagtaatagcctgcatgccgccatcgtagaaatctttacaagaaaagatgcgtattgccgttacacaacaatccaaaactggtcagacaatgtgtacaacttagtaaccaaacgagcaaaagcatacgaaggcgcaaccgttgaatggattgacggaaacctaggtgcaaaaacaacgatgaaatacccaagtgtttacttagatggaaaaggcgcacgaggcaccatgctctccatcgcctttgcaggagcaaaccaaatccaagatacgggtgcaaaaatgatccacaatgcaccaaatacatctagctctatcgtctctaaatcaatctcaaaagacggcggagaagtaaactatcgaggacaagtaacctttgccaaaaacagtgcgggttcgatctctcatatcgaatgtgacacaatcattatggacgaatggtcgaaatccgatacgatcccattcaatgagatccacaacagccaagtctctttagaacacgaagccaaagtctcaaaaatctcagaagaacaactctactatctgatgagccgaggcctgaccgaatctgaagcaactgaaatgatcgtcatgggctttgttgaaccattcaccaaagaacttccaatggaatatgcagtcgaactcaaccgattgatcagttatgagatggaagggtctgtggggtaatatctatttcattgctcgaaacgttgatattaaagcgtttcgagcatttttttatttggattttaatgattggctacgtttagaattattcgctcataaattttgcgaatcggtcaccagttttcttaacagattgtggtgtgacatgagcatagatattcatggtagttttaatatctttgtgacttaatcgttcttgtacttcttttatcgaagcaccactttcaaacaataagctacagtgggtatgcctaaatccatatggagtaatttgaggctccatcggtgtctttttgtaaatccaatttaaccaatcggttactacttgagtatagtggatcttgtcttagtttgcagtgaataaaaactatttttgttaatatatattatatcaatgtcgaatcgttatgctcattctattatccgccacaaggagttttacaactgcttagaaatcagattactcgttcaaataataatgcaaattgaatcaataaaagaagcgttgaataagagctcattctttcaacgcttcttttattaggagattttaatgaccatatcaacttctctttcaggattaggtaattcatgaaagctagtgtttatagcgcttaattgatcaactaaccatgttttattttttgactcttagacgaatttaaaattaatatcattgttctcgtgttgaagaggtgtctccaaataatctggtgaatattcataatcaacttaacctgctaatacaaaagagggtaatccataatttagtgtcagatttaatggatggtcgtaagcttttattttttttaacgtcatattgtacatatcttcagccataaaagttgagtttgtgatttcatattgtgtttcattaaaaaaagttatccgaataatcgcttatttttgaaaagtctttattgacaccagcctcaaaaaattgttcaactttttcagtataaagttgtgctaacgctcctttttcaatattaactttgatattttcatgtctatcaatttgagtgctgttcagtaagggaagatcagcttttagttttatatcgtcttgatttctttcaatttcaatcggcaaaatcttttcaatagattcagtttctgataaagggacatctagttttttatcatggtaataagcttcaaatccatttggaaccggaaaaaaatgtattgggtaattcttttctgaggttgttgtactagtttccgtacttgtagaacttgtgtcagaagtggtacacccgcttatagttccgatgagtaaaacgcaggttaaaatgattgcaaatttcttcaaaaaaattcctccttaaaattgaatatggactaatactagtcccattgtagcataccaaatctttaacattaataagaaaaaggactaattttagtccaaaaggtgtgctattcttgaaagaggaaaaaattattgatagagaaaatgtaatcggtagcaatattagacgattccgagtagaaaaaggaatcggtcaaaccgagctagttagagacctacagcttagaaaaatcgctataactagggaaacattggttaagattgaaagcggccgccaacacattaagttggatcaattgagagctattagggatgttctacaggtgtcttatgaagacttgcttcaataactacttgtagtctttagtataagaagctatttttacacccttatgtatcacaaagaaatactggtataataatgaatgggatatgtaacgatagggtatactatattctcaacaggttatactgagaatccaattaaacgaaatcatttgaaagtatacaaaacgttgttggataaagcatatgaatttgtattttcagaacactttagattcttagaaaactatgatttacctagttcactggatgttggtattgaactatatgatggagtagaaaagaaaaatataaagttaaatttatcaaaagattatagcaaaaatagtccagtgttaagagagctagaaatgcaatgaatccaatgataatttatcttaatgtaaattgcttaactctaattgtttctcgtgattatgattttgctactgatgtatatgttgaagaaaataaaggcttgaagttagagcttactggatataatttgtcgcagcaattgatactattagtggggcggtaaactctttagcaaccacatacttctgaatataactttcaatcaatatctgtaggtgaagataatgttggacaattgtaagagtcttgttatcgtttaagaaattgaaggaggaatcttgctaattgatgaagtagacgcaggtctttttccagctgcacaaattgaatttttttatgtcttaacccaatttttttaagactagggtattcaggtgataatgacccaatactctccaacgatgattaaaaaagtttttatccaaagagatattaaaaactataaataaactatttaacgaatacttttggtaaaattcaagtgatgacagattaaagctggatatatatgcagatatgtatgtaaggacaaaaagttgatgaagatttaatactgcaaaaaataaatatttcaggaggtgtattttttgccaacaaccaactcccttttgaggtatctggcaggaaaaagtcaattgtataaatttgaaaaaaacaatagacaagagtattggagaatatgaaatttatatcgagatatcgagcattttgcagagggagccggggtggcccattcagctattaattcaaaagaatgtgaaaatgactgcaattaataatttagataaatctatgcgttctttatggtattcaatattaaattatcccaacaaatttatcaatctaattaacaaaaccattgtaaacattgaagaatggccaagacagaaagaaatttgtaaaaaagagtttaatcatcctttttctctagaggaagggtttgcgaccttcttcctaaatataacgaacgtaagtggtattactagcggtggacagatagaggggacaaaacaagaaagtaagtacaaggtaggttgttgctttaataagcaatctttaataaaaaaataagggatatttctttactaaaagattcaattaactaatatggatgttgaatcttatacagatggtatttcatttaattatccaaaagagaaaatgttcatttttttgagcctccatattttaatcaatgtaaaaaaatctttatttgaatttattgataaagataagcatagcattagggattattacttatgacaatccagatgaaatttattgagatttacaaagaatttcgctaaaaatataagtatatgcttagatattctgttaataataagcgtaaagaaaaagcttgggaatatcgttttactagttaaattacaaaaattgataattttgctaatgtagaacctttgaaactaattgataagtagctttttaccaaaagcacaccacgtaacttgaatacgattgaaaactaatcattaaaatttattattagcaaagtgattaatcctattcaaaaagcacctagcttcaattatcgtcaatgaacttaatttcatagctgaagaaaaatctgaataaagaaacgatggctgaacccttgatagataagggttcagctctttttaggaacttatgtcatagccacttttttacataaatcagctaattagagaacaaattttgtaatttgagatgatgaacttctaaaagacgttgatacagatcagtttcaaaatcgctgtaatgacaaaaatcaaggactgtatacttagaagaatcaagaccagcaggaatcagtagaggtgaaccaaagatgaaaaagtcatattcttcagtgatgggaagtgtgagtagctcgatatctacaaaggggattttctttcctaaattcaagatttcttcggaaatcagatgttcagagacgttaacaaacccaactttcaatttatagttttcatcgatttctgaataatacggataaagtaaactggtttgtagaaaggctaattcacttacgcatgatttcagccatgtatagttttttcgttgtgcgatttttttccaaaaaccttcgattttgattgtcaagatacgtaaaagtgggtatttatctttaatataagaagagataaatagtgtggtcaaaggaattttttgcttgaacatgctaaaattaccaattgatagatagagattcaaaagcaaagctggctctttttcaaactggagtgtaccaataaatgtctgacaatgcttctgaaattcctctaagatatctttgacctcattgctcggttgttcatacgaatgatgaacgatcggcacacgaatgtcttgattagaggtaagaagcggccagtaatagaataagtaaaacaaagagtttacctctaagatatctaaacgaagattcgcaattttgaagaagtcgtaaaaaaagtcaatgtttgtttcgcttggaataaaggaatctcttgataatctatagatatccgtaaaatgattattttcgatcctcagcaaacaaatcaggcaatggaggctggattgtttttttcctaaatcaaacttattcttgtgttgcgatccttcgtgcttataaatcaatgcacgaacttcttggctgtaaggaatgctatccaggctttcccctaatgaaacaaaccaaaagaaattgaaaaagatgatgcgaatcagcatttcagaaccagataaggtaagattcgataaattcaagttgatattgtattccttcaaatattcagccaatttttttgtttgccgaaaacacgttgagcggctgataaattggcgattgcaaaaagctgcaagattttcatcttgttcggtcagaagactgatcaataatttataaggaacactttctgttgataggtaatgttggtattggatatattgaacaagttgttcaggaatggataacttatttttattatgtaacagtttaatatcagtaaattgtcctaaatcatcttgtatatcacataggatttttttgaaacgagtcgcactgaaatagaaatctaagttttctcgtacatgatctaaactatattcccccggccgtaaggtcatcacctttccatacacgcttaatttcattctcgcatggtcatctaataaaattttttcaatcaattcttcaccttctttttatgtttttattattaataccgtatttattttttcttgtaaatacttgtctcgattttctaaaaaaactatacaggatttagaaatattttttttaaatttatctcaaaattaccacttaatgagtatattttgtgagagaaaagaataaataacctattttcaataactaattattagatatatttattaatctatctcaagtttaatttcctttaaaataacactgattgaatagttagagccaaaagagaagagaattagaaagattagtgaattttttctaaggaggtatccataaatgaagaagcgaaattattttatcgttttctgtctattttctctatttttcgtcacctatttccatatccaaaaaggggagactgtggcagccaatgaagaatcaaccatagaagtattaaacaatgaatacggcaaagtaagtattaggaaaatagatcatcagctaacgatcttgtatcgattaaatgcgcaaacgcaagaaacccgatttttattccagctacattcaaaagatgcacctgaaacgaatctgctttcctcttatgtttctcaggaatatcaagaatacacagatgaacaacaacgaaaatggctagcaggttatttttctcaaactattgaagaaaaagaatggaccattgagttgccgagtacgagcaaagaatttcaactcaatattcagatagaagaaaaaacgggtcagttacttttatccgaacctgtttccttttcattttctatagataataagaatcaggaaactgcacaaacaaatgaaaaaacgtctgaaacatcaacttcttatgaaaatcatgagatatcggatgattcatcgttagataaagacgaatatcgtccgtttgaacaaccacaattatttaatgcacagttgaaacctaaggggttagctacgattgaaccagaatataccacagatgagcaaggaacataccctaaggcaatgtggcaaccggataatagtcaatatgtgcgtaatcatcagggcaatcgccaaggacaacagcaatgggacgggctgaatgggtgggatggcaatccaaccaatcgcaacaattcttatattgaatatggtggggaaaaagaggatgccgattatgccatccgaaaatttgccaaagaaacagcgactcctggattgtttgacttgtatctgaatgttcgaggaaatactcaaaaaaatatcactcctcttgatctcgtattggtcgtagactggtctggaagtatgaacgacaataatcggatcggtgaagtaaagattggtgtcgatcgttttgtcgatactttagcagatagcggtatcacagacaaaatcaatatgggatatgtcggctactcaatcgaaggatatagctacagtaacggtgcagtacagatgggttcatttgattcagtgaaaaatcaagtaaaatccattacaccttcatggacaaatggtggtacttttacacaaaaagcactaagagatgcaggaaacatgctatccgttccaaatggacataaaaaagtgatcgttttgctgacggatggtgtaccaacattttcctataaagtacagcgggtacacgcacaatcaagcagcaattattacggaactcagttttctaatacgcaagatcggccgggaaatacttctctaatctcaagaatctatgatgcacctgaccaaaacaatctatccagaagaatcgacagtacgtttatcgcaaccatcggagaagcgatggcactcaaagaacgaggaatcgaaatacatggtcttggcatccaacttcaaagcgatccggcagctggtctctcaaaagcagaagtagagtctcgtatgcgacaaatggtttcatcagatgaaaaaggcgatctttactatgaatcagctgatcatgcaacagatatctctgaatacctagccaaaaaagctgtacagatctcagcaactgtaagcaatggacaaataaatgatccaatcgcagaaccattcatttatcagcctggtacactttcagtcaagagtgtggggacaagtcctacaacggtcactccatctatttccatagaaggaaataccatcaagagcaatcagatctatttaggaaaagaccaagaaatccaaatccattaccaagtgagaatccaaacagaaaatgaggacttccatccaaatttctggtatcaaatgaacggcaggacaactttccagccaaacattgataccaatgaattagctgaattcggtataccatctgctaaagctcccggagtcagtcttcacatcaaaaagttatgggaagaatttgacaacaatctagctgatcgtccagatcaagttacttttgagattcaacgggaacatacgacaaatgctgcagcttggaaaaacggatatatccgcatcattaaaccagctaaagatacaacaaatacgtgggaacgtgcagacattgacaaattatctgcaaatagcggagaaagttatcaagagatattatcactacctcaatacaataatcaaggtcaagcattcagttaccaaacaatcaaagaattacctgtaccaggatacgattctcaacaaatagatgcaatgacatggaaaaatactaaacaattcacaccgttaaacttgaaaataacgaaaaattcctctacaggtgaaaaggatcttattggcgctgttttcaaattaacaggagattctattgatactttactaacagatcatggcgacggaacctattctcttccagaaaatgtcaaattgcaaaaagaaatgacttatacactgacagaaacaaaagctccagaagggcatgaattaagcaaaaagactacttgggaaatcaagattgcttctgatggtacggtaaccattgatggaaaaacagtcactacttccgatgatacgatccagttgaccattgaaaatccttttgttgaaattcctgtagcagtacgtaagtatacgatgcaagggacggacaaagagataaatcttaaaggagcagcattttccctacagaaaaaagaagcaaatggtacttatcagccaattgacagccaaacaacgaatgaaaaaggtcttgccagttttgattcactcacacctggtaaataccgagtcgttgaaacagctggtcctgccggatatgatacttcgccgggaaattatgaattccaaatcgataaatatggaaaaatcatttacacgggaaaaaataccgagatgacaaataatgtatggacgctcactcatcaaaatcgactaaaagcgtttgatctaacggtacacaaaaaagaagacaacggacagacattaaaaggagcaaaattcagactgcagggaccagaaatggacttagaatcgccaaaagatggacaagaaacagatacctttctattcgaaaatttaaaacctggaacttatacgctgaccgaaacttttacaccagaaggataccaaggtctaaaagagccagttactatagttatacacgaagatgggtcaattcaagtggatggacaagatcatgaatctgttctgtcaccaggagccaaaaacaaccagatttctttagacatcacgaatcaggcaaaagtaccattacctgaaacgggaggaattggccgtttaggaatctatctagtagggatgattggttgtgcgttttctatttggtatctttttttgaaaaaagaaagagggggcagctaaatatgaaaaaacttggttggcttagtatgtgtctcttcttgttactatttaaaccagcttttactcaggcagcaacagaaacagaaacagaaatggttcagattactttacacaaattgcttttcccaaacgggcaactgccgaaaaatcatccaaatgacggacaagaaaaagcgttattacaaacgtatcgaggattaaatggtgtcacattccaagtttatgatgtcacagattctttttaccatctacgggaaaagggcaaaacggtagaagaagcacaaacagagatcgcaaaaaacggtgcgtcttccggtacgtttaccgcagaagcaacaactacaactcttaacaacgaagatggtatcgcttctttttctctggccgctaaagatcaagaaaaaagagataaagcgtatcttttcattgaatccaaagcaccagaagtcgtcaaagaaaaggcagagaatatggtagttgttcttcctgtacatggacaaaacaatcaaaaactttcaactatccatttgtatcctaaaaatgaagaaaacgactaccctgatccaccttttgagaaggtattagaagagcctagaaatgattttacgattggtgaaaaaatcacttattccttgcatacgacaattcctgtaaatatccttgactatcaaaagttcgaattgtcagatagtgcggatgaagcattaacgtttttacctaatagtttaacgatttcatcgaatggagaaaagctgacagaaggctttgtcatacacaagaaacctcacggatttgatgttttattttcgatcccttcgttggaaaaatatgctggaaaaaaactgaccatttcttatcagatgcagctaagcagtacagcacaggcgaacaaggaaatcaacaacaacggaacactggattttggttttggtatcagtacaaagaaagtctctgtatatacagggagtaagcaatttgtcaaaatcgagacaaataaaccagataaacgattagctggcgcagtattccttattaaaaacaaagcaggaaattacctccagcaaacagccaacggatacaagtggacaaagaacgaatcagatgcgcttcacctgatttccgataaaaatggcgctttttcaatttccgggttgaaaacaggaagttatcgattaaaagagatcgaagcaccttctggttatattttaagtgaaacagaaattccgtttaccatttcaacttttctttctgaggataaagaggcggacagtatattgaaagtagtcaataaaaaagaaaatagccgtccatttcttccaaaaacaaacgaaacgaaaaatacacttttaggcgttgttggtatggtattcgcaagctttgcaatctggttgtttatcaaaaaaagaacaggagtgaaaaaatgaaaaatcataaaaaaataaacgttatgttaggagtccttttccttattttaccattactcacaaacagcttcggcgcaaaaaaagtgtttgcagaggagacagcagctcaagtcatccttcataaaaagaaaatgactgatttacccgatcctttaatccaaaacagcgggaaagaaatgagcgaattcgatcaataccaaggattagccgatatttcattttcagtttataacgtcactcaagaattttatgcgcaacgagataaaggagcgtccgtggatgcagcaaaacaagcagtccagtctttgactcctggtacaccagttgcttcaggaacgacagatgctgatggaaatgtcactttatctttacctaaaaaacaaaatgggaaagatgcagtctacacgatcaaagaagaaccaaaagacggagtgtcagctgccgcaaacatggttttagctttccctgtatatgagatgatcaaacaagcagatggctcttataaatacgggacagaagaactagatactatccatctctaccctaaaaatacagtcggtaatgatggaacgttgaaagttacaaaaatcggtactgccgaaaacgaagcactaaatggagcagaatttattatttctaaagaagaaggaagaccaagcgtcaaaaaatacatccaaagtgtcacagatggattgtacacttggacaacggatcaaaccaaagccaaacatttcattactggtcattcttatgacatcggcaacaatgactttgccgaggcaacgattgaaaaaggtcagttgatcgtcaatcatttagaggttggaaaatataatttagaagaagtaaaagctcttgataatgcggaaatgattgataatcaaacaaacacgccgtttgagatcttggcaaatagtcaaactcctgtagaaaagacaatcaaaaatgatacgtccaaagttgataagacaactccacaattgaatggaaaagatgtcgcaatcggagaaaaaatccaatatgagatctctgtcaatattcctttaggtatcgctgataaagaaggaacacaaaacaagtacacgacatttaaactcattgatactcatgacgccgctttgacatttgatcatgaaacttcaggaacgtatgcgtatgtcttgtatgatggggataaagaaatcgatccaacaaattattctgtcactgaacaaacaaacggattcacggtttcagttgactcgaattatattccttcactcactcctggtggtacgctgaaatttgtttactatttatcaaaagaattgtcataacctaaaaaagacactgctaagcaaaagcagtgccttgaaatattttatttaaataacacaaaaacataattactcataagaaaccaattctgtattatctaccatgaatgtaaagaacccctcattaggcatcggatgaaaataagcattgatcactcttatcaaggcattatggcaaactaacagatagacattttcttcgtcttcgatgcattctttcaataaaggaacgatccgtgcatacacatctaagactgactccccatttgggaatcgtacagcgaacgctaaacgtgctttttgaaagttctcatctttgcttggcagtccatcataatccccaaaatccatttctaccaatcgttcatcaacggtcagcggcaagctgagacgatcagcaactgcttgtgctgtatctcttgctcgttgaagaggggaatggatgattttcgtgattggaacaggcaaatctactaccttttctgctagtttctgtgcctgcatctgtcctttttcagtcagcggcacatctgcccgtccgcaaactaatccttgtgcgttccaagttgtttctccgtgtctcgttacataaagcatgtgattctctccttcgttggcaaagttccccttaaccataccttgttgttcttgagattacaagggttagattctctcaagagaaataatctcagtagatactttatccaggaaggtttgatcatgttccactagtaacatggcaggtttcacgttcaagatcagttgttctaattgttcttgattgaagacatccaaataattcaatggttcatcccatgtatatagttcagctggctgtgataaagatttagccaattccacttttttccgttggcccatactcatctgctcgatcttgttatgaaaaacatctctttccatcccaagctttcggaggttgttcaaaaatgcttggtagtctacttggtttttctctgcaaattccgccaacgttcctcgattgtcttcataattttggcttgcataactaatgctcagatgttttggctggtatttttctcctataaccttgccgttgaatgcccccagaagataatggataatggatgactttcctgcaccgttaggacctgaaatcgccacccgctgatgaggctcgattgtaaaatgaattggctcgaataacagattttcataccctaattgaagatcttctacgcttaaaagtcgcttatggtgagacgcttggctattcatcgtcaaagaatcgatatattcgatatcttttaatagtttttctttctcgctgatctgggtctccatccgattcacgattgctttggatcgtttcatcgtccgtgcagcatcagcacccactgctcctttattcactcgtctagattcagtatcgatgaatccgacttgtttctttgttttatctccttctcgggaacgagaccattcggctttttcagctgctgttttctttagcctactgacttcttttttcaatttttcattttgagccatttcaaattcatcacgaagttttttctgttcttcatagatagagaaattcccttgataaagttccagttgacttttttcgattgctaaaacatggtccactacttcatcgataaatccccggtcatggctgaccacgatgaagccttgttttttctttttcaaataagccgctacttgttttctaccagagatatccaaatgattcgttggttcatcgattaacgggaaatgagtgtcatccacaaataaaagtgccagtaggacttttgtcttctctccccccgatagtgtgctgaattctctccataagatttcaggatctgtttgcatcaattggagctctctttcgatttcccatatctcaaaatccgtaatatcatttaacacgtaataggttaaacgttctttatcttttgtctgttgcgggaaataggcaaattcttgctgatggattacttgcccttgataaggtagtttgttttgtagaatattcagtaaagttgtctttcctcgaccgtttcgtccgataagtcctagtttccattgtgtgtcaaaatttagatttgcttgttcaaataataatgtgccttggctgtcgtagccgaatgtcagattttttatttcgattttagacattttccatcacctcgtaaaaaaagaccagtcctattttcagaactggctaaagaggatgcaagggttggatacacacaaaaagacccatacatcgaaaaaaccaagccaatcccgaaaatctgcacactgcttccttgtctccacaaggtacagtctgaatgcagctttcatcaatcgacttaatttttcaatgcacggatccctcactttgtcctatatttgaaattacgatagcataaagaaaatgattttgtcaactacttcgggaggatggtgaaaaatctgctaagtgtctgtcctaagatttttgttttttctaatgtttgcctgtgttccattgcttcttctaaacctattggacccaaatgaatacttaagacaattgggagaaaatcagaaagtccttctagctcttggtctctacttccgcaaatagcgattattggttttcgatatttttttgcaagcactgctacaccgtatggaacttttccgtggatcgtttgctgatcgatccgcccttctcctgtaatgatgacatctgcttgttcgatctttttttccaatccagtgatttggctgactaaatcgaaaccagaaaccatcttcgctcccaacaaaaaaagggctccaccaataccgcctgctgctccacttcctggaatatcatctaaatccacctcccagaaatcttttatttgctgagcaatctttcctgcttgtttatctaagaaagctagcgtcgtatctattcctcctttttgtcttccaaattgccaagcagctccttgttgacctgtatatggattggtaacatctgcagcgataatcaattttactttagaaacaagaacgtttcttcgatcaaaatgaagttttttagtagataataaaggatttccttctgtgtacccttctaaagaagcacccaaggattggagtaatcctagaccaccatcgctacacccgcttcctcctaaagtgacaataatttgttctacttcttgaagcagtgcatctttaataagttctcctaaggcataactggaagcaagtcggatagtttgatccgttggtttatcaagtagatctaaccccaatgcttgtgcagattcgatgactgcggtgttttttccttgccaagttgtcaataaatagctgatttttcgctgacggaataagagatccatcccatcaatggtacgccatgttcccctgagcgcgtaatagattgcttctgcagtattttctccgccatctgcaatcggcacattgatttttcttcctttacgatcttcccagccatttagaactgcctgatttagttcaaatgaagaagcacttcctttaaatgaatcaattgccgccaaaatatccatctgtatccctcactttcttcttaagtaagacactttttttcatttttttcaaacaaaacaatgctattttcttccatttttctatatactaaaagggaactcattgaataaaggagagaaaaaacatgaaaatcgcaatagctggggccggagcaatgggcagccgaatcggattgatgctacatcaaagcggaaatgaggtcctcttgatcgatcgttggcctgctcacattgaagccattcgtacaaatgggttgattgctgactttaacggtaaagaagtggtcgcaaaactgccaatctattcaccagaagaaatcatcgaaagcaacgaacacgtagacttgatcgtagcattaacaaaagccaatcaattagatgatatgttttgttcgatccaatccattattactgacaatacttatgttttgtgtttactaaatggattaggtcatgaagatgtactggaaaaatatgtgccaaagaaaaatatcttatttgggatcacgatgtggacagctggtctagctggtcccggaaaagtcacattgttaggtgatggagaaatcgaactagagaacttggaaccagaaggcgaagcatttacaaaaaaagttgtagaagtctttcaagaagcaaatttaaatccgatctatagccataacgttcgttattccatttggcgaaaagcttgtgtaaatggaacattgaatggtttatgcacgattttggattgtaatattgctgaactaggcgcgcaaaaagcggcagagagcatggttcgaacaatcgtatctgaatttgcttctatcgcagcaaaagaaggaatcatactagatcaagaagaagtgtaccaacatattgcttctacttatgatcctgacaacatcgggttgcattacccatctatgtaccaagacctgatcaaaaaccatcgtttgactgaaatcgactacatcaatggtgccatttggcgaaaaggacaaaaatatgatattgctacaccatattgtgcctttttgacccaattagtccatgcaaaagaaggaatccttggcgcagaataaaaggctctctgatgagaatcagctgaatcagcagctggttctctttttttaagcccaataaaagatcaaaaagaaaacacaactctcatgatgccataagaattgtgcttgtttgtttcagtacataatctcttcaaaatgtaggttttttatttgttttcaacagaggagaggtcatattcgtattgctcataaatagtggaatcgttagtgataaatcgttttgcccaattttctgcatcataaaattccaatagctctgataggattggcttaaatggtgtatgcagaaattccggtaattcatctaaatcacgttctcgaagcaaaaaaatattttcaggacgataaaaatgataatgagcaatcgcttgattatccgtcactagtttcttttgaaaatacatggattcaaatgtccgcaaagtcactccttgctgaccctcccgcaacagttccagaatcccgcgcgattcccctgtttttttcaggtactcttcataagtaagatatccaggttgttcattccctcgatgtggaagaatgaaatagttggtcgtaacatctctttttataaattcctgcttatagctttctgctcgttcttttctcccattattcgttgcaccaaaaaatagatccgtctttggttcgctagaagaaaaattcatatgtttcgaataaaatgaactattatgtttcagcccaagttcttttgcttccaaaaaatcaaaatgataaatctcatcgattgccggttcatcttgtgcctgcttcagcatcgcctcgtgttctgctttgaagtgattccaaaaaaataacacaatttttgcattggtaaatgggcgcacgcgtcgagccatctccatatcaaatccataatctaaaaaaacgatcagctgataatttgccaactgttgtctagctgatttaatgaattccgactgtagtaaatcttttccggaccaaacatctaaagagcggatggaaggcaaaaaataaagtgatttattttttgcaactagcagtacgtcatttttgttcatcttttccgcctcactttctctgtcactttttcctatgatagcctgtttaaatagtaaaaagccagtaaaacgtttcctatatttgtatgaaaatttaacatttgtatgaaaatatgatgaaataaatcattcttctattaaaattcgcctaaaagttttctgaatagttgtaattgtctgaaaatttgttatcattagtcattgttaaatattgctatttattcttaatataaattttgattgtgaatttaaaagaaagaggtcatttatggaagataaaaaattgaaaaaacaacttagctccagacatatcaccatgttagctttaggtggagcaatcggtgcaggtctatttaaaggaagtggcgaagcgattgggatcgccggcccttctgtattgattgcttttttgattggtgggctgattttatatatcgtgatgaaaggtctgggaaaaatcgttttaagcggtggcgacacgcatcacggattatctggtttgatacgcccttatctaggtgctcattctgctgattttactgattgggtctactggtctatgtggattatcaatatcatcgctgaagctgttgcagctgcttcctttttgcagttgtggttcccgcacattccagcctgggtatttgtttttatgttggctgttttaactacgatcatcaatctttattcggtacggttattcgcagaaacagaatattggctggcttttgctaaaatcagtgtcattatcttactgatcatttttgctacttatcttgtcggtcagcaaatgttgggcacaggcgttttccctacccttcagcaattgactgaccatggtgggtttactcctcatggtatgaagggaatcatcagttctttgcttgtagttatctattcttacggcggttctgaactgattgctatcacggtaagcgaagcagatgatcctaaacgtgcgattcctaaagcaatcaaaggtgtcatgggaagaatcatttccttttacatcattcctttgtttttgcttttgattctttttccttggaatactttagcaggcacgaatgtcagtccttttgtgatggtatttgaaaaaatgaatatcccatttgcagcggatatcgtcaattttgtgattgtccttgctttgttctcatctatcaattcgggtgtgtatgcatcttcaagaattttgttcttccgtttgaaggatcgaaaaggttcctctagaaaactagctgttttaaacaagcatcaagtaccgcaacgtgctgttttattttgtaccagtgttctttatcttggtgtagctctttcttattttgtcggtgacaaattatttggctatctggcaggttccctttcgtatacagtattattgatctggatcattatcagtgcggcatcctttgtactggcactaagaaaaggaacattatgggataaaggaatcagcttttttgcattagctgtcttaggattgattttccttggtatcctgttcacgaactccattggggtaactgtattgactggcctgctttacctgttcatttatttcagttatcaaaaaaagaatgatgcgttcgtattgacgaatgaatgaaatcgatagaaaattttattttatttatgtggaatagatggagctattgaagaaaggagttgtgacaaaagtcttgttgcaactcctttttccgaataaacagtctcatgacctcttggtaaacggtattcaaaaaccctctgtgcaaaataattgattgttctccatgctcatgacatgatagaagaaaggaatgaaaaaaaggagtttgttttaaatgaaaaagtattggaagtttttgttgatgatcggtgtttcaacggtagttatgtttggtatgatgtacttgaatgtctatgcgctcgatcatatcttcttcagtcgtacacgagtattcatggcgttgatgatgggtgcagtcatggcagtcatcatgctgttgttcatgtggaaaatgtatgaaaacaaaaagataaatgttatgatcttagccgctagtcttcttgtttttgccggttccttgtttatggtacgaagccaaactactgtcaacgacacagcttggatgaaggccatgattcctcatcattctatcgctatcctggcaagtaaacgagctgatttaaaagatcctgaagtaaaaaaattagcggaagaaatcattcaggcacaagaagaagagatcgacaaaatgaaaaaaatgatcaaagaaatggaatgaccattatccgtccaaataaaaaaagaggatgttccagaagttatcagcttcaagaaataagaagaagctacttctggaacgccgtgaataaggggttgtgaaaaagctgccctgcatcaagtaataagaacagccaaacaaaaatagcttctcctatttttcgtttggttaggcttattaccgcagatgcaagcttttgaacaccgtttattaagaggttgtaaaatcagcgttctgacctgagtattagagagacaaatggaaaaatagttcctcatattttgccattttttgagctaataccgagggtcagctgattgaacaccgtttatcgagaggttgtgaaaaagtcgcttagtttcgcgtattaagaaaaattttgtgaaatggctttccacatttttgtataaatttggcttaataccgagaaactggcttttgaataccgtttattcgtaaaagggattgtgacaaaagtcttgtcacaatccctttttatatttttattgttctaattgcgctgtcttgcttactgcttcttgcggtttcacaaatttttttgagattccccaacctgtgaaggcactgaccatcgaaaacacaggagaaagcaaactgaaaaatacgaatggcaagtaagtgagtgtaggaataccaaatgtacttgctacgaaacttccggcaattccccaaggcactaagtagttgattactgttccaccatcttctagcgttctacctaatacagttggatcaaatcctgctttttcataagtttctttaaatgcattaccaggcagaataacagataggaattgttcaccaataaaaatatttactccgatacttgtcatcaatgttgtaaaaatcaaatttggtgtgttcgtcatctttcttgatactcgttccatcacggttgagatcaagccaaattcgatcaacaatccacctaatgacaaagttagaataatcaatgacacagtaggcatcatactttcgattcctccgcggctaagcagtgaatcgatttgttggtttccagtatttgaaacaaaccctgattcgatgaccccagccaacttcgttaaggaagtttgtgggttttgaataaaaatcattcctactgctacagcgatattcaacaaaatcgttaaaattgccggcacctttttccatgcacacagtaacattaaaaataaaggaatcagtgaccagattgaaatagtaaagtttgcttctagaacatcagtcacttcacgaatagatgaaagacttgcggctttacttgtgtgtcctaaaatcatgaataaaaagaaagaaacaacaaatgccgggacagttgaccacatcatatgcttgatgtgtttgaacaaatcggcatcaacaatagctgctgctagatttgttgattcggataatggagacatcttatctccaaaaacggcacctgaaacaatagctccaacaaccagcgctggatttaagcctagtgttgtcccaataccgaaaaatgcaatcccaatcgttgacataacagtaaaggcactccctacagcgctacctacgattgcacacacaacaaatacagaagggacaaaccactggacactgatcaatttgaacccaatgaccattagagttggaatgatccctgcttgtatccatacagcaatcaatgaaccgactaaaataaaaataaagattgggatgattcctggtttgatgccattgatgattccttcgttcagccaatctgtcgggtatctttttatcactgcatacaacatgaccattccgatcgctgctaagatcgtgatattaggtgagacctttaatccgacaacgccaatcgcaatgcctaaaacaataaccattaatacaagtgttgcttctaaaaaacttggtgttcctttttttcccatgataatctctccttttttagttgttcttatgttctaaaaaagttaagatatcggattactccgccgcaattcatccgcgattcctcctttataaaaataaaaagacctgttttaaactaaggacgaatgactccgcggtaccaccttaattaaaaacagatctgtttttcactttcaaacttttattcaaatgtatggactttccatgtaattcgtcaattaggcttgatcggttcacagcgaccaccgactttctgaacaaaacacctaaccgctactgcgtgaaaagttgacttgtacgaagtttaccttccataagatcatttgtcaatgaaaaagaaaatattttttcatttttctgaaaattatttttataactttcacacacaagtttattttttactagaaagtagcaccctcttgtttttttcttgctactatttcttgatgttcttgcttgattctttctaatagctttggctctttcaacagatcaagagctgtattggcgagtagttctgctgcaatcgcaatagaagcaaggcctttgtcacttttagcagcagctttgaattcttctgtgtgtccggcaatatatgtctcagagattgctaccgtaggctggattgttggtatgacttggctgacatttcctacatcagaagaaccgagacttgttctttgttccgtttctatttcttcatctggaacacctgcttcttttgcatgctggaagaataagtcatcaaaagaaggagtaacgatgacatcatcaactgcattttggaacaatccaaactcaaaagtcgtgcccgtacttatcgcagcacctcgtacgatattttccactttttcatatactttatctaatgtttgccgatttcctgcacgtaaatagaaacgtccagcagcgtaatctggaatgacgttggcagctactcctccgtctgtaatgatcccatggatattgacatcttttggcaattgcaagcgtagagcgttgattccattaaacacttggatcaatgcttccaaagcatttactcctttttcaggtgctgctgctgcatgggaagcgacaccgtaaaatttgatgtcgactggatcattcgctaaagattctgtcgttttcccataacgaaaagctggatggacgcataacgctacatcgacatcctcaaaaaaaccttctcgaacaaagctgcctttagctgatccgttctcgcccccttcttcccctggggtgccatatacacggatttctccaccagtttcatcaatgaattgcttcactatgctggcggctaatacggagtaagtaccaaacaaattatgcccgcatgcatgaccaatacctggtaaagcatcgaattctgccaaaaaggcaattgtgggaccgggtttattggaaatataacgtgcatcaaaggctgttcggtgtccagctacttctttttctacccaaaacctttctttttctaattgtttaatcaacgctgctgaggaataaaactcatagttacttacttcaggatgttcgtggatatctagagcaagtgcttgatattctggtaaacgatattggattagatccttcaattggtttgttgagattgttgttgtcataaaaaattcctcctatgctagtcatttttcttattttctcccgaatgtttcccatgcaggcacgcttgatccttttgatgttttctcgattactttgactgtgtcttctgtttgataagcgtctactattttttgatacgttttattgttttcatcttcttttcttgcaacgatgatattcacataaggacgtgcatggtcatccactggttctaagaagatggcatcagaagcaggattaaatccagcatctacagctacaccgctattgatcactgaaatgtctacatctgacaaagcacgtgctgtttgggaagcatctaattcagaaatgtctagattttttctattctcggtaatatcagaaacagtgggcgcttgtccttttgccttatccactttgatcaatccagcagtttgcaataacagaagagctctgccgccatttgtaacatcattagggattgctacttttgctccgtctttgatatcagctacatccttcaaagtgttagaataaattcccagcggtgcattgacagtatttccgatcgatactaaatcagttccgtgttctttattgtaattgtctaaaaagaattgatgttggaaagaattcaaatcaatcgatccatctgctaaagccacatttggttgattgtaatctgtaaatttcacgtattccaaattaatgttctcctttttcaaacggtctttcacgttgtcccatacatctgtatcttctccaataatccctagttttacgatagtttcttttttgtcagttgtatctgcttttccttggctacaccctgccaaccaaataattgctacaaatgtaatgactacaaaacgaataatttttttcattttttctcctccactttcaatgtgtaatttttttaatcagttgattactgataaattgacttaaaaaaactaagattagaatcaataatgtagccacaatcgttacatctgtttggaatcgattataccctctcgatatagcaagattccctaatccgcctgcacctactgctccagccatggtagtcagtccgatcacgttgatgatagtcaacgccgagacccgaatgataccaggcaaaccttctaacaaatacacacgtaaaatgataccgattggactggttcccatcgcttctgccgcttcgatcaccccaggatcaacttctagcagtgcgttctcgatttgacgagcaaaaaacggaacaactccaaaaatcaatggcactaaagctgctttcgcaccaatcgtcgttccaactaagaaacgagtagtcaatgctaaaagagaaagcaagataatgaaagggatggaacgaatgatattgatcagcttatcaagtatttcaaatagcagacggttagctagtaatccattagggcgtgtcactactaacgtcacacctaagatgattccaatcatcccgccaatgaatgctgtccaaaaagacatatatagtgtttgcttcgtcgcttcgacaaattcatccggaatcaaataaacattgggcaaatatgttttaaagaaatcagtcattttatcttcctccttcgatcactttgatacgactatctaattcgtttttttgtaaaatatttatttttacaccagatttgatcaaataatccaatgcttttttccgctgtttggtttctccagctaaagtaacgatcaaactccctaacggcgtttcttgtaataactctacattgccatataaaatattcgctgttacttgatatttgctgtacagatgagcgattagaggttcgttcgtctgatttccaatataacttaattccaccagccatttattggcgatctgatcggcaaaagcagaatgggcaatgatcgtttctaatgcttggtcaagatgagtagctgttcgaataaaatctttggtcaattcttcttcaggattgctgaagatctggatgctgctacctttttcaacgattcttccatcttccataaccgctaccttgttgcagatttctttgacaacttgcatctcatgagtgatcaggacgattgttaaacctaactggcgattcaatttttttaacaatgcaaggatctgaagggtcgttttcggatcaagtgcactggttgcttcatcacataataataccttaggttcattcgccaaagctcgtgcgattgctactcgttgtttttgtccccccgacagttgtttaggataagcagatgctttttcttccaaaccgacaagttccagtagttcattcactttttgacgacgttcctgtttcgattttccagaatactttaaagaaaaatcaacgttgtcaaaaatagttcggctttccattagattgaaatgctgaaagatcataccgatggcctttctttcttttcgcaattctttgggagagagctgactcaaattcgtctgattgacaatgacttctcctgctgttggtttctgcagcaaattcatcacacgaactaacgtacttttccctgcacctgagtaaccgacgattccataaacatcgcctttttcaatcgttaaatctacagaatctactgcctgtatctctttttctttttgtttgaaacatacagaaacatctcgcaattcaatcattaaaattcctccttatctaaaaaaagcgtcctcaagaaaatgaaaatgtcattttcttgaggacgcttttttgcgtgttaccacctcatgttcaagctgtgttcacacacaactcctcttcaagtacgatcatactctagcaagatatcggtcgcagccgtcatcgccttacatctatgctcgggatgaattgctcgatggccattttccaatagtcgttccttgcttcttctcagctaccgaagctctctgtcaaaggttcttctatcgtacttaccatttcaatgcaaataatattcaaaaaaaaagtccttttactaacataaactatgtcagtaaaaggacgacgtatcgcggtaccaccttttttcggaagtttccttccctcaagcccaacatctcaaaaagagagattggcgttcgttttaacggtcgaacagttccgaatttgcctacttatcgacaaattattctccaaggccattttcagcttttcttacttgactcttctcaccagccagagcctctctgcaaagtttccaaacttactttccttttcaacgaaatcgatattttgttgttgggattaatctacatgaggaaaactgaaaagtcaagtacgaaattcaaattattttttctatatttatttttctgtttttttatttaacatttcaataacagttcgaagatcttttccttccgcaagaagtttcaatttttccttttcttcgacggtataatttcggacaaaactggaatcaggtatcaaaacaacgcctaatcctgctcgtgaagcagctgttgctcctactaaagaatcttccactgcaaatgctgaactagcttctaatcctgttcgttccaaagctgtcagataaggaatcggtgaaggcttgttctccgacacttcgtctccgaatgtaaacgtgtcaaagtaatcagctaatttaaagtgatccaagatatctgttgctcttttcgtaacagtggtcgtagcaatgcctagtttcatatgacgttcttttaagtctgccaatatttcttttgcatatggttttaagtggatggctccgcttgtcagctgttgataaaaatattcttcacgcttcgctcggacttcctgtactttttcagggctacctgctgctttcactaaaatatcaaaactttgtttccagttttttccccccaagcgtcaacgatttcttttgggatatggatatcaaattgctgaaatccccaaagccagccatcacgatacgttttttctgtgtcaactaacaaaccatctaaatcaaatattgcacctttcatctatacattaatcctttccaaaacaatacacatagtttagcacgactggtccaaaaagaacagaagcaaagaaccagccttctcgtttataagagttcttggaatcgacggatatagattttcttcacagctgtcacaagcgccagataagcgatgactgtagcaaataaccataaccagtaattgccaggaagtggcatcaagcctaattcagcaccaaaacttgtaaaaggaaggacagaaccgacaataattcctaatgtagtgataacaaacatggcaaatgttgcgttgctttggataaatggtactttcggtgtacgcagtgcatggagcactaaagtttgtgtccatagtgattcgacaaaccatcctgcatggaataatgcgatgaaaatcactcgctgtgaactatccaatgtatggaaacttccgcccactacagcaggacaaataacaaaatacatcaacaagtaagtagtaatatcaaatatcgaacttgttggaccaaagtaaaccatgaatcccccaatactagatgcattccatttttttggctcgtccaaatattctttatccatccgatcccatggcaaggaaatgcaggaaacatcatagatcagattcaaaaacaaaagttgtaaaggcagcattggtaaaaatggcaggaacgtacttgcaatcagcacggaaaacatattgccaaaattagaacttgctgtagccttgatatatttcatgatattcccaaaagtttctcgtccagaaagaaggcctctttccaaaatcgtcaaatctttttctaaaaggatcacgtctgcagattctttcgcaatatccacagctgtatctacagaaataccgatatcagccactttcattgcaggagcgtcattgataccatctcctaaaaatccgacagtatgaccatttttacgtaaagctgtcgtcaaacgtgctttttgctgaggattcaattttacgaatacttcatggtcttcagctacttgtgctaattcatgatcactcatttccgagattttctcaccggtaaccaattcattgatctctagacctacttgacggcacactgaacgtgtaactaattcgttgtccccagtcagaacttttacagctacaccatgttctttcagagctttcaacgcttgtttcgttgtttcttttggtggatcaaggaaagcaagataaccaatcaaaaccatgtctgactcatctttgactgaaaattctccaacgacgcttggattggtcttttgtgcgacaccaatcactcgtaagccatcttcattaagtgactgtacttttgcaagtacggcttcttttcgttcttttgttaatggtgtaacagtaccgccaagatcaataaatttagaaatgttcagcatttcttcaatcgcgccttttgtgatcatttgtgttttaccagctggatcagcaaccacaacactcatacgacgacgttcaaaatcaaaaggaatttcatccactttttgataattgatcttatctgtatctaaagtttctgttgcttcatcaatgatagccacatctaacaaatttttcagccctgtttgatagtagctatttagatacgcatggcgcaaaacacgatcatcttcatttccttcacaatccatatgatattcaagaatgattttatcttgtgtcaatgtccccgttttatccgtacataacacatcgattgcaccaaagttctggatggcattcaaatttttgatcactgttccttttttggccatcacacttgctcctttgaccaaattcgtcgtaacgatcattggaagcatttcaggtgttagaccaactgctacagatagtccaaaaagaaaagcttctagccaatccccttttgtaagcccattgatgacgataactgctggagccatcaatgacataaatttgatcagtagcatggatgttttatggatgcctaattcaaagcttgattgaattggtttttcagatagcgtttctgctacatgaccaaatagtgtttcatttccaacagaaacaatgattccttccgcacttccactgatgacattacttcccataaagacaagattttcgtaacttgtttcgctttgctgatcgtcttcacatactttcgcatgcttttctactggatagctttcccctgtcaatgctgcttgggaaatgaataaatcctttgcggacaataaacgcatatccgctggtatcatatcccctgctgaaagccgaacaagatctccacagacgatttcttccataggaatctctgtgtactttccattacgttttacagctgccgttactttcacaagtgatttcagtttttcagccgcttgattggaacgtacggactgaatcaacgtcattgtcccgctgacgataaccatagtgaagataatggctacaccgaaaagatctttatctccaggagctgctaatacatattccgtgatgaatgaaataattcctaatgcgatcaacactaatgtaaatggcgtgatgtatgctttcaatatttctacaatgaatggtgtttttttgccatatgaaatcgcattttcaccgtaattttctcttgaacgttcgatttgttcttctgtcaatccatttgctgatgcatggaatagttcaaataattcttgtttcgtttttccagcaaaagctgcatagattttttgtgtatctttctttttttccatctcaatctctcctttgtgtccaaaagacagctgttctcgctgcttttggtctttagctattcatcggatcgatagagaaaaaactgaaaggggctgagaacagatagataatagccctggcctttcctctagatccttgtttttcgaatgactgtcatccatttgttctcatctcctttactaagtaattttaattcatgacttccaatcatttttcgaatagttatttttccaattagaccacctcctttttatttttcaccgatggggatttgcggcaacaaaaaaacctctcgccaaatactcagcgaaaggtttgaaaaagcatattaaaaaaagcttctcagatctcatcgttgagttttgacactgtacaacgtaaaaagcagatacctgcttttagctaccttatgaaaagccttatctcgacaattcctgttctacccattggcgtctctcgacgtttttgggcagtagcctatgtttgtataggagcctcacctaacaaatcttattcggttttccttcgttaatataacaactaaaaaagaggatgtcaaatcaattttccatgtttttcatactttttttaaaatacacacgttatattcctgtctcacgcggttttatttgtctcattttccacctcccgctataatagaaatatagtaggaaatgaggtgctgttatggaaagaacacttgttattatcaagccagacggcgtgagacgccatttagtcggaagcatcatccaacgttttgaagcaaagggactggccattgctgaaatgaagtttgaaactatgactcctgaattagcaaaagaacattatcagcacttgactgagcgcagtttttttgatgaactgatcgattacatgacttccggtcctgtcgtttatcttgtgctggtcggcgaggaagtgatcgatatcgtccgtaagatggttggagcaacaaaagctgccgatgctgttccaggtacgatccgaggagactacgcgctgccggggactgaaaacatcattcacgcttctgattcccgtgatgctgcggtaaaagagatcgcccgctttttcccgccattcgatataaacaaaccgtctgaaaaagcggcgaagtgatacaaattctaaactgctggtctagttgctgggttcagcaatggccagcagttttttctctaaggacctccgttgattctttcctaacatatattcgagcactgtgaagaattcttggtagtctttcgtcttttcttcccctaaagcagcagaaatcaatctttgataataatctgccatcaatgtttcatagatcactgtacttctttctttatgtgctaagctccgtttcatatcttcattcacactacgtgcctttttcaaccgaccattttctatataaaacgaagtcaggttcattaaaaaagtaaagagatactgctcatgattgttcaactgtgctaatcgtcgcattctttttttgattttcaaataattgttctcaatgaaccgatcactgaatatccaaggaaaatcagctagaatagatagttcaaattgaccatagtctggtatctgcatcaagtattcttcaatgattcggcattcataacgtaaaaattcaaattctgtctcagatacttctgttttttcgaccatgtgaagattcaaaaccaaataatacagatcttctgttttcttaaaatgcctacggttattgctgatctctttataaggatcaaagctgtcttcttgtacccgatctagcattcgtctttttttctttaactttattggttcatccagctggtttcgcatccattcatattctgcaagtgtcatgttcattcgctctaaaaatgatctcaatgttacaaatgacatttttttcactgaatttgtctcaatcccgactagagaagtcttaaaacagattccttccgctaattgggactgtgtcaacttcttgttgactcgaagtttcttgatcaattcaccatcatacataatagttctcctttttaatttaaatttttccacattcaataaatagatacgttaaaaaggaaaaatacacgaaaaaaataaaaaaatgtttttttcataaaaaataccaaccttcaagcattagaatgttgtctaactactgaaggttggtttgattgtttattgattatttttttgctgttcaacgtctgttcttgttactggatataagttggttgttgttttattaccattttttgaaaagacacttgtcgaatgttcgcctttttgcttttcgattgcttcattacgttccgcttcatttttatagtcatattttttcggatcaatcgtctcaaatccgtttggcacataaaaccgcaagagattttcctgattcagcttatctgaaagacttaacgcagtcttgactttttcctgatctttggagatttcctcatcgattcctgctgctttcgtatcgatgatttctcctgtctgattattgtaagcttttcctcctaggacggtgtatttgggtgtcacaaagttcccatttcgaaaagcaactacttgatcatgctgagaagataataagtctgtaccaaaatgaagataatctttatcatcgattcccaatagatgtagtaatgtcggcaaaacatcgatttctccaccgtattcatgattgactgtccctttagtataaccaggcatatggatcatcaatggcactcgttgcatctgtgcgttgtcaaattcatcccatgtatctggatctttaccaagagcgcttgctaaatctttattatctgtattcgagatcccaaaatgatccccgtaaatcacaaagattgaattttggtaaataccagattttttcaaatacgtaaaaaattgttccaatgattgatccagataatgtgccgttcgaacataattatctactgtgctattgccagtattcaaagatggaaagtcgaaattcttgtcatccgtataataaggcgtgtggttggttacggaaagaaatttcgtgtaaaacggctgttgtagatgctcaagatattgggcagattctctgaataaatctttatctaatatcccataacctaacgtttcgtcggattcatcaaaataagatcgatcaaagaaattgtcataacctaagtttttatatacatgatctctattccaaaaactagctacattcccatggaaaacagcgcttgtatagccttgcttttgtccaaggatcgctggtgcggcttgaaagacattgtctgacccaagttctgtgaataatgagccttgaggtaaaccaaatgtgccagtttccaacatattttcagcatcacttgtctttccctgtcctacttcatgaaagaaattgtcaaagctgatcgttgcttgattctggaaaatactatttaaaaacggtgtgacttcttgtccgtctaccttcatattaatcaaaaactgctggaaactttctaaatggagaacgatcacatttttccctttagcgatcccaaatgtttcgggatttggctctgcataatgtttctttgtataatctaaaacttcatcaatcccattactgcttgcatgcgcgcgaacactgctagtcattcctgttttgattccgtcataaatagtatacgcatcgattcctagatatttgacaatatatgaacggtcaaatgttcgctgcagcaattgtggacggttggcttcgctcagcgctagatttcctgaaaaaataagccctgaaagacaggtaacagcgatagccatcggtttgccgacagggttgcttttgataggtattttcttgaccttcaaccaaaccagtagcccaatgaacacagcgatatccagccagtagatgacatcatggggcttcatcaaagaaaaggagcttcctgacaatccttgcgacactttcgaaaagcctaatacagatttgactgtaatgaaatctgtgaattcccgataaaaaataatattcaagtacaacaaaagcgtatttaaaatatcaatgatcaaaagaatagctaacgctggctttggctttttaatatacaaagaaaggccaaaaaacaataaggtagtcgcaattgggttgatccacaagataaagtactggatcgtaccttccacacctaatgaaaaatctgcatagtaggcaatgatcgtcttcagccagaaaaagaaaacagctgtcaaaacgattgctaaacgattttggcacaattttttaagttgtgtcacgtatatcacttctctctattcacattttttcttattttgctcctgaaaaatgaaaatttcctaaaaaagttgttatcttaagatttttttattctttctaaagattattccgtccacttttcacagcataaaaccgctgcgatgtaagcgattaaactaatgaagagataaaagtcttgtggtgaccgcttcactccacggtattcaaaagccagtttctcggtattcgtacaaaaaaagaggctgtgacaaaattcttgtcgcagctccttatttcttgatgcaggacagctttttcacaacttcttccttaaacggtgttctcctgccaactcctcggccacaagtcacaatatttataaaacatgagaagctgttttttgaaattgttccttgtggctcagagttaaacggcaggctcaagacctcttgatacacggtgttcaatcagctgaccctcggtattagattatgtcaggacgctaattttacaacctcttggtaaacggtgttcaaaagcttgcatctgcggtaataagcccaaccaaacgaaaaatataaggagctattttttgaaattgctccttgtggctcagagttaaacggcaggctcaagacctcttgatacacggtgttcaatcagctgaccttcggtattagctcaaaaaacggcaaaatatgaggaactattttgccgtttgtttctctaatactcaggtcaaaacgctgatttcacaacctctgtttttcattgtccataggattgatattgtccttgtgatgactcattcgtaataattgaggcttgattttcttcacttcccgttatcgtttgtccactgccagaatctgaaggacttgttcctgtcgactcgtttttttgagaagagacagttgttttcttgacttgttcatttgtctttttccattccgctaaacgatcggcgaccacttttttgtctactttttcagaataagcggtgatcacttttccatttttcaaacgggctactttgtcgccatcatgagtcaaaagcaaaacggtcaaatgcttgtctttaaattgatattgtctgagagaaatcgcactaagtacgtcatcgatattaataaattgattttcttcttttccttttggcaaataaatgtccaattcgcctttttcgtaattggcagttattttatactccgcccaccaataagttgagaattcttttttgaaattatctactgattctttgcttgctacgattttttctgtttctttctgagtaagatctgctgtcatttttcctgaaaatgctgcggataaaataagcagtaagaaaaaaccgaataaccaaaagagaagaaacggtctttttttcctcatgctttcctccactcctatttaattttgactattctattatatacaaaaaatgaaatagaaagacaaaaaagttgaaaaagatcgtaaataattgaacttctttttcacaaaatggtaagaatggagaatttcacgcatttgctctcaactattctttcttaagcctcaaatccgtttttatctgatacgtctttgaaccaatgacccgattttttgattgttctttttccatcttgtgctaagtctactgaaataaagccatatcgattcttatatgcattggtccacgaccagttatccatacatgtccacatatgatagcctaaacaattggcaccttcttgaatggcttgatggacatatttcagatgagattggacaaattcgatccgataatcatcgtggatcatgccatcttctttgataaatcgtgcttcgttttctacacccataccgttttcagaaataaagcagtcgatatttccataatgatctcgtacattgatcaaaatatcatagattccttgttcatagatctcccatccgcgataaggattcattttacgaccaggcatttcataattgtcgaaataatcctcaggcattggaccgtttttagtatcgattggtgtttcttttgcttttacccggcgtggctggtaataattgatacctaaaagatctactgtattttctttgataaccgtcaaatcctctgcatggataacaggcatgagatcaagttcttttactatctcaatcaattcacttggaaactcgccttttacagctggatcaaggaatgaacgattgaagaacgcatctgctatttgcgctgctttaacatcttcagggtttgattcgtctcttggatagcttggtgtcagattcaagatgataccaataacaccaccttgctccatttcatggtaagatttgatggctaacgctgaagccaacgcttcatgatagccaacttggatcgcttttttcatatctgactcttctggataatgccatcgatataaataacctgcttcgactggaacgattggttcattatgagtaaaccatttttttactttcgaaccaaacaattcaaaacaacttttggcatatttttcataggcttcaaccgtttctcggttcaaccatccgcctttttcttgcagatacatcggcatatcgaaatgatacagattcacaaagggttcgataccgttttcaatcaactcatcaaaataacgatgatagaaacgaacggcttcttcgttgattgttccagattcatcaggtatcaaacggctccattggatagatgttcgaaatgaattatgcccagtctgtttcatcaactgtacatcctcttgatacttcgtataaacttgcgaggttttttcaggtcctacttgatcaaagaacttttgcggttcttttttgtaccaataatcaaaaatgttctctccttttccatcgcctgaaatccttccttctgtttgtgggccacttgctgcagaaccccaccaaaaatttgctggaaattgatattttttcatcaaagcacctctttttcttttttagttcgttttagttgattccatgtatgatattttccatcacaatcactttttcattttcttcctcttcttttttgattcgttttaacagctgttctgctgctcgttccccgattttatctgttggtggcgtgatcgtgattttcggaagaatactcagatcgtttttatctaaataatcatagtgactgaacgcaatatccttcccgattctgacaccttcttgattgaaacattcgatggcaccaatcgacatattgtaattgctgacaaaaatagcagttgcccctttttctaataatgcttttgccccgtaatagccgctttttctagaatagtctcctgtaaagacctctaattggatcgatggatcattttggaccgcttctttggctcctgctaaacgttctcttgctacgtagtctgtttgagtggcagcaataaatccgatttttttatgtccttgttcaccatgatgagcgatcacttttgctacactttctcgatcattcactaatattgtatcaatacctgctggtccttctggacaattcaatgcgataactggaatactcatttttgtgagcatttcaaatccagaccactcttcttcggataagaagacaatcagcccatcgatcacatgcttcatcaggtattcaattttttgttcaattttttctggctgatcggcaaacccgcttaataataagctatacccattttcttcagctactctttcgatccctgagacaacttccgacccaaaacggctggaaatcccgtttatcaaaagtccaatagagaagcttcgattattcttcaaccctttagcaatgatgttttctttatagtccaacgctgaaatcgcttctgctatttttttcatgttcttttccttcagttgctgaccattcaagtaacgggaaactgttcccactgaaacaccagccatcttagccacatcacggatcgatgccatacattctcactcctgccagttacatttgatttctctttcttgttgttcgattatgatgaccgcattctttgcatagtgttgcttgtcatcaatatccatataactaaagtcttcagtagagcaacttcctctcactattaattatacttaaacaagtatttgaaccggttcatttttaatatagcatttttttaaaagattgcaacacttttttaaaacgctttctgaaagtggcggattttttgcctttttaaaattttattctaaaatttactctatttgtgggtgttttgtgcgtttttctcttccatccgtttgaagttttacattccaatggtataatttctttatcctatcaaatgggggaagtattttgaagaaattaatcgtactatttattttgtctgcgggacttttgacattgactggctgtgatttgtttggcggctctgaccaatcctcggacgaaacaaccgattcttctgtcttaaaagcggaaaaagcagatatcaccaacagtgtatatacgctaaaagtacgtaaagatatggatttatccgcgggacagttgacatttacagataaaaaaatggaatggacacgcacgtatcagacacaaggaactgattcttctgaatcatctgaagaaaaaacagtgctgacagatatcaagatcactaccaaagatgacgaatatattatttcaggaaaagaaaataaaaaagaaacaacagtcatatttacaaaaatcggtaattaccgtttgaaggatgaggatggcaacatctacagtctatagtgccgtctgttggatcttcttttgtttctccccttcttttctgctatagtaaagaagcaagatgattgtaaaggagacgaaatggatgatcgatagtcctgattattgtacatgtaataacaacaaaaatatccatacagaatttaatgaccaaggaagcttgagcatatgcgacaactgtcacaaactagtcaaagattcatttaaaacatttgaatcttatcctgttcaaaattatgtaaaaagtagaagaagataaacaaatccaagcaaaactcactatggctgatttttatgaacttcaaactcagcttcttcctttgatcaagcttcatcagtaaaacaaacagtggatcatttcagtttacaaatcaaagagtaaagatttatttatttcaaatatttgaatataaaataaccaaacgatagaaaggcttattctacatcacgtagtaatttttctttcccgtcgtttggttttttatttttagcctaattcttgaccttttgcatgctggttatccgtaaaatattttccagcaggctttccttccaattcagctaatttttcttggatctgacggatcaccttttttgcatcttctggattttctacaaaatcgaatttatccccatccacttgtattttaggacatacatcaaaatcttcataccattgattatagcgggtgttcaacgtttcataataggtatataacgtctcatcgctttctagctgttcatagtcacgcccacgttttttgatacgttctagcatcgtgtccaaagaaactttgatatggaccatcaaatcaggccgtttttttggagcaacatcatctaactcgtttagcatcgtatctaataagctatcgtactgctgtacttcgatatccgttacccgacctaaatcagcgtttagatggaacaacaggctatcttcatagatggatcggtctagcacattgtcatcgttcactaaagcatttttcattgctaaaaatcgcttgttcaaaaagaagatttgcaataaaaaagcgtactgctcaggatttgaataaaagagcggcaatacttcgttatcttcgacattttcataaaatggtttagaatcaatctcttttgcaagcatatccgtcaaactgctcttacctgcaccaatcgttcctgaaatcaaaatcactgacatacaacccttcctcttctataagtactcgcctacgtaagtttcaacaggcaatgtttcaaaatcatattcacgtacagcttggtctgattttaaatacgtatggagactttgtgtaatcatcaagttcgtaggtaccgtctcttcttgtacaatgatcatcggttttttcaacatagttgccacacctaattcgtaagccgttcctggatcgattgtttgatgctcaaagtcaaggatagcaacaacaaattctgcatttgtcagttcttccatatctttttcgtatacttcctgcgcccatccagcgctgaatagttcataattgctttcttggtgatgacgtggagagtagaaacttgtgactgttttgttttcctccaacgctttttcgatacgacttactcgatcgatttgctcctctgaaaaaaatggtcctgctaaatatatttgactcattattttgcctccttcaataataactgatttttaatagatactgctcgtaattcattgaccagttccaatggattgttggaaaagattacttgatccaaccattttttatccataaaatcctcttttgcaaaagtttctaataattgttgcaagccgctgtaataaccgccaatattcaatattccgattggcttgtcgggcgtcagaccgattgctatccaagaaagaagttgtgagaattcctccaatgtacctagacctccagggaaaacgaggacagcatctcccttttcaaataataatacctttctttcatcgatcgtttctgtaggaataaatgtagtaacatcttttccaggcaattcagtttcaaaaagcccattcggatagatacctgtgacttttccgttattttccagtactgttttactaatcactcccataatcccggagtatgaaccaccgtaaaccagttcgatttcttcttgtgccatgtattttcctaacgtttgcgcaataaatttgtaactttctttattaccaaaacgggaaccgcaaaaaacagtaagtttcataaaaaaacactccctaactcaaaagtctatcttcattctacacgtgtttttttaaaataaaagactagattttgtagttttttagtggtatataggatagacaccactatatatagtatttagaaaaaaatcatttttcagctattttatagataaaacaaaaataaataacgtgttttcatcgatatgaaatgacttacttatagaagatactgggatttcgtcctatatgccaataacgtgtattattttaaacaacaaatacttgtttcttttattaacgaaaaaatcattttgttctcgtgttatgtttcactgataaatgatgtttctctaaataaaaaagccgacgaactaaacgatcaaaatttgatcatttttgttcatcagcttctcctaaaaatctttttgttaacgataaatagctggatttgtaaaaatatcacttgaatcgtcactgctggaagaaaattcagtgataaccgcacctgttgcgcctgcctggaactagtgtttgatattgggctcgaacgtgtactgatctctagcatgaagaataatttctttttttactgtataataactttctttcctttttggaatagtacaggaaagtttttttgtttcctttccttcgacataaggtataccagaccctttcgacaacgaaaggttctcatttttccttcatcgtcatttcaaggagggtgccgatgctctggacagtttcgatcgctcctaaaccaaaatctgtatattcgattctttctaactctgattctttcataccattcctgcctcaaggtacatctattgtacttttttcttgtaatccattctgcctctcctaactaattgtcaaatcatcccaagatatgtcttcttcctctttttcttcttggatgatttctgcattcggatctactggttttttcaataataaaatggttattcctgtgacaaaagaaccagctaacaatgcaccaatgaatgcccatggtctggtcatcgtagcgactgcaaacattcccgatgccggaatacggctatctgcgccccaaaacatgcttaatccgccacctactgccccaccgactcccgttgctatgacattgcgtgccaagtcgttcaatacgatagggaaacatccctctgtgatctgacagatccccataggaaaagcggtcttcaatgtatcgatttcttgacgattgagtatatttttacgaatgattttccctaagaaataagcgatcgtcaagccgaatggggttaccatcgaagctaaaatcaatacagtgattggttcatagattccttctgaaaatcgtgccacacccccttatccagaataaatggtaatccagaaacagccgtgtatctgcggtaataagcctaaccaaacgaaaaatatgagaagctatttttgtttggctgttcttattacttgatgcagggcagctttttcacaacctctttttttatttatgtttcataatcaatatggtaaggatgcagctccgtatggtagaccgcctccgaatattcaatcatttccccaatttgcgtagacgatttccgtatccgtttgatgccgatctgtgcgtctgttttcagaattccttgttcttcttctgttaaaaatactgccgagaaatcatcagaaaatgagtcaatagtatatccttttttcgtcagcaaacgatacaaagattctttgccaaattcttctctgctgaattgcatcatttcttgtggaagataatgaacaaaataaatataaggctgattgttcaaataatataagcgcttaaaacaaacagcttgctcaccgaaaaaggaaaacaaaggatcttccttctttatatggaccaattgcaaatccagcgtttctttccggacttcatatcgggagttctccaagatttgcgtaaagcttgccgctttggataatcgattgtaaggacgattgcttagaaccgtcgtcccacgaccacttttctttgcgacatattcatctgatgccagcagttcgattgcctttcggacagtgattttgctgacttgaaacagttcttctaattcactttctgtcggcaacatcgaaccgactggatattttcctgagaaaatatcttctttaattttatctgcgacttccaagtatagtacacgtgtccttttcataacgtcaccctttgctttactattactaaaagaatagcacataaaaaataaaaaaagaacacaaatcacatgtgagaagtgtgttctttttcattcagctgctttaattacaagtttacgccatttgaggcaattacttctttataccaatcaaaagattttttctttgatcgattcagtgtcccatttccttcatcgtctagatccacatagataaagccgtaacgtttactcatttctcctgttgatgcactgacaagatcgatacatccccaaggcgtatagcccatcaaatctacaccgtctgctactgcattagccatcgcttcgatatgacgacgtaaataatcgatccgataatcatcaataatcgtgccatcctcttccatatgatcaatggctccaagaccgttttcaacaatgaataatggtttctggtaacgattgtataattcattcaatgcgattctcagcccttctggatcgatctgccagccccattcacttgcctcaagaaacggattttttactcctcccagcaagttcccttctgaagttgctgcttgtggatcagtctcattgattgccgtagacatataataactaaatccgatgtagtccactggatattcttttagcaactggaagtctttttccgtttgctctaatttttccggatcgactccatattttttatgggtacgcgctgtgtatgcagggtattctccacgtacttggacatccgtgcagaaaaaattgaattcttggttttggatcattgttgctgcctgattgactggattggcatcgatgctgtaagttgttgcatagataatcatgcagccgatttggatatccgaacgcaattcgtggccgatttttacggctttgctacttgcaacgaattgattatgccatgcttggaaaatattttggtactctcctgctccattgctttttactaatccttgacttaaagctggaaagtgaaaggccgaattgatttcattgaaagtcatccaatatttgactttactgctgtatctctctaatactgtctgagcaaatcgttcatagaagtcgatcagttttcgatttttccagccaccgtattcttttgccaaatgaagaggcatttcgtaatgagaaatcgtgatcacaggttcaatatcatattttaagcactcatcaatcagctgatcataaaattctaatcccgcttcgttaggagtaccttcgtctccatttggaaaaattcgtgtccaggcaatcgaaaaacgataacatttgaatcccatttccgcaaacaaggcaagatcttctttgaaacgatcgtaatgatcgattcctcgatgattcgggtaaatatatttttcttgatcaatcgtccagtcaaattcttcactgccgataatcgcaaagcgctgcttacctccaggcatagcatctgcaacggatagtccttttccgtctcgatcataagccccttctaattgatttggcagcagttgctccaccccataaaaatttttctgaaaaacgtgattgcatcctgatttcctccttattttacaattgccagaacatcttcgtttgcaataatctctttttggtctaattcaagtatatcggcaaatgcatcagtattcgtaatgacaactggagtgattacgctatagccagctgctctaattgcttcgatgtcaaaacgaatcaataaatctcctgctttgacgagatccccttgtttgactaagatctcaaagccattcccatttaattctactgtatccatcccgatatgaatcaaaatctccgctccgtcagtcgttgtgatccctacagcatgtccagttggaaaaatagtcgtgatctctccgtctgcaggtgcaactagttctcctacttctggatcaatagcgataccttttcccatcacgccagaagaaaaaacttggtctggtacttcactcaatggcagtactttacccgttaaaggactttttaaggtatgccgtgctgaagtaatcggttctcctgcattcgcatgtttgttttctaattgattgtcttgtgtttgttcgtcaaatcctaaaatcaatgtacctacgaatgcaagaacaaaagcaattcctgtagctattactgctactgtcacatttgactctacaccatccaccgtattaatgaaagtcggaatcgtcaataagctgaccaaactgctggagaaagcttttactccggaaaatccgataatagctccaccaatacctccagaaatacaagcggcaatgaatggtttcttcaaaggtaatgtcacaccatacacagttggttcagtgattccaaataacgaagtcactgtagaagaaatccctaatgctcgaagtttcgtatcttttgttcgcaatgctacagctaaagcagccccaccttgtgccaagatggctggaagaagcattggcatcaatacatcaaacccatattgttcgatattcaaaaacatgatcggtacgaatccccaatgcatgccgaacatcacgaatacttgccataaacttcccatgattagacctgctacgattggactaaatccataaatcgagttgaagagaccgcctaaagcattaccggcaaccgtcccgattggtcctaaagcaagaaatgttaatggaaccatcactactaaaacgacaagcggaactaaaatcatttgcagaaattgcggaatcactttttttacgaatggctctaatttactttgaacccatacggctagaatgattggtatgacagaagaagtataaccagatggtgaaagaatcactgggatcccaaagaaactgatagcttctcccgcaccagcaactgctgtgatagctggatacacaagtgccatagcaattgctactgctaaaaactggttggctttgaactttttagctgctgtaaaagcaagcatgacaggtaagaaggtaaagacaccatctgctgcagcaaacaatatttgataagtaccgctatcagctgtcagccagcccatcaccgttgccaatgataagaatcctttcaataccccggcggctgccatcgcccctagaaaaggtgtaaatatactagagataatatcgatcagacgattcaaaatatttttggactcttcttttccatcctccgaaactgcaagaccttcctcatccacgatcgattgataaacatctgctacattactgccaatcactacttgatactgaccgccactttgtacgacttggatcacgtccgggtcttcttttaacttttgcgtatctgctaaagattcatcttttaatctgaatcgcaaccgcgtagcacaatgtactaaacttttgacattcttttgtcctcctaccgcttcccatacacgacgaccaactgcttgattatccattgttttttccttctttcttttttatttaaaaaataaaaacccagattgaaaaaaacagtcacaaacattcgtgaacctattttttcaatccaggttttgcctgccatacagtaacaatccttatgattggatgctttttttctcacttactactctttgaatatgaatcgttaaataaatctgctctgcgatccccatttcctgtttttgcgtttgtcgaagatactcattgatccgttcgacacaatgaaacgcttttggatactttccttgaactaatgcgtagagaaattcatcttgctcgtcagatccttcccctttgagataacgctgggcaaaaaactgcagatgagtaatgatacgctgataattcaaagattcttcatcgaacacgatgccgaagaatttactgatgatactcagtatatctcttaccattgtggtagcggtcatcgtcacttgcatgtcttcgtttccttgttggctattcacaaaatgaaaggcaataaaaccggcttcatcctcagaaagttccacacccgtcttttgtttcacgaacaaaagagcctctttcgctgcttgatattctttcggataaaatttttttgtttcaaataataatggattaggcagttggatattttcttttgctcgtgtgatcgcataatgaagatgatcggtcaatgtcagataaatattaggcgaaaattcaacttttagtttatcttcagccagttcgactacttgtttgacccattcgatctcctctgccggaatatcagccatcagctgctggaattggtttttagcaaaagaatctcttaaaacaaattctttttggaccgcttctggcgaaatctcgtccccaatctttttttgaaaagctagtccttttcccatacaaacgacttcttccccgaatccatttttcgaaatgacgacattgttattcaaaattttatcaattttcattttgcttcgccctctcaagaaaaataaaaaaacctagaattcgcctactgtttcttagctgaattctggttttgcctgccgtacagtaacaatccatttcttattcaaaatcatcataccatcgaatttttatttatgcaagccttttcatataaaaaataaaaaaactggaacacaagtctatctagaaaacaaccaaatcagagatgcacctctttgcgtttctctttttttcagcaaattggtttttccttatcgattcatatcctttggctgtttttaatctgtaacgacttatgtcccagtatcctaaaatgtttttgtctctagattgaaagcagatctcatatcatctgtcgcatcttttatcgatgtaacactttccagttctccttgtacaactagtcgcgtgacggcgtccatgtcgccacaagtaattagtgtgacaatttcttttccctcgacttcattcagtaattgggtatctgtaggagcaactttttctttaaaaaatgttttgtatgtatacacattttctaaatctgtcaaatagatcttggcacccatctctaaattttctagcggtgtaaacagcaattcagggttcgttgcacgatggcttgctaaggcataatttccttttcccatttcttgatctggagataatgttcctgctccgtaaagtagtgacgtattatccaagcctttgaaaaccggtaaattgattgaaactgaagggactgcgatactagcaatcactggtagatctgttcctctcatttgcgacctcatgaccccttctgtcgtcattggttctaccgcatcaaagtcaaaactgacatctttatcgttattctttttcagatcttcttttgttacattcgctatagcatatttatctcctgtctctctgacaagataatccttgatctgttcattgaaaatcaaagctagtcctactaataacaagaggaacaagaggatattgactagccatctttttgcttttcctttttttttcattttctctccctccagactcattttactgtttttcttttgctctttccaacagccgaatgacacatttctacaactctgtgtatttttttcgtacacctgcgcttttttctacaggatatttcaaattatttttgatcaatttttcttcaatgatctcatctagatccaggtgaaggttgtctgccatcatgtatgaatagatcaatacatctgccagttcttctttgattcgttctaattgtgtttcttttacttcttccggcgttttccattgaaaaagttctaacaattcagatgcttccaaagaaatagagatagccaaatctttttcgttatgaaattgtcgccaattacgttcatctctaaactggttgactttttccatactattcatttgcttgccttcttccaatcacttcttacttgattaatcataccatttttttacataaaaaatagatgatgcttttaaaaaaactcctgttttcttttatttaaaataaatgtcatagaaaatcaataatttaggtagccaccatgtgtatgcagtagcgtgtcttcttcccttgaggctttttgtttttcgatacgttcttcttcccaaacagacaacgctactagaatctctcttaatgattttccttcttcggtgagcgagtactctactttaggcgggacttggttataggcttttcgatggatactttcatcttgttctaactctcttaactgctgggtcagcattttttttgtgatcgtagggatttgcttgcttctccacgcctaaaataagcgatattgctcttccctttatctggtgtaagcaaagcagttagcattttgacgatcgtgggttccgcttttcacttcttatctacttagtatcatgaagtatactttcgtactaatactaagtagcggaagtgtcaactactttgtttaactacatagcaaaacaaacagaagggtgacaacggtcatcacgcttctgtttcttttgaatatgctgtgttgttgtctctatctccgtgtagactttcctcaagcttatcctttgacagtaagtcagtaggctgatttgctctttctagatgccagatacatttctacaaagaaacagtgattctgctttgaaaaatcgatttttagttctgcattttcgtaaacatccagcatttttttcgcactgtatagacctaacccgccattttttttagaggtttttcctcttttgaccatctccgatagcgtcaaattcgttggatttgccttgttcgctatactaaaacgtaatccctctttttcttccagcagattgatcgtaatcggactctgatcggctacacgatgatcgaatgcgttagaaataaaaatagataaacagcgaataaaaacaaccagatcaatcgggattgttttcacttcgacaggaataactacttggatcgggattttctccgattctgctttttctagaaattttaaaaagacacccctgacagctggggatacaatatttgttagctgttgtatttgcggtttttcaaaaatagctgcagaatgatcttctaagatttttaaaaattccaacgtttcttttttattttcttgaagagtaatttttaatgaaaacagtagacttttataatcatgtttgaattcctctagatgatggtaatattcttcatttatttgatacagttgaagcgattcctgatgttgtctttcttttacttggaaactgatcaacataatggaaaaaaacaaagaaaaaaactgatgactatcgacaaaagagatagaagcagataattagatgagcggaagtgaacacttcccaataccaagtaaatcacgccccaacttaataaaatacaaatacctccaaaatagtgttcagttggataagtaaaaagcaagttgagaaatctcgtctgtttgtctatactttttactaatagatagaaaataaatgcgataagtagtgcaaaaaaacttgctgttccaagatgtctctttcctaaataatccatcagatcaaaaaccagaaaaaagctgagtccagtgatagcaaaaaaaagattactgatcaaacagctgataaacaggtttttcgtagtaaaataaaaaagaaacatcaataataagccaactaggtaaggaaaactcactttagggataggaagtaaaagtgtcaccaccatcaaagctatacaaccaaagctgttttttactagcagttgtttcgaaaagaataaatagatacctaaatctaaaatcaaagtaaaggtcaaataaagtgtcactgttgcgaccatcttattcctccattgttttgtttcaaaatgtacacatatttttttgataggagcctgcatatgaaaaagtattttatcatagaagataaccagtttcacagcgaatggatcatcaaagaattggtcaatcatcatatcgagaatatcgtgcagctcacttctgtctctcaaatcaatcagttgatccagttgggcactattgataatcacgatgttttctttatcgatatcgacttgaagcaatcactcacaggtattgatgtcgccgaacaaatacgtaaaaaaaatgcacatagtaatattgtttttttcaccgcttatacgaattttgcagtagagatcatcaatcggaaaatccttccgattggatatatcagaaaagacaggaatttatctgaacaaattcgtcaagtgctagaacagatcaattggaaagaacagcagatcgtaaatgtcgataaaatctttattgatcaaaaaggtggaagtctcgtcctgtatcctcgggaaattttatatattgaaagtatcaaaggtttgaaaaaccaagttatggtcaaaacaactacagaagataaattagtgaatacttctttaaaacaattgaagacagagttagaaaagtatgcttactttttacttttaaaatcttactgtatcaacttatcgcaattgcagaaaattgattctgctcattatgtgttagaatttttcaacggtgactccttactcgttggtcgaaagatctttgaaaagacaaaggaacgtttccatgacttccaaaaaactgcttcgagttgatgaataagagctgagacgtaagcatagcagatttcagggagtgggccttgaatcggctccactccctgaaatcgttgatataattttacgcttcctcttctgtaggagcatctgttaacgaccatgtgaatgttgaaacgtagttgtctacagcataattggatacaggaacaaataattccactgattgtctcccttgttccacattctctcctaatgaataaatccatgtgccaatcccttcatttgctcctgcagttactagatctactgcctgatctgctgggatttcgattccttcagcgccagttccagaaacggtagatggcattccactgctattagttgcgctatttcgaatcacggcgtttttgaatttcacctttgaaccagttagtttattcgtatcagatgttgtaccaataaattctgttcgtttgactgataatttccaaccggcataatttccgcttttatccgttacttgtacgaaattctgtacttgtgtttgtgctccagtactgtccgttccgctttgtaatgcagcatatactgtttttgctgtacctaacttgattgttccaaaatcaagatctggagcttggtcaatcgtcagtaatccggatgttccctgatttggttcgtcaggtgtaaaaggagtatcaggatcatttggatcaacaggaggaactggaacaacgtcttcaggatttgcagcatctggtttggtcacagaaatcgttccttctgtagtggctgagctcttattctcagcaaaaacactttgtgtacataataatagacttccagctagaacggtacttaatgcaattgttttttcatttctttttccttctttcttttaaaataaataatccagcaaataagccaataagaatgactccaacaagtatcagccatcgccagtcaaatgtttctggctgattttttaaatcaatatccttttcattcaattggtccgctgcatcatcagttatttcaaaatcggtatggagattccagcgtttttctttccaagcacccttcacaaccgcttgataatgtcccggagctaatttttttccttctaatgggacaagtaaatcaaaatttgtattgggtgctacatctattttttctttttttattgaaaggtaaggctcttttgtttcttttttgtagatttcaaccgatgtagtcaagccgaacatataagaagcatttggattttgaagattcgccttaatcacatttcttccatcgctttgatccacataagctttttttaatttcaaatctggggaagactctttttcgctatttcaaatcaagattgctttcacttgagaaaactgattgacgacaccaactgtacttttgttagaaacgttctcttttttttcttgaaacgtgatccctcctgcgaccacaccagccagctctttttctggcgctttcagtgaaagtgtctcagtgaccgcactttgaggaggaacagttatttctcccactgtttttgctaaatttttcatatcataacttaatgtttcatcaaatttactttttgattctccatattcgatcacaccgtttgaattcgtcgtagcggagtggatcaatgtctcaactgttactgatttatctgttcggttaaagaccgtgtaggggatttcctgtgttttcccaggctccatccttacatttatatatgttttgttcttatcaatctgattagccggtaattcaaaatctaccgcaaaattgaattcggaggcatggacaggtgtctgccaaaggatgaatccaaggagaaggatcataagtaaagagcagttgtttcgatgacttttattccatattcgattcatcaatcatcctccttgatctttattctgtcggcgcatctgctaatgtccatgttatctctgctgagtaattaccagctatctgattttctttggttaagacaagtttaaacgcccgaccgttatttaaatattctgaataatctgcttgcacattcgttgaattttgtcctctgacaatttccagttcttcttcattcactaattgatactcctctcctttcttgaaatataggacatcctgcatagaaaatcctgcatcatttgtgaaaggctgagataattttatcgttaagatccacggatttttcgtttctcgctgatcataaatccataatttttcctgtatatccatttggccaaatgcttcttgtgtcaaaccagttgctttgatctgaccaaaatcgagtttggaaggggcaagaaatgagagaccaccttctactacgatcttcgtagcaggtgcaaaaggcggggcatcatgataaacaactggcgtatcacttggattgtgattcccaatttcatcgttggtacttggcttgttctgcacacccttagcagtagcttctcctgcttggtcgtttaatacaatttctaatacatctcctgcaaaaagttgattttctgggatagaaagaacaaattcccctgtatcatcaatagttgtttctgacaaaacagcttgattttttttcaatgaaaccaaggctcctgcttcacctgtacctgtgatcgtgcgagaagctgcattgatcaatgtggtacttaaattagcaggttcaggaggaatcacatcgactgtcgttttgacagagtccagttctgtcacttcttggccacctcttacttttttagcagcaacaacttgcacttgatcctccgtttttaatctctcatcattgggtacttgaacttcgaacaagccgccttgttcgccttctccccatgggttatatcctgccccttcattttcatctgtttgtccttgcgtgagagcagtaatttctacagatgatttcgtcgtatctgcgtaagtaatacgtaaagtcacttctacttcgcctgtccaagcatctcttggctttgcctcgacaccttcgggaacaacgacatgcccatagatttttttatctgcattcgttggcactcttaaggattcaatcatcgggagctgattattggcactgattcgattataatttttcattccggcacctgtctgagcaaattcatttgttaaacctgcactagggcttgatacgaaattgcctaagtcggtcccattgatcgataagtctgtcatatcagaaaaataatccgggtctttttcaaagttatcgaatgttgcgcctgtttttcgccataaagcgatttctgaatgggcgatctttaaagaagaatctccatttccttggaatacccagccgcctatgccattggtctcgcttccaatccgtttgttttggaaatcaaaataggtaggagattctaagtccacattcaacacatccccactgatgatgccggtcttatcttcccctgttttcccgaccatgactaaataagttttttcacctgccgtaaaatttaaatcaatatctccagttgtatctacagttgctccggaatctgcgcgtatatcgatatttgatttttctccagtgactgtaaaatcagctgaacctggactttctagaaaaccagaagcgtcataaaattggatcgcttgatttccttgattgagtctgttcacgtaagatttgccatcacctgtatttcttaccctcaatgagcctccattggttactgtcagcttttgcgtaccattctcaaaacgaactgcgctggaacgcccactctgcttatcgatgtcgataactgatccggctccttctacgatcaaagaaaggccttttcctacaaaacgcatcccattgttcccgggttgatcgtcatctccagccattttgaccgagatttgtccaccacttgatacatggatttgactagaatctccttgcaagcgaaatccgcccgtagttgctgtattgatggtgattttcccaccattcgatacagtgactttcgatcctgaacctctcatttggatgattccgcgattgttgtcattggtaatattgatctttgtatttaccgaaaattcgcttcccgaaccactgacttcaaacatgacattaccaggtagcgtatcgactgcctctccttcatcgctaacgccatctgcccgatcataatcaagagagacctttgaaccgcttaagatatggattcctggcgctgtttttccactaccagtctcatctcctgaatctagaaaaccgtagaatttccctagatacggtccataaagttgactaccattgatcacattcaattgatagcttctacaaaaataggctttacccggagcggcattcagtccttccttcactggttggacatccaacacaccggaaacaccatctaatgtgacagttgcacgaggagcgtaaatcagtcctaatttggacccatcatacaaatcaagtgtcccggtaaattttatttctcccgtaaaatgatatctgcttccccaaaaatcggtcatataagcaatgataatggcatttccatcgatatttggtgtcaatccacctggatgtgcagctgttcctttaaaattctggaactcgatcgactgaggtatctcattgatataaatatggtgtgtgccgaaattgtgagcgaatccaccaaaatcaataacgatatctcgtttgatctctaattccctgtctaaagtcaaaggctgaatcagtcggatcttagttactgattcgtctgcgagaagctgcgccagttcttctgttgtggcagcttcgctgtacccatccgctgaaacagctcttgccagtgccgcttcactgctatcagacgtttgttcagctacttctgaggtctcacttgtcttattttcttcttgccttttattagtagaagcctcactttgagattctgtagtttcagaagtaatcgattcttctgaaaaagtagtcttgtcaaaactttgattctctgattgcgttgattcgtttgttttctctacatcggcaaaaacggatgtcaccatcaagagagggaagacaaacaaaatcgacgcaatcagcttttttacacattgattcattctccaccatcctctctgacgttttgacaattttattttatcgttttaatctatttccaattgtactttcatatttaaaatatgtatttttatggaaaaatttttctattaggtgtaaatttcttttttgtacaaaaaaaaggctgtgacaaaagtcttgtcacagtcccttatcccgaacaagcggtgttctcccgccaactcctcggtcacaacctccattttaacaataaacctgtaaatgtgagggcaatactttgattgtcacaggtaatttatccccttcatctccatcaacattcgtcgtcaattcttcctcatcagctaatgacacaactaattgctcacaagtaaggtaggctagatttttcgtagattcatctactccttttaataggtctggcaatgttttaagcgtatcgatcaaagaagaatcttttaaataaaccaaatggagcttaccatcatccacttttgcatttggaagtaatgtttcaaaaccgccgactgagttagttagtcctatcagcaaggtactgctctcaatttcttccttctttccatcaacttctacgtgaaacgagtaggattgtgtggaagctaactgtttgattcctgacatgaaataagctagttttccaaatttcgtcttcttctccgcatctacatcattgattgcttcagggatagagccaattgcgacgacattcataaaatagtcgtcatttatttttccaatatccaatggcttgactgattcaatcgaaaaatgattgatcgcttcctcaggttctagcggtatccctaatgctcgagccaagtcattcaccgtacccaatgggaaaaatccgaaatttggccgatgttcttgttcagcgattccactgattccttcgttgactgttccatctccgcccatgacaaacacactatgatacccttccgtagccgcttcgcgagtaaagttttttgcatcccctgctttttttgtatgcaagacgaccacttcatcaaacaccgattccaattttgctatcgctaattgctcaaattcctttgcttgttcaccgcctgaactggggtttaccactaataaaacttttttcatcactttctttcccttctgattgatttctttaatataacgatagcataaagaaaaaaattaggctgtgatgaagtactgttcatgaaacattcatttattttttgacaagataaaacatccatactatgaaactgaggaaaattaaaacaatgatataggaaataaaagaaaatgataggcattgtatacctaataaagtaaaaatcttaggtggcagataaaaacacaaaaatagcaagagaatgtaatagcgtttcttccactttttgttatcagaccttatagcgatcagaggaataccaaatgcataactgaaaaactcttgatgtactgttaatatgtcacggccttgaataataaatgcgacaatccccgctataattagtgtgcctaacaccaaaacggaaaattgatgaatatattttatatacaaatgatccattgtacttcctgcctttttatttgtgagaaaaacaaatccgtatacgtgaataacttctagaaataaaagaaatttgcaaaaccactccatttatctacttctacgtgcattttttgatattgttttctttatttaagattatacagaaaaatatctagggtcgctggattctaagtaaataaaaaaaatttttaaaataaaaagaactaaatcaagtagtaattaaactactgttgatttagttctaataaaaagatttagatgaacagttttattgatttaaatagttcatattttttatttataccgcttatttactacttgctgtactagaatctgaagtgaatgtactcaaaacattttcaaagtctttgtctttgatttttacattagcgtctttcaatacttcgccaattactttattctggaaggtactgtcacttaattttgtgtctgttgcaatttctttcaattcttttttgtatttatccatgtcgttgcctttgttttggtttttcaccattttaaccacataatattccgtagtataagttgaagcattggtagaagtgatcacatcagaaacttgaccatctttcaacttaaaggctgcttctttgacttctgccggaaccgttgtagtagtagaatcaaatttcacttttccgccatcttcttttgtcgtagtatcagttgacttgtctttggctaatttagagaaatcgtctcccttatcagcagctttcttcacatcttttgcatcatcttcacttgctacttggataatttgagcttccacttctggatggaaagattcccaagccgtttttaaatcttcatcggtcaatttgatatgtttctttagaccttcttgaaaggatagactttgtttgatactgtctttgaatgtttgttctgtgtaacctgcagatttcaattgtgaatcaaatgaatcacccaattgtttctttgtttgatcatattgagaatcgatttctttggttgatacgtcatctccatatttatcttcaaatacttgataaacgatcaactgttgcacagcggaatctgctccttgcatttttttcaagctatccattacttcttgttcgctgattgtaccgcctttataactaacggctgttttttcaccggcattcgtacagcctgacaataagccagtgcctagtacgatggcaagtgctaaaaatctttttttcatttatcaattctcctacttttcgttttttgcgaattgctaaaaacaaaggtgttcaagatgaaaatcatcaagaacacctttactaatctgctcgatacgtcctgaatagatataaggctacacaatccagaaagttcgctcagcagaataaatgtcaagtagcacatcacaccttaatatactacttcttttgttaccgtttttcaagtctatcttgcgttccgtatttaacgtaactaattcttagaacaaatgttatcgattttgtttttcttcttccgctgctgggatattcaaatcagacacttttatgttcgattttccagacatttttttgttgtttttattatgatatatttttatacaactaaaaatgaatatattaaaactaccaaaaataacttttaacgctgtttcattatatgttttttctattttatataaacttttggatacttaataccaaccggttggattgtaccaacatgagaatgtgtcagttctatttcctgtcgcacttgcataggcccatactccttttgttgcatttgctgatcgaatagagtttccaactttcgcttttgcaccgtgacgattatagacacgactatagtggttagaatgacctgtttttctcgtacaagttgtatcactataataaacccatcttccagagctatgattaattgctgttctagaaatttcccggtctactggtaaatttgacttaataatattacctttagcatcaaaatgaatctctcctggctttaaagatttgtaatagatttcaccgtgaactgaatttgcttccacttcagatgacatagcgtttcctccaacaaaacctatccctagtgcacaaataataactgcttttttcataaaacgacatcctttcctttttgatttttaaagcatgatcttcttgtttcctattttggtcagatatggatcatgcgtgactacgataactaacgtaccttgggaagcttgttgcgataagatttcaactactttatccttatttcttttatccaatgacccagtcggttcatcggctaaaatgatttttctattcttcaataagactctcgcacaggcgattctttgcttctcaccaccagataatgtgtagataggcgtacttagcttcttgtttatatttacttttttcaatgcctcatactttgctgttcgcttatctgaaacatttaaattcgaaaacttcaatccaatatctaaattaaaatcgattgtttcatattcaatcaacccaaaatcttgaaaaagaaaagatatggtatttctttttatcaagcgcttctctctcccagttaattgtttcgtctcttgatcgaacaaatagaattgtcctgaactgaactgatcattcaatcctaatatattcaataacgtacttttacctgctccactttctccaacaacagtcacaagatccccagcatccgcagtgaaacgatccaaatgaagaatcgttttgtttcgaatgatttttttcgcaccttttatcactatcaacggctccaattgttaacctccattcatcagcaataactgacttttcttttctgtagacaaaataaaaacaactgaaagaataaaatcaatgaagctaaagaaaaaaatattaaaaagatatttaggctctctttctataagaaaaaggaagattacacttgtcgttccccatttgatgaggttcatcatgaagaaatctttatacgtttcaaagagcgaataaccacttgaacgaaagatagcgattttccgacaattgtagacaaaatatatgcataacatgacatagctcaacaagaagaaagaaaagaaagtgagtaaaaatatctgtatcaagtaatgaaatgatctgcttaacactttgacagctatctcttcagtctgagtatacggaaatgataactgcaagttatcacgtaactgactttcttcaatcagctcaaataacctttctttcgacaaagagcctatcttgatctttaacggtggatagatttctccgctgagaatatttctttccaaatacgtactgtttttcaatgtcagtatttcaacaaccggataatgttcgatccaggggatagaaggaataaatgtataaatgggttgattgttttttataaatagaaatttcggttctttttcactgatttcttgataatattctgttatttgcgccaggtcattttttaaatctgtatgtctatatcgttcagggatcaatataacagggtgcgtttctttttcggttatttggatcaaccttccagagacatcaatcaaaggaaatttcttaagataattcagatttatttttatccctctgccaaactgttcattttcttcattcaagtaatctgatacattgactaatatacttccgtttttattcaaagtttcatataattcctgatctgctgctgatgcaaaacgattggaataaataaaatccacgtggtttttcccgatggttactggataaaatacatgatagtcctcaccagcgatttcttttggtggttcatgggaaacagctaactgtgaagaagaaaaaacgatagttgctaattcgacattggcaacggtcaaaagaagagaaaacaacaatccaaatgtaaaaagaatgtattggatatagttgaacgcttctcttaacgaagcgattttttcaactaataaaagagaaatcaaagagataccatatattccgctgaacaagaaaacgtacatctcgaacaaataaagaaattgctccttataatacataaaaataaaaccaccaatgattcctgcaattatgaatgtaataatgattttctttttccccaataaacaccacaatacttgatgtaatgaaaagtcattattcaacaataaactgatttctttattcatcaataagaaaaaggatgataacaaaaggaataaaagaatcaatccaatagttaaatacactcgataattatatacgtctgtatttgaaataaccgaatacgaatagctattttcaaagtcttcaaaaatattagtggcataatcagtgtgaaatgcttgattgaatcgatcagtgaatagtgaaatgaaccgttcataggcttctttttctctcgtcatcaagaaaaattcaccttcaaaatcttttattttgatcgattcttcaatggacgttacgcgaaaggaggtattagaatagggtaccttctcgtgagaagatttgacatccccttgataatacaatgtcatttcaagctttggctgtatcttgaagttccaagatgtatctacttcattggattcatttactgtttttttcatataagaaagctcagtttctgatgagacattttcaaataccatgattagctgctcatattcttcttgcccaataaaatgttgtggcaatcgaatcggagtataagtatctgtttgatggaaaaattcatttgtccgatagagtacctgtttatttatactaaccaaggcaaaaccactcatgataccggtcactatgattgtgagtaaaactgtgaacttttttttgattatcaccactctcccttacttaaatgattctttgataaaatcataccgtttttcatcaaaaaaacgtatctatcaagtgtataggtcatgtagaataaatctatatactgtagaatcgaaaggagaagaagatgaacatcggagaaaaaatacgaacttaccgcagaaattgtaagcttacgcaaaaagaattaggcgaaaaaattggtgtttccgataaaacgatttctagttgggaaaattctcgtacaatgccagaccttgaaatgctgtcacttttacatcatactttaggtctgccgattgattttccttctattgaatcagctaccgaatcaatagaaccaacattgccagatgaacctcttgttaacaagaaatcttattcatcaaaacaacccttctcactcaaaaagacactatctttctttctgctcgtcttttgtttggtctatctttttcttatcaattatcaatacaaaaatgaaacgatcgatcgattcaatccttttttgaaaccacaaatcggctataccacactccctgtaggatacgtggacaattccatcgaacgttgggtatgtaatgatatctttggccatggtacatggctgtcttttcacgctggagaggtagaaaaagagaaaaaccatgctgtaatcaaacacaaaggaaaacacgtcatgaacgttcgcctgctcacttgggaagccattccctcagattaccaagaaatcctcagccaagactatgacgacgccttaaaaagaagccctcaggagccagataggcattaagtaggagatgaacgtagagatagaaaaaatcaatgcacatgatcttatccaaaaaacaggggtacaaattaattgaaaaagccttgagatgaaagttcctaaataaaaaagttcagaatgataggtatttctggcttatagtataatatttacgccacagcctcccaatgattctttttggaatcataatcaaggatggacattcacaaaaatattttgctcattcgatccgaatagattaacgaccaatctagtaagtaatatagattggtacgtagtcaagctgcacataatttagatcaattttagttcttttttatatttctatgatctgctcatttacttttatatgatggcttacagtaacataaataaatatgataatcgctggtagtttatccaagagtactcaataaaatacaaaatggattgttcaagcgcctatcataatgataaaatgaaacaaataaacgatacaaggaggaagagactttgagtaatggcagaacaattttttcattgtaaaaattgttcagttgttaatctatgggatttcggtagcatgggcatttttttatagaggaatcacaccaacctggccgttttatctcttgttagtgggaatattagtaggaaattttgcccctcttcactatcgtacgaacttttttccaactgattctggcctttttcttaaaacaaagacgcgaaaattagaaaacattattgaaatgacaattacctgtataatcattttcttagttatattcctaaacgtcttctaataagaatctcttaaaattagcttgttacagttagttacctagtttatataacacagttatcttatcttccttatcaacatcttttgccaactctttgtcttaaattcgaaacatataagcagagctacgaacaccaagactgtttcggctctgttttttacatcaaattcactcttatatagctgataatctcggctctttaaaagaaattattttcgcttcattttattataaaaaggctaggaaccttgatgttatcaggttcctagcctttatttaagtattaccccacagacccttccaatgactcttttggaaatcagagtaaaggaataagctttgtatagatatttcatttaacaaattactatagactgacagtatatagcagcagatattatcatcgggaacgtagccaatatcgtaaccaaaacagcaggtagagaagttatttgaggattcaagttattctgtttcagctatgaagttaagttcatttactataattgaagataattgatttttttctaaatgattcacgtatttttttaagctctttagtaattgttgattaagggttattgtatctctttattacaacttaagatatttcttacctatctgattagtttcatatctttttgaatttcttccgtatcaataatcttatgtttatttacgactcaaagataaagttatggatagttgatcgattaagtacaatagatatttgcaagaattatctaaatctgaaaataaagttgattttatcatcaagatattataaaaagaagaaacggtgacataagtcgctaaaaaagaagcatgtgtaactcttcagatcaattctccctatatttagtcgtccaagagaatatgatttaagcgcaatgggattgacaaaaatagatactggaaacattgaagataaatataaaaaataaggagcactcgaaaaaataagccattttcgagtgctccttattttttatagagtgtaactaacttatgtcacacctccaatttattcgtatttcttagcgctcaattacttacatagatagttaaaaacatcagcgctacttccaacaactaagattagtgattcagttaaattaatattttgatagagattagataagacaacgatgattgaacatcacattgtaaatgatcattgaaactttcgacaccttatttattttttgttaacgtcaaagatttgtaaacactcccaattattgatagtattcaaatgacactaagcaagatcaaatcagtcgttttccatgtactattaagagacaaaaatgtgtatacgtaccagtgatcaagagatagatagatcgaacaatgatcgaatacttggaaaactttctttacctttataaaaattagactatgaaataatgtagaagaaaagcaaatttaataacgctgcgattccatgtgtaactgtatttaatacttaattgatgaattcgtgctttcgtctaaattctatctccatcttattacactccgtttcattcgtgagattccactatacacaaaagatattctgtttacgtaaactatatacttacttttttaaaaattttattaggatcactaaaaatagcaacaagagcacaccgatcaaaccgcttacaagtaaaaatgcagtacactttgcctgtttcactttttctaaggattcctttatttcttctggttcaacaacgattctgtgtccacgcaccagtaaacggtgactgttgatcatatacggagtacaagtaaccagtgtgactagatcttgatcttcttggatttgcagcgcttctgtttctgtgggttctacggttttgatttgatcgacttgatacgcaagatactgtccgttaatttcaatataaaagtgatcttttatttttaattgaggtaaatttgtaaacaattttgcttgcgacaagcctctatggctagaaagtaccgcatgtgtcgatttgcctccaatagggtatgaggttccctcgagcagacaagctcctttttccaatagtttcatcgttgtttgatcaaaaatcggtaagttgacattgattttggactatttttccgtttgtttctctaatactcaggacaaaacgctgattttacaacctcctgataaacggtgttcaaaagccagtttctcggtattaagccaaatttatgcaaaaatgtgtaaagccactttcacaaaatttttcttaatactcgaaactaagcgactttttcacaacctctgataaacggtgttcaaaagccagtttctcggtattaagccaaatttatgcaaaaatgtgtaaagccattttcacaaaatttttcttaatactcgaaactaagcgactttttcacaacctctcgataaacggtgttcaaaagcttgcatctgcggtaataagcccaaccaaacgaaaaatataaggagctatttttatttggctgttcttattacttgatgcagggcagttttttcacaatctcctcatgctgttaaatggcttgcataatgattgttagtaatagccccaatacataactggcattgaataagaccatatttttgatggaatagctgaaactgataggctggggtaacgtttgcttgaattgatccaaatgcttcttcacaattggcaaggtcaagaaggtgaccaagatcggccattcatagataccgctcaacaaccccattaaaatcacgaaatagcaagcatacatcaatagttggaataacactgtccctgcagggcgtccgatataaaaaactagtgtatagcgatgattttcaatatcacggtcaagatcccgcaaattattagccaacatgatattggcaatcgtaaacaccaagggcaaggaagctaatacgattgctgctatagcccaaagatttcctaccaaagcaaattgtccagatgaaaagttgactgtcagatcatagacatctgaaccgaatgtattgacataaacgaccatggcaaaaattccaaggcccatagtcaccccactgaaaatttcccctaaaggcattcgagataaaggaatcggtccgaatgtatagaatactccaataaaacaacagataaatcccatcaaaagtaaaagccaacccgtattgatcgttaaaataacgccgataacaaaaacaaatgcaatcatagctaaaatcatgtttcgaatcaatacaggagatagatttctgcggccaatgacattttcttcatacttatatacttcagaatgagccttttcataatccatgtaattattgatagcggtagtcgccaaatcaaaaactagcattccaataaaaaataaaaaagtgtttagccaatgtatttcatgaaaaaaagcgatagagaataatacccctaccgcaaaaggaaatacactagccacctttgttcgtatttcaactacttctaaaaagatttttagtgtcatggttcgtactccttattttagttcagaacggtcacccatcgtgtaatgggagtcctccgataatttgaaggtgtctttgattggatcggtcacatatactttatcgtcttttgtcacgaagatcgcttccgtcccgttattcaattcgctttcgacgtattccagtccttttttcacacccattgaaaagactgctgtagacaacccgtcaccatcaattgatttatctgttatgatcgtgacacttgcgatatcattgtcgaacggataacccgtttttggatcaaacaaatgatggtattttttgccatctacttctaaataacgctcgtaaattccagaggtaactaatgttttgttccgttctttaatagaacctaaaacagatccgcgagccatgttcggatcttggatgccgactgtccagtcttggttttcgcctcttgggctgtggcctaagacatagacattaccgcccaagtcaacgatggcagtggtcactccttgttttttcaagactttcactacttcgtccgtaatgtaacctttggcgattgcacctaaatcgatgatcattcctttttcttttagataaacagttttttctttgtcatttagttcgatcttatgataatccactaatttcaatgcctgatcgatttcttcttgggaaggttttctggcgtcatcaaaaccgattcgccataattgtgtgattgcaccaatcgccatatcgaatccgccttgagaatcttggctatattcgtaggcccgcttgactaacgtgtagacgtcatcagaaacttttactggtttgatcccagcttgctcattcacttcatcgatctcagaacctttttgattgatcgtgattttatcaccaagttcttttactcgatcgaaggcaggtttcaatgctgattctttgccttcatcatacacacggatacgaacgtaagtccctaacaagaactgttcatcagaatacggatcttttaatattttggtagacgctgaactttcagtggttgttttatttgctgaattgctgcatccagttagcaccataaaagagatgcccagtgtgattaaggaaaatagtagttttttccgcatttttttcctctcttcattttgaaaggtgagacgactgcctaatttggctatcgtcccaccctccaacttttattagtaaaattatatgattatttttctgttacgatattatctacttcgattgtttgagtgtcgcctttttcagctgcattcactaattgttgtgcgtacatgatgaatgaatgtgagctgtgtgtagcacctgtaacaacttctacatcagcaggtgagccatcttcttcgcccattgctttgacgaattcgtcgttcagagtagggatgtaagtttttggttctgtaccgctttttgctttcatattttcattatattctgtatcatcttgttttgatttaccgtctttgtcgatataatcaaagtttgattcagttactttgccgccagcaactgtcatttcgaattgcacacggtagccgttagagtagttcttttcttcaagcttgtaagtgccgtctttcaaatcagcaccattgtcgatttcgattgtatctgtgttaccagcttgagcagcttggatcaattgttgtgcgtagttttggaagctttcagatgagtgagtagctccagttacgacttccacaccgcttgcgctttgtgcttttaagaattggtcgttcaactcaggaatgtatttttctgggtttgtgccagattttgcttccatgtttttgttgtattctgcatcttttgtttttgattcgccgttttcattgacgttatcatattttgattcagtgattttgccgtcttttacaaccatttcaaagactgcacggtaaccatttgaataatttttttcttctaatttatatgtgccgtcttgcaagtctccgccagcaacaacttttgcagatgattctgttgtgctttttgcagtcgaagattgtgctgtagatgattcagaagaagcatttgaacttccgttgtcatctgcgccgcaagcgcctaacactagagctgaaaatgctaacacagcaaatccagttacaaaacgttttttcttcattttaataccccaccattccatttttagtccacaatttttctttgtgattcattatacattctaatctttttagcctataagtcaactatttttgataaataacccatgtaatatttcaaacgttttctttcagtaaatttcgtgaaaaaacgctttattttaaaatttgaaaaaaatccaaaaggagttagacaaaagaacagaacatctatataatatatggagattgtgtaataagtatcaaactaaaagaattatcatatattcattatatagatagtctataaggagcggatgatcaatggcaaagcaaaatattgtcgttgtaggagcaggatatgccggtgtttcagctacaaaatacttggcaaagaaactgaaaaaagaagatgtagcaattactctgatcgatcgtcattcgtaccatactatgatgaccgagttgcatgaagtagctggcggacgtgtagaaccagaagcaatccaatacgatctgcagcatttgtttgctcgtcaaaagaatgtacaacttgtcacagacactgtaatcggtatcgataaagaacgaaaaatcgtcaagaccaaattaggttcctatccttttgatcagctgatccttggaatgggcggagagccgaatgactttggtacacctggtgtcaaagcacacggattcaccctttggtcatttgaagattctgtaaggattcgggaacatattgagaaaacagtagcaaaagctgcattggaaccagatgatgaactgcgtaaagcaatgctgactttcgttgtctgtggttctggatttaccggtattgaaatgattggggaactgatcgactggaaaaatcgcctagccaaagattataaattagatccaaacgaaatcacactgatggtcgtagaggcaatgccgacgatcttgaatatgttggatcgaaatgatgctgcaaaagctgaacgctatttgcgtaagcacaacgtggaattattattgaatgcaccaatcgtagaagtggctgctgatcatatcaaattgaaagacggacgcaacattccgactcacacactgatttggacagctggtgtcaaaggaacttctgacgctgctgactttggattagaatcagcacgcggacagcggttgatcgccaatgaatatatgcaggcaaaaggctacgaagataaaaacatctatatcattggtgatttagtcttttatgaagaattcccaggaacaccgacaccgcagatcgttcaagctgctgaacaaacaggacacacagctgcagcgaatatcgtggcttcgatcaaaggtggagaaaagcacaaattcaaagggaactatcaaggatttatggtttctattggagccaaatggggtgtggcgaatttatttgacaagattcatctaagtggatttttagctatcgtgatgaaacatatcgttaatttgaaatatttctttgatattcgttctggttattatatgttccaatatttaatgcatgagtttttccatatcaaagatgatcgcaacgtgactcgaggacattcttctcgttacggcaacgtcttatggagtgtgccacttcgtattttctatggtttagtttggttcgttgaagcctccaaaaaaatcattggtaatggtgaagtgttcaaaccaagtacttggtttggtgaaggatcatggttcactggaaacagtgtgttcccttggacatgggaatacaatgtaacagatgttgccagtggtgcttctgctgctggtgatgcaaccacagctgccagcggagcaggggcaagtgccggagaagcagcgactcaagctgcacattttggtttgagttatgcatacggtgaagaaccaatggctgtgattgagaagtcaccagactggttcacaaagatcatgcaagtgatcatgccaaacaatgatgtagcaatgttcttccaaaaattcatggtattctttgaaattgccttggcattagcattgattgctggattattcacatggctatgcagtgcgacaacgattgtattggtgatcacgttctgcttatcaggcatgttttactgggtaaacatttggttcatttttgttgctttcgcattgatgaacggttccggacgtgcgattgggttggatcgctgggtaattccatggctacaacgtacactaggtaattggtggtacggtagaccaagttcccagtacggcaagaaataaatagacaaaaatagatgaacaactttacttgaatgcaagatttcaatagaaaggggctgagacaaaccgtcacagcctcctttttatgtaaaattaaaggaataagatgcccgagataagcctccatgagcaagacacaggtgtcgcaacctctgttacaacctcttgttataaacggtgttccagaagtagcttcttcgaaaaataagccgaaatttcacaaaaacttgaaaagtaattttcgtaaattccttcttatttcttgaagttgcccacttctgtcacaacctcttgttataaacggtgttccacctgctgcttctcggtaataagcccaaagaattagaaaacatggaaagctgttttctattcttcgttcttattactcaaagcaagacacaggtgtcacaacctcttgtttttatgctaaaattgggtgagttaatctggaaaaaggagaacaaaaatgagccttaaagaatttgctgaaaaaagtctgctcaaaccttgggatgtttttattattttgcttttgactgttctttcttttttaccagtcatgatttttggtcttcagcaaaacaccgtaacagcagaaaaagaagcggtactgcgtgtggatggcacagaaatcaaaacattccctttgatggctggagaagagagctacacatatacttacaaagatgaacacggagattataacttgatcgagatagatggcgatcgagtacggataaaagaagcagattgcgatgaccagatctgcgtacgtcgaggctgggcaacgaaaaatggcgaaaccattgtttgtttaccacataaattagtgatcgaggtccgatcaacagatgggggtgacaaagacagtctgatttattagaccttcacacaccatgagtaaattacaaaaaatgatttatatttcgctgcttgttgcacaaggagtgatcattggtttattggaaaatatgatcccttatcctttttcttttgcgcctggtgcaaaactaggcttagccaatctaatcacgatcgttgccatttttaccatgaaaaaacgagacagcttcttactactttggctacgactattcctgactactttgctaggcggaacgatttccacattcctttatagtatgagtggtgctttgcttagttattttggaatgttattggtcaagcaattaggaccaaaacgtgtcagtatcatcggaattagtgcggccggcggtttcatgcataatgtcggacagcttttgatggcttctttcattgcacaatcatggacagtcatgttgtacttgccagtcctttcagttttagggattttatcagggattgcaatcgggatcgcagcgaattatcttttacgacatgtgcagacacttcaacgattccaaaaagattatgagcagggaaccaaacaaaaatggagcccaatgtttaccaaaaaataatcgtcacacaaggagtttttttatgaagctacatccaatgtgggaaaactatcctgctttaagtaaagaattgacagaaacactaaaacggatggaagaaactgtccgcctgaaaaacaaacctgtcgaacaagcaatcaaagaaacgatccatgccggcggaaagctgttgcgtcctgcctatcagctattgttctcacaatttggaccagagcaagatcgagacaaagccatcgctttggcagcttctatcgaaatgctccatacggccacactgatccatgatgatatcgttgatgaagcggatctgcgacgtggtcagcctaatatccgtagtcagtttggtaatgtcgtttctgtctatgcaggagactatttatttgtctgctgttttaaactattgtctgattactccacttccttgaaaagtctccaattgaattctcgcagtatggaaaaagtattgaatggcgaattagggcagatggatgatcgctataattatgaactttctgtaaaagaatatttggaaaatatttcaggtaagacagctgaactgttccaattaagttgttctgttggcgcttttgaaagtggaacaagcgagcgcttcgcaaaaaaagcaggagatatcggactttctatcgggatggcctttcagattatcgatgatattttagattatacaaaagagagccaggaaatcggcaaacctgtactagaagacatgcgtcaaggggtctattctttaccgttgatctactctttgcaaaaaaacaaaccaaagctactaccttatttagagaagaaagcggcaatgacagaagaagatgtcgacgccgtacgcaaaatcgttgaacatacaggaggcgtggaagaagctaggaagttagcggcctcttacacagaaaaggctttgaaggaaataaagaaattacctgccacctctcttcgaacaaaagagaatctcttttcccttacccaactgattttggatcgcaaagactgaatagggaaaggttcgatacgtaaataaatttctcagaaggaaatctacgtgttttttgacaaattgaattgtagttcttgtatttatgataaaaagcaaaaataaagagcaacgtccgttagcgacgttgctcttttttatcttgaatatttttttaccttttcgatttcttataactcataaaagtgattcttaaaccgattacaagtaatataacgcctgcgagtgttatccaattattcgattgacttccagttttaggaagtgctctttttgatttgtttccattgtcattgcttgttttattagttaagttaaagttcgtcctgttatccgaacttgtttttgagaaggagacacttgcatgacgtgtatcgcttgtggtagacgacgtgtctgtactatcgcttgaagtttatgaatctgagctatcacttgtggtagagattgtatctgtactgtcgcttgaagctgacgtgtccgtgctatcacttgtagtggtagatgaatctgagctgtcgcttgtggttttagtacctgtactgtcacttgaagctgatgaatctgagctatcacttgtggtagaggatgtatctgtactgtcacttgaagctgacgtgtccgtgctatcacttgtggtagaggtagtatctgtactatcgcttgaagttgatgaatctgagctatcacttgtggtagaggtagtatctgtactgtcgcttgaagctgatgtatcggtactatcacttgtagtggtagttgaatctgagctatcacttgtggtagaggtagtatctgtactgtcgcttgaagctgatgtatccgtgctatcacttgtggtagaggtagtatctgtactatcgcttgaagttgatgaatctgagctatcacttgtggtagaggtagtatctgtactgtcgcttgaagctgatgtatcggtactatcacttgtagtggtagttgaatctgagctatcacttgtggtagaggtagtatctgtactgtcgcttgaagctgatgtatccgtgctatcacttgtggtagaggatgtatctgtactgtcacttgaagctgacgtgtccgtgctatcacttgttgtggtagatgtatccgtactgtcgcttgaagctgacgtgtccgtgctatcacttgtggtagaggtagtatctgtactgtcacttgaagctgatgtgtccgtgctatcacttgtggtagaggtagtatctgtactgtcgcttgaagctgatgtatccgtgctatcacttgtggtagaggtagtatctgtactgtcgcttgaagttgatgaatctgagctatcacttgtggtagatgtatctgtactgtcgcttgtgtctgtcgtatctgtaccattgtcgctgataaatatttcgttaggatcccaacgattggtagctgcatctaaaatcacatttgttcctataatcgttccgtcttggttttgagtaatgcggatagtagcattaggcgcaaggattgttccttgaaaaggagcactgattgtcaaatcagtcatctcatttccaaaattccaagagatattcgcatccgaaaaatcttctgtttcatgatttgaacgatcattgtatttgattggtgactgtacgttcaatgcagaagaactgttgatgacattaaatacaactacttgatcatttggattaatgatttgaagtggcgtattcatcgttaacacttctgcatcgatatttaccaataaaaacccggtatctgataaatcagttaaatcgattgtccgattgttcatgtctggaaaatctgcagcagtatatgttttagctggagtgatcgttgcaagatcatttgctgctacattcaatttagcaaattcctgctcgaaatcaatatattcatgcccagcacgatctttataaaaatcatctggagttaagtgatcaagcctggatccattgactgtaggatgaccatcttgaagtgctacatccacgttactgccaacgacaaatttattcattcttgtgctacctgtaggtatgcctgaagaattagcgaaagaatcagttttttgtatataatttatttcttggttcaataaaccttcatgaagctctgtaccaaaattattttttgcatcaagttcatgtgttgctatatttccgtctgtatgtgcattcacagttgtcttatttttagcaaatacgtggaattgactagcaattcctaacaagccatagttaccagttagatcattataaatattcccagggtctttaggaatgtatgtttccgctgaaacggccacaccatacgaaaagatattgaacaacaaagcaactaggactagtaaacttgccctttttttcatttttccccttcctttcctttcaaacattttcctattatactctttttctcctagtcttaaactgttcgtttgaaaaatcattgtttatttaaagaatattaatgaaacgttcatattgttgcttcttgttcaattgatagttcgacactatctttttctttcaatctccaaaccattgatgatggtgactgttaaagtgtaaaaaataagggtgtgtagtaacatataagtaggtatcctagaattaggaaaaagtaagtaggataaataaaaaggaggaaaataaatggattatttagatatgctatgcgagagtgtggatcgggcatacgatcggtttgaacgtttgtttgaaggcgtctctattgaggaggccaatcgttttccagtggaagatagagccccgcagatcaaatcaatgacttggctggcttggcataccgctcgagaattagatttccagattgctgatttagcaggaacttctccaatttggcatagtcaagtctgggaaagccggtttccgatgacgatagcagataacgaacaagattggaagcatagtctggaacaagcaaagcagatccaagctaatcaaatagaagatctgctaggatacttgcgaggagctgctgattttgctatttcttacttaagaaggctggaaccttccgagctagatgaagtaattgacgagaactggacaccaccagtcacacgaggaatgcgtctcgtttctattattgatgatgctgctatgcactctggtcaggtgatctatgcgagacgtttgttgggattaagagattaaggcactagctaaaaaagaacttacggcaaaataagtcgcaagttcttttttgtttttatcgttacccatggtctatctataagattgaaaaaggaagcggcctgctatctcttttgatcgtgtaaactgatgactctcttgttttttgcattgattcatttaaagaaagtgtaccatgctttatagatatttttagaatacctttttctagaggatagagaaactgtcagctgatagaataaggagagtcttttgaagagaattcagaaaaaaggacactgtatgagatcaggtgtccttttgtgaaatctgataattattgcgtacggatagatgtgagactgatttcgccagaagacaaactcatcttctgttcatttgtttggacgatcagttcgccatgatcaccgatttcttttgcaagaccgacataagtcgttcctttttgattgaacgacacggtttttcccaatacgaatgatttttctttatagaagtccaacgctttttctgggtgagaaagataagtgaacaattcttgccagattttgctgattagctgattccttgtgacactagcttgtccgtcgggaaagacagagatggctttttcttggagatcagctggaaaatgattttgaggaacagaaaaattaagcccgatcccaatgatgatatgactgatcctgccgctttccatatcactgactgcttcagataaaatcccacagactttttttccatccatgtagatatcattgacccatttgatcgaagcagaacgaccggttacagattcaatggctttcacacaggcactggctgcgatgatcgtatattgaggcaattcatcaaaccgtttgtctggatggagcaagagactcatgtagattcctcgtccaggttcagcgaaaaaaggccgtccaaaacgtccacgagcttgttcttgtgtatcagcaacaaataacttcgaaacagaatctccttgagctgctgccagtttggcatctttcatcgtagattcagaagtcaacatcgtttgtactttcaaatcaggaataaacgaccgtagctcttgctggatttcttttgcatctagtacgtcagagggcaggtaacgataccctgtaggcccgtgctcaaaacgatagcctgccttttccaattctttgatggctttccaaatacttgtccgggaaacttccagttgctgtgccaacttttctccggaaagaaaatctggtgtctttttcaataattgaagtaccttgtctttcgttgtcatggcatcaagctcctttcccatccattctatcaggaagaaggagagaacaaaatagttttcgaagaaacaacggttgatacataaagcaaaaacgaaagaaggaaagagaaaaaagaagagggtgggcgttcattttttgtcccagcctctttctgattatgaagataaaagtacttgatcgtcttttaatgccgtgccgctgttttgtttgaacaacgctaataattggggcactgtgagctgctgtttttcctcttgctggatatctacgacgatccttccttgatgcagcatgatcagtcgattcccatagcggatcgcgtcttccatgtcatgagtgaccataaaagcagtgagattctgctcagtgatcagcttttctgtcaattccatcaccgttttggaagtagcagggtcaagcgctgcagtgtgttcatctaataagatcagttctggacgctgtaatgtggccatcaataacgtaatagcttgacgttgtcctccagacagcaaaccgatttctgaggataaacgattttccaaccccaaatttagccgaaccagctggtctttgaaaaatgttcggtcttgtggtttgacaccacggaagaagccgcgtttttttcctcgtttcatagcaagagcaagattttcttctaccgttaaacgaacggctgtccctagtttaggatcttggaatacgcgactgatggatttcgaacgttcgacaacagattttttcgtgatattttttccattcaataaaatttgaccctgatcgacagaaaatgtaccggcgatgctgttcagcaaagtagatttaccagccccatttccaccgatgatcgtcacgaagtcgccgggatctaaggaaagattaatgcctttcaggacatgattttcgttgatcgttcctttttcaaaggtatgatggagattttccaatgttaagacgtcattcatttgacactaccgcctttctttttttgaggtaaatggaatttttgctggatctgcgggaaagaaagacagatcactagcacgaaagcagaagcaagtttcgaatcacttggttcaacattcagttcgaagactaacgctaaaataaaacgataaatgaccgcacctaaaacgacagtcaagagacggagaaatagtggctggttacgtaacaaaacttctgcgatgataatagaagcaagtccaattacgatcgttccaataccagaatttaaatcagcaaagccgttgttttgcgcaagcaaggagccagaaagagcaatgcatccattagaaatcatataaccgatgatcttcatattatctgtgttgatcccgtttgcttcgctcattgccagattatcgccagttgcacgaatagcaagtcctgtttctgtacgtaagaacaaaacaagtaaacatacaacgatcaaagcaaaaagcagaccgacgatcagtacagcgttgtcttttgttatgccgaatgactcgacccaatgaaagatcgttggctgacccaataaagagatgttcggcgcacccatcacacgggatgtgacagaatataaaccagtcatggtgatgatccctgcaagaagggcgggaattttcaattttgtgtgaagcagtccggaaacaagccctgctgccgcaccccctaaaaagcctagaagacaagctgtcaatggatgatagccatttgtaatacttactgccgcgatccctgcacctaaaggaaagcttccttcagcagtcaagtcggcaatgtccaagatacggaaagtgacgtatacaccaatcgcaagtagggcccataagaccccttgcgatgcagatgataagaaaagagagagcaaatttgtcatgagaatcctcctgtgttttattcagcttctttgatgctgtctggattgatgcctaatgctttggccatgtctttattgacatacagttccaaatcattcgctgtttcgacaggaagttcacttggattcttgccgtctaagatttttgctgccatgatccctgtttgtttgcccaagctttcgtagtcgattcctactgttgctagaccgccgtctttgacttgatcaactgcgccagcaacgacaggtgtttttgtttcttttgcgacttcaccgacaacacttgccgcacttgcgaacgtgttatcagtaggaatatagattccatctacatctttagctagacttttcgtcacttgttggacatcatttgtggaatttgctgtcagtactttgactttgacgcccgcttttttcaattctttttctgccaaatcagcttggatcttagagtttgcttcaccgttgttatacatgatgccgattgttttggcgtctggcacgatatttaacagtaagccgatttgtttttcgattggcaccatatctgtcgtgccagtcacattgccgccaggtttttcattggatgtgactaaatgggcttgttccaagtctgtgaccgctgtgacagtcatcgggatagtggttgtttcatttaataaagattgtgctgctggagtggcgattccaagtagcaaatcaggatcttctttgacgagtttctcactcatacttttcaggttgtcttgattgttttgggcattttgataatcgattgttagattatcgccttctttatacccttcttctgctaatccttctttgaatcctttataggcagcatctaacgagttatgttgtacaagttgcaatacgccaattgttttttgtccatctgatgcctctgcggaattgtctttttgtgcgcaacctcctaaagctagtagcagggcagcgcctaatccgatgattatattttttttcatttctttttcctccttaattttgggaaacaaaaaatccattcagacaaaatgtccaaatggattgaaaagtcggaaaataaattgaaaaagtagaatgcttgatacttttactttgtattttcactgctcagccacttagcattttgtctacgtggctttttgctgcaatacaaagttctttagccatcatagatacaaactgtcgtttaacgtttgtatccatcatgatgaatacaaacctatctaaagtagctaaagtaaaagttattcagttgtgttggtgcgatttggttgatgttggttcgcatagaagttcctccacaaaatgaattttctaaagtataaccgagataaaaaggtctgtcaattaagaattgtcagataattgaaaacataaaattgaaaacattaagaaaatattgcgaaaaagcagaagaaacgccaggaagtgttgacttttatagaaaataagtgtagtatatgaagttgcaaaaactatctgatgaagaaaaggcagaaacgaaatattgtccgtttcggctttaatataaggaaacaaaagtagaagctcacgaagtaaggtttcaagagaatgttctatttttggtttttttttgcctaaaagccgcaaaaaatgtctgttgttacctaaaaataatatttgaaatattattgtaacaattgatcgggtagtctttttgaatgacattttagaggggtgaagagcttggctggacacgtagtaaaatacggaaaacatcgcgaacgtagaagtttcgcaagaatcagtgaagtgttggaattaccaaatttgatcgaaattcaaacagactcttaccaatggttcttagatgagggacttagagaaatgtttgaagacattttgccaatcgatgacttcaatggcaatctatctttggaatttgtagattatgaattgaaagaaccaaagtatacagtagcagaagctcgtgcgcatgatgcaaactactctgcaccattacatgtaacattgcgtttgacaaaccgcgagactggcgaaatcaaagcacaagaagtattcttcggtgatttcccattaatgacagaacaaggaacattcatcatcaacggggcagagcgagtaatcgtttctcagttagtccgttcaccaggtgtctatttccatggaaaagtcgacaaaaacggaaaagaaggattcggttctactgttatccctaaccgtggagcttggctagaaatggaaactgatgcaaaagacatctcttatgtacgtatcgaccgtacacgtaagattcctttaaccgtattagttcgtgcgttaggatttggttccgatgatacgatctttgaaatcttcggcgacagcgaaacattacgcaatacagtcgaaaaagacttgcataaaaacgcaagcgactcaagaacagaagaaggtttgaaagacgtttacgaacgtttgcgtccaggcgaaccaaaaacagcagacagctcacgtaacttgctgaatgctcgtttcttcgatccaaaacgttacgacttagcaaacgttggtcgttacaaagtaaacaaaaaattagatttgaaaacacgtctattgaatctgacattagctgaaacattagttgatccagaaacaggcgagatcatcgttgaaaaaggaacagttctgactcaccaagtcatggaaacactagctcctttcattgataatggcctaaattcagtgacttactacccatcagaagacggtgtggtcacagatccaatgactgtccaagtcatcaaagtattttcaccaagagaccctgaacgtgaagtaaacgtgatcggaaacggctatccagaagcagctgtaaaaacggttcgtccagccgacatcattgcttcaatgagctatttcttgaacttgatggaaggtatcggcaatgtcgatgatatcgaccacttaggaaatcgtcgtatccgttcagtcggtgaacttttacaaaaccaattccgtatcgggctagcacgtatggaacgtgtggttcgtgaaagaatgtcgatccaagatactgaaacattgacacctcaacaattgatcaatatccgtccagttgtggcaagtatcaaagaattctttggttcttctcagttgtcacagttcatggatcaaacaaaccctcttggcgaattgacacacaaacgtcgtctttcagccttaggacctggcggattgactcgtgaccgcgccggttatgaagttcgtgacgttcactactcccactatggccgtatgtgtccgatcgaaactcctgaaggcccaaacatcgggttgatcaatagtttgtccagttatgcgaaagtaaataaattcggatttatcgaaacaccttatcgtcgtgtagaccgtgaaacaggtcgtgttactgaccaaatcgactacttgacagctgatatcgaagaccattacatcgtagcccaagcaaacagcccattgaatgaagatggaacatttgctcaagacgttgttatggctcgtgctcaaagtgaaaacttagaagtatctattgataaagtagactacatggacgtatcacctaaacaagtagttgccgttgcgacagcatgtattcctttcttggaaaacgatgactccaaccgtgccttgatgggtgccaacatgcagcgtcaagcagtgccgttgatcaatcctcaagcaccatgggttggtactggtatggaatacaaatcagcgcatgactcaggagctgctttgttatgtaaacatgacggtgtcgttgaatacgttgatgcttctgaaatccgcgtacgccgcgacaacggtgcattagataaatacgatgtaacaaaattccgtcgttcaaactccggaacaagctacaaccaacgtccaatcgttcatttgggtgagaaagtcgaaaaaggggatactctggcagacggaccatctatggaacaaggcgaaatggctctaggccaaaacgttttagttggtttcatgacttgggaaggatacaactatgaagatgcgatcatcatgagccgtcgtttggtaaaagatgacgtatacacttctatccatattgaagaatatgaatcagaagcccgcgatacaaaattaggacctgaagaaatcacacgcgaaatccctaatgtcggggaagacgcattgaaagatttagacgaaatgggcatcatccgtattggtgcagaagtccaagatggcgatttgcttgtagggaaagtcacgccaaaaggggtaacagaattatctgcagaagaacgtctattgcatgcgatctttggcgaaaaagctcgtgaagtccgcgatacatcattacgtgtaccgcatggcggcggcgggatcgttcacgatgtgaaaatctttactcgtgaagctggagatgaattgtcaccaggcgtaaacatgttagttcgtgtttatatcgttcaaaaacgtaaaatccatgaaggggataaaatggccggtcgtcacggaaataaaggggttgtatcccgtattatgccggaagaagatatgccattcctacctgatggaacaccaatcgatatcatgctgaatcctttaggggtgccttcacgtatgaacatcgggcaagtattggaattacacttgggtatggctgcacgtcagttaggtatccacgtagcaacgccagtatttgatggtgcaagtgatgaagacgtatgggaaacagttcgtgaagccggcatggccagcgatgcgaaaactgttctgtacgacggacgtacaggtgaaccatttgatggacgtgtgtctgtcggtgtgatgtacatgatcaaacttgctcacatggtcgatgacaaattgcatgcacgttcaatcggaccttactcattggttacacaacaaccattgggaggtaaagctcaatttggtggacaacgttttggtgaaatggaagtatgggcactggaagcttacggtgcggcttatactttacaagaaatcttgacatacaaatcagatgacgtagtcggacgtgtgaaaacatacgaagcaatcgtcaagggtgaaccaattccaaaaccaggtgtaccggaatcattccgcgtattggtgaaagaattgcaatcactaggtctggacatgcgtgtcttggatatcgaagaaacagagatcgaacttcgcgacatggacgatgaagacgacgatttgatcactgttgatgctttgacaaaatttgccgaacagcaaactgccaaagaattagaaaagaaagctgctgaacaagtggaagatgaaaaagacgatgtcatccaaaactttgaaaccgcagaagataatttagactaatccggtctatgagctgcaaggcggtcgaagatcagccgtcttgcggtttgccattaaatgaaatggagggaaccccttttgatcgatgtaaataaattcgaaagtatgcaaataggtttggcttctcccgaaaaaatcagaagctggtcttacggtgaagtaaaaaaacctgagacgattaactatcgtaccttaaaacctgaacgcgaagggttgttctgtgagcggatttttggtcctacaaaagactgggaatgtgcctgcggaaaatacaaacgtatccgttataaaggaatcgtttgtgatcgatgcggagtggaagttactcgttcgaaagttcgccgtgaacgcatgggacatattgaattagcagctcctgtttcacatatctggtactttaaagggattccttcacgtatgggtcttgtattagacatgagcccacgcgctttggaagaaatcatttattttgcttcatatgtagtcatcgaaccaggaaatacgaatttagagaaaaaacaattgttgacagaacgcgaatatcgcgaaaaacgtgaacaatatggacaagaattccaagctgctatgggtgcagaagcgatcaaacaattacttgataatgttgatctagatgcagaagcagccgaattgaaagaagaattgaaatctgcacaaggacaaaaacgtacacgtgcaatccgccgtttggatattttagaagcattccgcgcttcaggaaatcaaccaagctggatggttatggacgttatccctgttattccaccagatttacgcccaatggttcaattagaaggtggacgttttgcaacaagtgacttgaatgatctttaccgtcgtgtaatcaaccgtaataaccgtttgaaacgtttgttagacttgaatgcacctggaatcatcgttcaaaatgaaaaacgtatgctgcaagaagcagtagatgcattgatcgataacggtcgtcgcggacgtccagttactggaccaggtaaccgcccattgaaatctctttctcatatgttgaaagggaaacaaggtcgtttccgtcaaaacttgctaggtaaacgtgtcgactactccggtcgttccgttatcgttgttggaccttttttgaagatgtaccaatgtggacttccaaaagaaatggctatcgaattattcaaaccattcgtgatgcgtgagcttgttcaacgcgaactagcttcaaacatcaaaaatgcgaaacgtaaaatcgaacgtcaagaagacgaagtatgggatgtcttagaagacgtaatcaaggaacacccagtattgctgaaccgggcacctacgcttcaccgacttggtatccaagcattcgaaccagttttagtacaaggacgcgcaatccgtttgcatccacttgtatgtgaagcttataatgccgatttcgatggagaccaaatggctgtccacgtgccattgaatgaagaagcacaagcagaagcacgtatgttgatgttagctgctcaaaacatcttgaaccctaaagatggtaaaccagttgttactccttctcaagatatggttctaggtaactactacttgacaatggaagaagaaggacgcgaaggcgaaggaatggtcttcagagatcaaaacgaagccgttatcgcatggcgcaacggatatgttcatttacattcacgtatcggtgtgaaccctaactcattaggtgaaaaaccatttactgaatggcaaaaagaacgtacgatgatcacaacagttggtaagatcatcttcaacgagatcatgcctcctgaattcccttatctgaatgaaccaacagacttcaacttgaccgtccaaacaccggacaaatactttgttgaagctggtactgatattcccgcacatatcaaagagcaggaattagtattaccgttcaagaagaaaaacttaggaaacatcatcgcagaagtcttcaaacgattcaaagtaacagaaacttctaagatgcttgaccgtatgaaagacttagggtataaacattcaacacatgccggtatcacagtagggatcgctgacatcagtgtactgaatgaaaaacaagaaatcattgaaaatgcccataaacaagttgaaactattacaaaacaattccgtcgtggtctgattacagatgacgaacgttatgaacgtgtcattgctgtttggaacgctgcaaaagacagcatccaacaaaaactgatggaaggtttggaagcgaaaaacccaatcttcatgatgtctgattctggagctcgtgggaacatttccaactttacacagcttgccggaatgcgtggtttgatggccgctcctaatggtcgaatcatggaattgccaatcatttcgaacttccgtgaaggactatccgtcttggaaatgtttatctcaactcatggggctcgtaaagggatgaccgatacagccttgaagactgccgattcaggttacttgactcgtcgtctggttgatgtggcccaagatgtaatcatccgtgaagaagattgcggtactgaccgaggtcttgaaatccaagcaatccgcgaaggaaatgaaatcatcgaatcattagaagatcgtttagtgggacgttacactcgtaaagaagtacgtcatcctgaaacaaatgaattgattatcgcaggaaaccaattgatttccgaagacatcgcaaaacaaatcgttgatgcaggtgtcgaaacagtgacaattcgttctgtcttcacatgtaatacaaaacatggtgtctgcaaacattgttacggacgcaaccttgcaactggctctgacgttgaagtcggagaagcagttggtacgatcgccgctcaatcaatcggtgaacctggtactcagttgacgatgcgtacattccatacgggtggggttgccggagacgatatcactcaaggtcttcctcgtgtccaagaaatctttgaagcacgtaatccgaaagggcaagcagtgatcacagaagtaacaggggatgtcatcgatatctcagaagatcctgcaacacgtaccaaagaagtaacaatcaaaggaaaaacagatacacgtacgtatactgttccttatacagcacgtatgaaagtagcagaaggcgatatgatccaccgtggtgcaccattgacagaaggatcaatcgatccaaaacaattgttgcaagtccgcgatgtattatctgttgaaaactacttgcttcgtgaagtacaacgtgtttaccgtatgcaaggggtagaaatcggcgacaagcatattgaagtaatggttcgccaaatgctgcgtaaagttcgtgtaatggatccaggtgatacagatatcttaccaggtacattattagacatcgcagactttaaagatcaaaactacaatacgctagtctcaggaggcgttcctgcaacttctcgaccagtcttgctaggtattacaaaagcatcattagaaacaaatagtttcttatctgctgcatcattccaagaaacaactcgtgtcttgacggatgctgcgatccgcggtaagaaagatcctcttcttggtttgaaagaaaatgttattatcggtaagatcatcccagctggtactggtatgcaacgttaccgtgacatggaaccaaaagaagtcggtgtagcaagcgaaaatgtctacagtatttcagatattgaagcgcaaatggctgcagaagacgcaatgaacaatcaaacaaaatagatattttacaaaagaggttgtgacaaattattgtcacaacctcttttttggtttttctaaaataatttgtctaactagaagaaaagtgggaaaggatcttaacaacatcgattcgtatcccattaaggtatcggaacgatcatcttccaagagaagtcaatcaacaaaagtaaagatagatcattttttgaatgcaaaataaattgatgggaagatagagcggttatttttaatattttgctagctattattgaataattcctcgaataaaacaaaaccagtagacatgtctgttattctatttatgttttagagataagtatccccaaataacatggattgaaataagggtaaatgtgtttaaaaaaacgaactataaaaacttatacacaacgtggttaaaaatagttttttcttccctgtggaaaaaatagtttaacacaaacattatagttatccacagctatctaaaacagatggaaaataaagaaaaatccgctaaaataccgggagggggtaatagggggtgagtgattgaaaaaagaacagagtaactgacttatcctcagtgtttctgttcttttataaatctgccctatatttcttgttgttggatcgaatctgtgagagtaatttcggttgaaagaatgattcttttttcttctgggtattggtgatggatcaattggaataaaagttctgtggctttgattcctaactgatttgttggaatgtctatccgagtcagctgtggcgaaaatagggaggacaataagggatcactgaatcctgcgatcgaaagatcatcaggtatctgctttccagtttgttctgccactttgtaaatactcaatgattttaatgcatcggtagaaaaaatcgcagttggtctttctcgcagcttcattaaatcattcattgctgccatgctgtcttctaagcgaaagccgccgtctatgatccattcattacggatatctaggtgatgatcaaataagcattgacggtaaccattgagacgatcattggatacataaacttctgtcggagcatggagacagccgatatgacggtgtccattcttgatcagtgtttccaccaaatcgtaactatcctggaaattatccgtgtccactgagtagatgttcgtgtagtcgtttccgacttttccgattaccacaataggaatattgtattgatccaattcaaaaagaagtgtttcatccatcgtagagcttaaaataataattcctcgaatcattttttcttggatctttttcgcgcatttttctagctcttcttctggtgtttttgccgtttgtagaatcaagtcgaagttattttgttcagaaacggcagaaatggattgaatgacatctgaaaagaagggattgccataagtcgtatgggatgtgcgatgggataatgctaaaatcgcatcaaatccacttcctgatagtcctcttgcaattttgctcggttcataatttaattctttgattgcttgaagtacactagactttgctttatcagatatatttggctggttatttaatactctagagacagttgattttgagacattagcttttttcgcaatgtcataaatagttggtttcaattttatatgcacctcctttttgggagcgttttagaataattccatagtacaatagacattcttttttgtctatgattttgaaaatggaggaatagcttagaggataataagagatcatatttttttaagaatccactaactattgatacataagctttcttatttgtatttttgcgtatatcaaaattatttaaaaaaaacgctattgacagtaagcgttttccataatatgatcgagttgctgggaacgctcccataaaaagaaaggggaatccgatgtatacaaaacttttacaagcaatttatcgcgactcagatttagctgaaaaaatcgcctctatgattgaacaaaaagtcagtgattatcagcagaagaaaggccaggcaggcaaactgcattgggacgaagaagatattttcttgattacttatggagatcaattttttgaagagcagcaaccaactttacgtacatttaaaaaattttatcggaagtatttggcagatacatttagtgttgttcatttcttgccattttttccatatacatctgatgatggtttctccgttttagattatcaggcaatcaacgaccatttgggcacatgggacgatgtagaagaaatgagaagcgaaacaaggttgatgttcgactttgtctgcaatcatatgtctgccgaaagtacttggtttcaggaatatttaaacttgaatgatacgtacaaagatttttttattgatttgccactggatacagatacaagcagcgtgactagaccaaggaccagcccgttacttacaacgttcattgacaaaaacgggaaagaaaaacacatatggacgacttttagcgaagatcaagtagacttgaattttaaaaatccagaagttttattgaaaatgatcgatattcttttgttttacttagaaaaaggcgcttcatttattcgcttggacgctgtgggatttttatggaaagaactaggaacttcttgtatacacctgccagaaacgcataaaatcatccaattattccgtgcaatcgctgatgaagcagctccaggaacggtattgatcactgagacaaatgtgccacacaaagataatatcagttattttgggaatggcgagaatgaagcacagatggtctatcagttttcgctaccacctttgacccttcaagcgattcgttcgggtaatacaagtaagttgaaagaatggttaaaaaccatcgatttcgcatcgaaaaaaacaactttttttaattttttagcctcccatgacggtatcggattgaatccggtacgaggtattctgccggaaaaaacgatccttgaattagtggaacagctgaagaaagagggtgcccgagtaaactacaagaaaaacccagatggaacgaccagtccatatgagataaacgctacgtatctagatgcgttaagttctccaacagatacgacggaatggagaagcaaacgctttttagctgctcattcatttttggtaacgttaccaggcgtgccggcaatttatattcaaagtgtgctgggaagtcgaaatgattacaaaggcgtagaaaaaacaggagagaatcgaaaaatcaatcggcaaaaatttttgttagcagatattgagaaagagttgcagacagatccattaagaacagcagtatatggtgaattgacccagatgctatctattcgaaaaaaagaaaaagccttccatccgaatagtttgatttacttactggactcagcagattcttttatcagttttattcgcgaagcgaaggaagagaaagtcttagttatccataatttttccaatcaatcagcaggttatcttttaccaaaaggagattacctagacctgttttctggacaaattatccattgcagtcaagaacgaaagttgatattccagccgtatgaatacatgtggctgaaaataataaaataagaggtggaaaaaaatgaaaaaaattattgttactacctgtttgctagctactggatttcttcttactgcttgtggtgaaagtcaaagctctaacgaatcacaacagacaacgattcaattcatgcactcttctgtcgaacaggaacgattaagtgtgatcaatgaactggttgctgattttgaaaaagaaaatccagacatcaaaatcaagcaagtgccggtagaagaatcagcgttcaatacaaaaatcgttacgttagctcgttccggtaaattaccagaagtaatggaagtcagtcaggattttgctaaagtgatggataaagatgaactgattgatcagacggcagtccaaaacgttatcgaggaagctggagaagataattattatgacggagccaaaaaccttgttcgttcagaagatggaaaaagctatattgctgcaccaattagcggctgggttcaaggtatttggtatgacaaagaaaaattatcagaagctggtttttcagaaccagaaaattgggatgatattttaaaaattgctcaacatttcacagataaagagaataaacaatatggaattgctatgcctactgctgaaggaacaatgagtgagcaagcgttctctcaatttgctttgtcaaatggagcaaatgttttggatgatgaaggcgaggtaacgatcgatacggaaaagatgagagaagcattgtcgttttatcaaaacttatcccaatacacgatgccaggctctaatgatgtgacagaaatcaaagatgctttcatgaatggaacagcaccaatggcaatctattcaacttacattttgccttctgtttatgaagcggggaactcagaaaatatcggttttgctatcccaacacaaaaagatcaagctgtctatggcacagtatctggattgacgatttcttctggtctagacgagaaacaaaaagaggctgctgaagcattcacagctttcttatctcaaccgaaaaacatggaaaagtgggtcttgatgtctcctggtggtgctcaaccagtgaataaacaagtagtcgaactggatggttacaaagaaaatgaagtcatcaagtcttttggcgagctgccatctgagattgctagtgcttttgatgaagtacaagtctttggactagtcggggaaaagaatttcacgaaaatgggagatatcacaagctcaggtgtgatcggaaaagcagtgaaccaagtaactgtcggaaacgaagatgtcgatcaagctttagctgacgcacaaaaaaatacgaaataacaagaagttctgccaatggtgttcgaaaaaagtagatagctattggcagattatcagggggaggtttcaatgaatcgtccaaggaaacattctgacttaaaattagccatgggacttttagcaccaagcatgcttttattagctgttttagtgctgattccaatgctttccaatattcagatcagttttttcgatatgccgctgaatcctaacttagacgccgtttttatcggattaagcaattatcttgaaattttaagtgatagtgaattttatcgttctttaggtttaacagttgcttacacattcttagttgtagcaggcagtacagctttaggattagccgtagctattttgcttaaccgcaagttcagatttaggaaaacggtgcgttcactgattttattaagttatgttacgccatctatttctttgatttttgcttggaaatatatgttcaataatagttatggaatcgtcaatgatctgttagtagataggttgcagcttttcaacgaagcaccgctgtggttcgaccagccagttgctagcttctttatggtcgttttgtttgctatctggagatactatccgtatgcgtttatttcatttttggctattttgcaaacagtcgacaaaacgctttatgaagcagctgaaatggacggtgcaaatgcttggcagaagttcaagatcgtgacactgccggcaatcaaaccagtactagcaactgtgattgttttacgatctatctggatgttctatatgtttacagatgtctatctactgacgaataaagtcaatatcttaggcgtttatttgtatcagacagcctttgcgttcaatgatcttggaaaagcagcagctatatcgattctattgttcatcattattgcagcggtcgtcttgctctcacgaaagaaggtggacttgaaatgaaaaataaaaagagcaggaaaatcttattttacgcgacgattttgttgctattagctgtcaatttgtttccatttttgatcatgctgatgacatcattcaaggattcacaagaagcaattgcaacgacacaaactatttttccgaaagaatggacttttgaacattatcaggatattttcaatgctgagatttttccattcatcatgtatttcaaaaatagtttagtgatctccttgatagcctccgtaactgcagtagtgattgggatcagcggggcatacgctttgtcaaaactacgcttcaaagctcgctcgaaaatcaatgctagcttttacaccgtttatatgttttccggtattttgatcgttgttccattatttaaaatcatttccggtctaggtttgtatgataccaatacagcactgattatcacgatggtcgttcaaacacttcctactgcgatattcatgctaaaaagttattttgacacgattccgactgatattgaagaagcagcaatgatcgatggtcttagccggatccagatcattattcggatcattataccattggctatttctggaatcatttctgtcttcgtttattgctttatggtttcgtggaatgattatttatttgcttcgattttcctgtcgacctccgaaaaatttactttaccaatcggtttgaacacattattcagtacaccagactacatttggggacgaatgatggccgcttcattggtgaccgctttaccagtcatcattatgtatgcgttatctgaacgatttattaaaggtgatttagtcgaaggcggcgtaaaaggataaaaagaaaagaaagaggaaagaaaagatgaaaaaattagttgcattagaaccaagaatagccggattcaaagattacgaagaccgtgagatcgaaaagaacgaagtacgtatccgagtaattttcgctactccaaaaccaggaacagaaattgtcgactttagaggattaagtccatttatcgatgaagaattttcagaagaatggcgcctattcttgccaagagaagaaggaagccaacgcggtgtggtatttggcgaatttcaattaggaaatatgattgtcggtacgatcgaagaaacgggcagtttggtgacagagtatcaaaaaggagagttagtctgcacttatggacccattcgtgaaacgctgattacaaacggtgttgataattataaactacgtaaacttgatcggttggatcaatggaaaaatgcagtatgttacgatcctgctcaattcgctttaggtggtatccgggaagcacatgttcgagcaggtgatgctgtagcaatcttcggtttaggcgctatcgggcaaattgcgattcaattagctaaaaaagcaggtgctactaccatcgttgggatcgatcccatagcgcagcgtagagaattagcagaaaaatacggtgccgattacacgctagatcctatgaaagcagatgtcggttttcgtctaaaggaattgacagataaacgtggagtagattcagttattgaaacgagtggcagtgctgccgcattacaagcttctttaagagggatcggctatggcgggatcatttcttatgttgcctttgctaaaccttttccagctgggtttaatcttggtcgcgaagcacatttcaataatgcaaaaatcgtctttgctcgagcatctagtgaaccaaacccagattacccaagatggaaccgtaaacgaatcgaggacacatgttgggaattattgatgaacggttacttggattgtgaagaaatcattgatccagttgtgccatttgcagaaagcgcagaagcttacatgcgttatgtagaccagcacccagaagaaagtatcaaaatgggcgttcaagtccgaggaggagaacaatgaaattcggtacgcaagatcaagcatttttcccaagagacattttagaaaaatttagatttatcaaagactgtggatttgaagaatacgaaatcgacggtaagttgttaatagaaaatatcgacacagtcaaacaggcaatcaaagaaacagggatcccagtagtgacagcttgtaacggctacgatgggtggatcggtgactttatcgaagaacggcgtcttaatggtgtacgtcaaattgctgagattttgcgtgcactaagcgaggttggaggcaaaggaatcgttatcccagcagcttggggaatgttcacttatcgattaccgccgatggtttcaccccgaagcaaagaaggagactataaagcagtcagcgaatcacttcgttatttagataaagtagccgaagaaacaggtacggttatttatttggagcctttgaaccgataccaagaccatatgatcaatttgttagcggatgcgcgtcattacattgactctaatcaattgaaacatgtgcagatcatcgctgatttttatcatatgaatattgaagaagatgatatttcaaaagcattgactacgcaaaaagagtatgtgggtcatatccatttagcagataatcatcgctaccaaccaggatctggcgcaattgattttactcgccattttcaaacgctacttcaaaatgagtatgaaggttatatggtatatgaatgtcgtttgcgaggagaaaatgaagtgaaaatttatcaggaatcattgcaatacttgaaaaactgtctggaaacagcgcgtcatttaaatgatttagagaaagaatagagaaagaataacaataagtaaataagcaaaggagggagaaataaatgaagaaagtagcaatcataggcgctggacaagtagcagaaaaagtacatgctgcttattatcaaaaaagatcagatgtcttagaattggccgctgtggttgatccagtcagccagcgagcagaagacttttgccgacgtacaggattttctcatgcgtatacatcagttacacaaatgctgaatgagatttctcccgatatcgtgagtgtctgtacacccaatcgctttcacttcgaacatgtattggctgccctcgaagctaatgcttcagtgatgtgcgagaaaccaccagctatgacagctgatcaagcaagaaagatggcagagacagccgataaaaacgggcagattttggcttatggattccagcatcgtttttctgacgaagcaacaatgatcaagaatcatcttgatgttctcggggatatttattacgtagaagcgaatgcgcttcgtcggtctggtgttccaggctggggaacgtttatcgacaaagaacttcaaggaggcgggcctttgatcgattatggcattcacatgcttgatacagcgatgtatattactggatttcctaaagtaaaaagcgttcgggcgtacagcttccaaaaaattggtacgaaaaaaaattcagggaaattcgggaaatgggatccaagcaaattcacagtagaagatgcaatttttggcacactggaattagaaaacggcaagatcatccaactgaatacttcgtttgctttgaatatcagagaagacaaactgaatgtggctttttgtggcgatcaggcaggtgctaatctgtatccaggcgaactattcgaagatgtagatggaaagctggtttccttacaaaagaccacgccagttaatgacccacatgaactaagtatggctcattttgtgaatcgggcgctcggtgaccagactcagatgattgcagatggctggcaaggatatgtcatccagaatctggtggaaaatttatatcgttcggcagaaacaggagaagttattaccttatgaaagtagaagaaaaacagtttgatttagagtatatcaataagtatgcgagtcagatgaccattggaaatggattttttggtatcagaggaagccaggaggaagactatcggaatcaagtaaggggaatgtttgcagctggtgtatataaccgacctttaggagcagaatcagccgagttagtgaatctcccagatgtcatcagatgggaaataaaaatcgacggtgaacatttttctcttgagacgatgaaagttcttgcatacgagcgggcactagatttagaaatgggagagcttaaacgctatgcgctcattgaaactgctcaaggaaaaaaagtggaagtcattacttgtcgtgttgctgatcaaaataatctccatcaggcagccctgaaagtggtcatcaagccgttgaccgaagactgccaagtagatgtgaaaacgggtatcgatggacagcaaaccaattttggtacacagcagttggttgaaaaagaactgcgagtatttggtgacgatttgatcagtgcatcctaccagacaacagaaagtaaaattgatattgggattgcagctaaattcaataaagcaggtgtattccaagcaaaaaatcgccggatcaccgcttccttttcagaaaagatcagaaaaaatacgtcctttacgctggagaagatcatcgtgctctctacctctcttcagcaaacagacccgtttaagaaaagtattgcccaagcccagaaaagcgttagttatacagaaattttagagcagtcgatgtcttattggacagatttttggcatcagcatcggataacgatccaaggcgattcttctttcgatcagttagcgatggacttcgctgcttaccatttacagattatgactccccgcaatgatccaagtgttagtgtaggggcgaagggactaactggcgaaggttataaagggcatgttttctgggatacggaaatttttatcctgcctttctttttatatcagtttcctgaagtagcaaagaatttgctgctgtaccgttatgatcgattagaaggcgcacggcaaaaagcaagagattatcactatcaaggtgcacttttcccatgggaaagcgcacacactggtcaggaagagacacccaaatttgctgcattgaatatcaaaaccggaacaagacaagaagttgcttcagctgccgcagaacatcatatcagtgcagaccttgcttatgccgttcaagagtatgtccaagcaacagaggatcaatcgtttttagaaacaaagggaaaaacgctcattcatgaaacagcagctttttggctgagcagagctgtaaaagtcgatgatcatttagagatacacagagtcattggtccagatgaatacacagaatatatcgacaataatgcatatacgaactatctggcgcattataatgtggccttagctgttaaatatcaagctggcgatccgctttttttgaaagaatgtcaaaattttttagataagttatatttgccagtgcctaacaaagaacagctgattccgcaagatgacacgtatctcagtaagccagttattgatttgaccacttacaaagaacgtcctggcagccagtctattttacttgattatgcccgtagcgaagtaaatgaactccaagtcagcaagcaagcagatcttgtcatgctgttatacttattacctgagtatttttctcaaccaatcgtttctaagaatttgcattactatgaaaacaaaacaatccacgactcatcgttgagtaaagcgattcacgccatagaggcttgccgtatccaagaaatggaatgggcgtatcatttattccaagaagcgtgcctgattgatttaggaccagatccgcattcatcagatgacggaattcatgctgcttcattaggagcactatggctagcagttatatttggtttttcaggtattacagtaacgaatggaactctttctatttctccaagacttccttcagcatgggaaaaaatttcttttccttttatttggaaaaatcacaggttgctatttgttttgacaaaaaaacaaatagtaataaaaaaagagacgaaagaaacattacctatttttgtcaatggagaccaataccagctggaaaaagaactgatcttggaacggaggggaaaataatgcgtattctgattgcgccagattctttcaaagaaagtctgacagccttagaggcagcacaagccattcaatcaggttttcaagaagtttttgttcaggctgaatatgatctgctacctataggcgatggaggagaaggaacggtttcatcattagcagacagtttaaggttgaagcggcaaacagcagtcgttactaatgcatttggcaaaaacaaagaaatccagtacgcttcagacggtcaaactgcgatttttgaaatggcagaaatcgtcggattgaaagatgtcccactaaaccaacgacagccacttaggttatccacgcgaggagtaggagaactgatacgacaattgttgcaacaaggtgttcgacacatcatcatcggcgttggcggaagtagtaccaacgatggcggcatcggcatggcagaaggtctaggttatgctttttacgatcaagataatcaaaaagtagaagcactgggagaaaatctaggtaaaattgctacagttgataaaacgaacgtgcctattgagctgattaaagccaaaatcactgtcattactgatgttactaatcttttatgcggaaaagaaggcgcttcttttgttttcggaccacaaaaaggcttgaaagaaaatgaattagcagtggctgaccaagccatgcatgatttttatatgagatttgcccctcaagtaatcgaggcatcgggcagtagtgctggtggtggaatgggtgcaggactgttagcatttgcttcagggaaaatagtctctggcatcgactacgtattggatttactggagttcgataaacgggtacagcaagcagacctcgtaatcgtaggcgaaggacgtctagatggacaaagtctaaaaggaaaagcgccagttgggattgctagaagagtaccagagggcgttcctgtgatagctatttgcggaagtgttggtaaaggaagcgaaaaagcagcagatgttggcatttcggccgtttttccgatccttcctgcagctgtgcctttacaagaagctttacagcaagccactgataatcttcatcgcacagctaaaaacatcgcatctttacttcaagtcgttcattttcaaggaggtaatcgatgaaaatcaaagcagcactattcgatttagatggcgttcttgtagacacagctcgttatcattacgaagcgtggctggttttagctaaccagctgtccattccattcactgagaaagaaaacgagcaactgaaaggaatatccagaaccgagtcactagagcgattgctgtcatttggaaaaatggaacagaaattctcagaaaaagagaaatcagcctttgctgagcaaaaaaacaatctatatcttcaagcgattcaaaaaatggatgaaacatccgttttgcctggtgcaatagctgttcttgagtacttgaaaaaaacaaacatcaagatcggattgggatcagcaagtaaaaatgcacgcctcattttagaaaaaacgaatttgacaagttattttgatgtccttattgacggcacgcaagtatcaaaagcaaaacctgatccagaagtttttctcaaaggagcacagcaattgaatgtaccgccaaatgcatgcttggtcattgaagattcagaagctggttgtcaagcagctttggctggtaacatgcatgtattgggaataggtgaaaacataaatcttccttctgctgaatatgtgattcctgatttaaccgtttttgatcaagtacgttcgttttggcatttatcagaagccgtatcacgtatataatagtttccgttttttctgtcacaagcaaaacgttatcctccttttggaaatcaaggtatgatgagaaaaaagggggattttatatgacaaaaaaagcagttttcgcaggcggatgcttttggtgtatggtcaaaccatttgaagagcagccagggatcatttctgtgacatccggttatactggcgggcatgtaccaaatccaacttatgaacaagtaacaacaggcacaacagggcatacagaagcagtagagatcgaatatgatccagaagttatttcttatgatcagttggtggaaatctattggcagcaaaccgatccgactgacgcattaggacagttcgctgatcgcggtgattcttatcgtccagtgatctactataatgatgaagaagaacgaaatattgcagagcgttcaaaacaagcattgcaagacagcgggcgattcgataagccaatcgtgacaaaaatcgaaccaagaagcgaattttatcctgcagaagattaccatcaggattattacaagaaaaacaagctccattacaatctttatcgagaaggttctggacgtgcaggtttccttcgtcgacattggggcgtcaagaaataagaagccgaaaaagctacttatggaacaccgtatatcagaggttgtaaaaccagcattttgagctaatactgagggtcagctgattgaacaccatttagtggagaggttgtgaacctgtcgcctagctccaagtcacaaggatttggtaagagaacactatatatcagaggttgtgacaagtcgtttgtcacaaccttttttcaatacctaagatgaaggacaatcagcaacgcactgctcaaaaaaggaatgaaaggcagcttttccaacttttttttatgacagataaagtaaacagaaaaaacggatattccaaacagactagcaagaaacaagatctgaagcaactcttctagagacaagccaccactccaagaaagcatcaacagagtatcgccagctccgagataggattgaccatagcgaaggcacacaccgcctacgataaacgttaacagcacactttgccattggaagacgccggcctgcaaccaaaaaatccataaaattgcccaagaacagaatagcgtgtgagaatggaccatgaagtaaaataaatccatcaacgaaaatagcaaagccgaaagcatccatatgaacgtcgaaaaatttcttgcggaagaaaaagtaaagaaccaggcaaaaagaccaccacataaggcttctgccaacaaatagtagaagggcaaccgacacctgcaatagcggcagcgaaatcgttggacgatgatcgagagaatcggaatcaattcataccaagaaagcgaacgacagcatttgacacaatgagatctaggataaataatagagtgacctaacggaatccgctgggcggttaaacataaaaatgatccgatacagcaaccaatgataaaataaagtaacacgccatctcccccttttcaaaaccaagatacgcaagcttaaactaaatttttgtacatacataaaatttgaggtgaaaaaatgaacgtttcaatcggattagatatcggaaccacacaaaccaaagcagttgctttcacagatgaagcccaagaagcagcatccgcttattttcgctaccctttgatccaagaaacacaagggatggcagaacaagatcaggaattgatctttcaaggtgtctgcaccgttataaaagaagtaattaaacagttgccttcagacacaatcattcaatttgtctccttctcctctgcgatgcatggcctgatattgttggatgaagagaaaacaccgttatctcgaatgatcacttgggcagataaccgagcagcggacgaagcagaaaaactgaaatataccgtgcttggcaaagaattttatcggcagactgggacgccgattcatccaatgacaccattgaacaaaatcaagtggctgcaaaacagccaacctgaattattcaaaaaaactgcttattttgtcggtatcaaagactatatcttttatagattgtttggcgaactgatcagcgactacggaacagcttcaggaactggatattttgatatccatgaattccaatgggcagaagaagtgcttgactacttgaacattcgaatagagcaattgccgcaagtctttccttccacctatcaagtaacaggtctaccatcaaaaacagcagcagaactaggtttgccaaatgatatatcatttgttttgggaggggcagacgggccgctttctaatctagggttaggtgcttttggtgatacgatcgccgctttgaccgtaggaacgagcggagcacttcgttttattactactcagcctcagttccatccagaaatggagacgttttgttatgttctggatcagaaacattgggtagtgggaggagcgactagcaatggtgctggcatctttgattgggcagggcatacatttttacaggaagtcgttcaatctgctaaagaaaaaggagaaaatccatatgatgcactgctttcggctatcgcttttgtgccagcgggtgccaatggtctgatttttcatccctatttacttggtgagcgagcaccgctttgggacgcagatgcgtttggcagttttatcggtttacagcggcaacatacagaaaaagaaatgatgaaggcgattctagaagggatctgtctcaacctttatcggattttaaaaggagtttgccaggaaaatcagctcacagagatccgtgctacaggcgggtttgctcaatctccgatttttcgtcagatgatggctgatgtactgggttacccgcttgttttccctactgtcacagaagcatccgcattaggagctgtgattttaggctggagaagcatcggaaagatccaaagtatcagtgaagcacaggaattgatagaattgaaagagcaagttggagtacaagaaactgatcataaaaaatatcagaaaatctatccattatttgtttcgacacaaaagcatttagcacagacttatcagcaatttgctcaactgcgagaagaattagctgattctgaaaaatgattggctttacggataaaaaagcgaactgaaaatcgttctcaggtaaatgattttgttgtacttttcattgaaagtctactattattttaagtgtaagaaaatgttaggaggcaagaaagatgaaattccaacaaaccaaagaagtattaaatcaattagttgcagatctaagccaaatgtctgttgttgttcaccaaacacattggtacatgagaggaccaggtttccttacattgcacccaatgatggatgagttcatggatgatttgaacgctcagttagatgaagtatccgaacgcttgatcacattagacggttcaccttattctacattgcgtgaatttgcagataacacaaaaatccctgatgaaattggccgctgggatcgtactattccagaacgtttggaaacacttgttgcaggctatcgttatctagcagatctttaccaaaaaggaatcgaagtttctggagaagaaggcgacgatccaacacaagatatctttatcgaattcaaaacagccacagaaaaacgtatctggatgatccaagctcatttgggcaaagcgccagagatcgacgcgtaaaaactgttgttgaacttgaccgaaaaagaggttgtgaaatcagcgttttgacctgagtattagagaaacaaacgtcaaaatagttcctcatattttgccgttttttgagctaataccgagggtcagctgattgaacaccgtttaccaagaggttgtaagcctgccgttcagctccgagtcacaagaaacaattttaaaaaacagcttcttatgttttatggatattgtgacttgtgaccgaggagttggcaggagaacaccgtttattcaaaataaggggttgtgacaagacttttgtcacagcctctttttgtttttcattttgacaggaaacgacccttttatataaaagaaagaaaagaagtaaagtttcatataaatttttcaatcaagcagaaaaacgttgacattgactagattagcgggtaatatgttaaatggtattgtttgccccacaaagagccccggaaactcgaagtgtatgtcaaacatcagaacttaaattggaggaaaataacgtgcgtacaacatatatggccaaaccaggcgaagtagaacgtaaatggtatgtagtagacgcaactgatgttccattgggacgtctttcaacagttgttgcatctgtactacgtggtaaaaataaaccaactttcacacctcatttggatactggcgatttcgtcatcgtcatcaatgcagacaaagtgaaattaacaggtaaaaaagcgactgacaaaatttattaccgtcacagcaactacccaggaggattgaaatcaatcactgctggcgaattgcgtgctaaaaattctcgtcgtttgatcgaaacttctgtaaaaggtatgcttcctaaaaacactttaggccgcaaacaatttacaaaattgaacgtatacggtggagcagaacatccacatgcagcacaacaaccagaagttttagacatcacaaacttaatctaataggagggaatttcattggcacaagttcaatatatcggcacaggccgtcgtaaaaacgcagttgctcgcgtacgtctagtaccaggaactggcaaaattactgtaaataaaaaagatgttgaagaatacattccacatgctgacttgcgtgaagtaatcaatcaacctttcgctgttactgaaacaaaaggcgcatatgacgtatttgttaacgtaaacggcggaggatacgctggacaatcaggagctatccgtcatggtatcgctcgtgcattgctagaagttgatcctgacttccgtttagctcttaaacgtgctggcttacttactcgtgacgcacgtatggtcgaacgtaaaaaaccaggtcttaagaaagcacgtaaagcttcacagttttcaaaacgttaatcgttgttataccaacgatttcagacactttctcattgcgagaaggtgtctttttttcgttctggtaatgagaaaggtaatgacaatattataaaccagtgtaagcaatgaatttttctaacgcatttcgttgagctttttcagtaacatgagaataagtgttaagggtagtttcagcatttttatgacccaatcgatcttgtgtttctttgatacttgctccaccttctagtagaagagtagcgtgagtgtgccggaatccatgaatagtaacgtgcttaaatttatatttcttctctaaacgtttcaatatattatttgaatagtccgcatgcaaaggttgattaatgtcaccgtctgcatttacataggtaaagataagttgattttttgtatttgtatttatgccaaactgcaaaagctctcgagcttgttcttttttccagatttttaacatttcaatagtttgtgcatcaattggtaatattcgttcggaagatatattttttgtatttttttgaatcctgacagtttttcttcttgcattcttctcttcatttcgaatagttgcatagctctttctaacatacattagctgttcttcaaaataaatgtcagaccaatgaagagcagctagctctcctttacgtataccagtagtaatcaaaagctggaagattaaaatatgttttaaaggctcttctttattgagaatatcccaaaaagcttttagttcttctaatgaaaagtaattttcattttctttcttttcccgctttggtagatttgtatttgccataggatttcggtgtaatagctctgcaaaaatggcatactcaaatatttgagagctgtaagacttaagctgtttgatattcttgaattttaaagcccattcattgactgcattctgacagtgaacaggagtaatcttagaaatggacttattcccgaattttggtagtatatgcaagcggaaaaggtcttttgtacgttgatatgtcgtttcttgtacacgattcctataagaaggcaaccattcttcatacactgttataaacaagtcattagaaggcttatgatagccggtatcttcaatctcgaccttttttcttgcttcgtgtaacttggcttctttttcagttttaaaccctttttttacatagtattcttgctttccattttcatctttacgaacatacaagcggacactatatcgtgcaccgctttttgttgtgtacttttgtattgacataactaatctctccaatctgataacttggcgagttggctgattgaataattagttttattgaagttttgatattaatcgagctgttatctctctttttagattgttaacctgtacttgggttaagttgccaaataactcagattctaactcttttctttcatcgatatttaagtttaaagctttattaataaacttcttttgtttggcaaatagaatcgtgtattcaaaggagtcctctagaatactttttaaaaaaagaaagtcggagtcatcttcttgaagtttgacttcaagtaaagaagtcatggaaaagtatagattagataattcagtaaaataatctgagtcaagactggcaatattcttgactattttgtcctttttttctaaacgagcagtttttattctatcaagattaggttgttctatggaatttgtttcgtctaatcccatcaaataacttacaggaacatggaaataatcagcaaggatattccatgtttcagtatttctaggatttcgctcaccacggtaatagttcgtaagagttgtatagttaataccagtttctgtactaatttgtttaatggtctttttactggaatcaatataaaattttattctattcaaagtaacgccccctatagtaaattccaaactattatagcatgaaaaccacaaattgagtaatattttaattgacattactcgttttgtggtttaaaatgtgcttattaagataaaaaccacaaagtgaataatttgaaaggaggcgctgaatgataactcttaatgatcaattcattagaagcttaagaagacatagagccgatcttatacttactaaaaacgatgcagcaaaattgataggtataaatcggaaaacatatgtcaaaatcgaaaatgggagcaaagaaagtattagagcatctacttatcaaaagttggtaaattggttacttaatgatttgaaaatctaaataaatacaacttggcgagttggctgattgaagaaatagaaaatgagaggagaaaaataatggatgcaggaattacagtaatgttagataaacaacaaacgaatcaattgaaaaattatgtttttgaaatgacaaaagaggctattgatcaagcaagaattgataccggattagaaagaccatttctaaaaggaaaagagatggctaaatatttgaatgtatcatatacaacttttttgaaatttaaaagaatgggattgccagttattttattagaaaaaatggagttgttttcaaaagaagaatgcaaaaaatggatattgagtcatcaaatttaaaaaacacctcgttttttaaatttgatgaagtagaaaaaattaaaaagagtgttcccgtcagtttgcagatcgggggaacactcaataataaagttctgagaaaactttatttgaatctattatagcaaataaaatcagaagcaggtgtgacaatgaatgaaaaagaagttgaaagcttagttgaaaagcaaggctattctaattctgatatatatgcagaattatactatcaatatcctatttttttaaacgtaaatgaaaaatataagaaaatgaaactaagttctaagttagtttatatgttactaaaagatagaaatagactttcattgaaaaataacttgtatgatgagaatcaaaaaatttttttgatatttgaaatcaaaaatctcgtagaaatttcgggaatgtcaaaaaatacaatcttatcagcactagatgaacttcaaaaagttaaacttcttgtgaaaagaaaaaatggcttcaataaaagtaaaatgcaaatgttcccaaatttttattatttgttaaagcctgttctgtgcaaagatgatgtttataaaattaataagataacccatcaagaaaatagacaaaaaaacttgatagttcaaaatttgaactatggaacaaatcaatattctgttgatagttcaaaatttgaactatgcgacacatcaatgaaaacaagagacaaaaacaattttgctgatagttcaaaaaatgaactagaattatataagtcttataaagatagtaaagatattaaagaatcacataatgatgatcttcttgaatcactttcaactaaaaataataaattagatgaagaattgatcgaaacatttattgaagaaaatcttcttaaacaaatatggggagaaagtattgtgaattgcttaaaactggctagcaatagtgattatcgtcaattcgacaactggtacaaaaaattcaaatatgcgattagatctgctgaaaaagaacaaaaaattcaactgaaaattatctatgaaatttgtaataacaagtattttgtagatcatgttagagaacagctatcaatgactttacgtgacttgatacgaagagcaaaaacagatcatcgtatcaaacaaaaagacgattatatctttgcttctctaaaaaataaagcgttagaactaattgaattgcaaatcagcgaaggaatagataagcaataagaatagaattgagtcaaatgaaatggaggggtatctccacttcatttgagaactttgaatataggaggggttattttgattaaaaatcgtttaatagatcaagtttggtgtctagatcaaaatacagatagtctcgaattaatcgagactatttgcttcaacactatagttctcgatttaagagctgaaaatgataattgtgtaactcatgtcataattaatcaaaaaatggctcagaagctctctgagagcctcagaaaatgggctaagggaggtaacgatgaaaataattgaaaaaaagattgccaataaaaaaataaattggttggttgttaattttcttgttctgatagctatgattatttttacaagtaatattgctcatgcgagtattttcaattggtttgatgacacaaaaagtcaaacagagtttttgaataattctctttatagaccttacctaaaaaagtacaatggagatttccttagtcagttcgggatttggctcggatgggctgtggtaaaaggcatgtttactgtgacagattcgattcaaaatatgattccagatgtgctggatttgttcaatttcattgaaagtacagggctaaataatgtttatcaatcagccgtaaatacaattgtcattggattaatgatcctttcattgatgtttgttggttacaaaatgattactggaaaaggaacagtggatttaaaatcggttggaatgaacgtagtgatgtctatagcattaatacttttaatgccaaccatgatttctagtggtattcaatttgctaaaacattttataaggactctactacgattacaaattcagatgacggagtcgcttggtcattgataaaacaaggagtaacagatttagcatatattaataaaacagatcagtactcaagcattgataaaacggaggatcgaaataatttaacacgaaaaaattttcaacagacggatctcacacaagtgttaacggataaagtgattgataaattggaaaaagaaaatccaattgcggacaatcttcgttatgaattagttgaaaattctaataatgaatttgttgctacaaagttttctgacaacttcttatcaacattttctgatagcttgaaatcaggctattaccgataccaagcaaatctatgggggatttcaattgggttgacagcgttagcaatcgcctatgtgttcagcgcgtttgtgatcattacagcaatactagaacttgcatttaaacgtgtgttaggtgttcttgtttttgcaacagatattgagacaggacagcgttcaaaagttgttctatcagatattctacaatgttacttaactgttgggtttcaaggatttgggttatcaatgtttgctatgtttatcaattttctgaactcaggacaaggtatctcaacaaatatttttataaaaacaattgcttatatctgtgccgtttttgttttaatcaaaggcagtggaacagtcatgagatactttggtgttgatattggactcaaagaaggctatgggcaacttgcttctgcttttggaatgggcgcaatgctgtttagaaaaggatcaaatggatttaatcgtgctaaaggaagcggagaaggagaagatcgaaaaccagaaaagaatttcggcgaaactctatcaaaaaaagctggcaaaactggaagagctttgggatatgcccatgaacgtggattatccggtttagcttcagatggagctacaatggctagtgaaagagcaacaaaaccatttaagagtatgcgtgatatagctaatgataccaagaataagtttaaagaaggtttagatgatggtacagtgtccgctattaataaaaatagcaaacctatgttagctaaaaataaagaagatgaaactggaaaatatgctgattccgtgccaacacgtctttcagatagaaaagatggtgctaaagttgaaaatgccgatagaattatgtctagttctgaacgtatgcgtgaagcaatgaaaaataatgctgaatcgaataataatcctgcaagcgcaattcagcaaaaagtccaacaagatattgaagaacgtaaaaatgctatgcacggtcaagctaagtctgctgaagaattaattaatcagaagcgtcatgaagcgaaatacacgcctgaagcaatgaatcgcgaggaaataatgttaaggaaacgtgtagaagggcggacaggcgctaatattgacggaaaagaagcgttgaccaaagaaagaattcaagaagctaaaaattcaaatacaggattagaaaaattagtcaaagaaaatccacaaaattctacaagtagtcatggtggccgatcagtagatgtccgagaaaatattcaaggttcactgaatggtcatgttggacggaatgttgatgtaagagagaatttacaaagttcttcaaatgctcaaggtactaagacaattgatgttcgagaaaatctgcaaagtagcagtacaagtcaaccaaaaacagtagatgttcgagaaaatgtacaaaattctacaagtagtcaagggtttaaatcagtggatgtccgagagaatgtgcaaggtagcagtgcaagtcaaccaaaaacagtagatgtccgagaaaatgtacaaagttctacaagtagtcaaggattcaaaacagtagatgttcgggagaacattcaaaaagatagtggagaaatgaaagaaaaaacacaaaaaatcaatatcgttgaagacagaaagtcagcgaaaaaatttgattcaaatcatgaaacagtgattattgatagtgaaatccgtgaaaatgataagggatcaaaatcaagacgaagattcacttatgaagacaatgagttattcagagatacacttaatgatcctaatccacttttcgataatttattaagaaataaaagggggggattgtcatgcaattaattctaaagattagtacgcatgatttcttagaacttgacgaattatgtgaatcagtaaagaacgcaacaaatgaaaaaatcacggtcactaattatattgaactgatgattcaagaagaattaaagatgaaaaatgaaatagagagcaatttcaaatgttgctctctagaaaaaaatgtgaggggataatcaatggatgataaacaaaaaatgtacgaaaaaaatcgcaaacatagtgaggccttaaattttcgtgtcgataaaaagacttatcttgaactgacattgattgcaaaacaaaggggaatttctagagcagacgtttgccgtgagcggttaaagggactcaaatatgaaccgccgttgttagctgaagatgatagggtagttttaaccaaacagttaaatcaaattggtaacaatttgaatcaagcggtaaaggcattaaatatcattgctaaatattttagagaagaatctgaagataaaaaagaaaagagcctacattttagttttgatgctagccgttacaacatttttaaagatgaacttgcgaatagcatagcaaaaaagttgatgattagttatccagatgacatttttttggagtccaatcggagtgccccctctttttttaaattatcagaagtagaaaaagaatatttcgaatattggatagaaaagcaaactagaccgggtacgaaagaagagtattcccaaaaagttgatcggaatttaattcactcaattcagattattgcaagtttaaaagatgaggtgaaacaactttgggagctactataacatcgaaaggacgcaagaaaaatttatcctcgctattacaatatgcagctaatccttcaaaaaaagaaaaatgtgttgcagtctcaggaataaattgtagtgatgatagtgaggaagcactgcaagaaatgaatttagtacgtaccaagatgaataaatctaaagatatagcacaagcgtttcatgttattcattcgtttgataagagtacttctaaagagttaagtattgataaaatgcacgaaatagctgtcgaatttgcagagaaagcttttccaaattcgcaaatcattgttgcaagtcacaatgataaagatcattttcatagtcatcttgtcattaataatattaacatggaaacatgtaaaaggttgcgtattgaccctaaagatttagaactaatgcgaaaaattaacgatcaagtcctcaatgaacatggtcttgaatcagtgaataatgagtactatgaaaacttagaaaagagaaccaatctttattcaaacgatccttctaagatgaaatatggaaaaattaattatcaagagtttgtgcaaaatgcgatcgaagcaacgttggaaaaatgcgaagtgaattcttttgaagatttttcggatcatttggcaaaagaatataacattgaagtttatcaattttcaaaaacaaataacaaacttggctatgttctttacaaacaaggtgtaaatttctatgagcgtagaggtgagttaattactttaggaagagataaacaatctagaaaagaaaaaagtcagtatgtcgaacgtacttttagtgcaagaaagttagggaaaagatattcatttgaatctgtttctgaacaacttgaaaagaatttagaagaatcacatataaaaaatttttttaatatggaaagagagcaagttatgtcgctaattagtggagtaaattacaaaactggtgagttaaatgtaccgtttgtggaattagattccatcgcacaaaagcaatttagcgaccgtgaaggcgatgaaaaattcattaaatatgatgacttcttgcgagaggtagacaagcattttgtaaatacaatgtctttagaagatgatcaagaatacacgattaaacttcatacggatgtgaatcctcaaactttacgtagtgcgaaaagtaaaacaatttctattaaaaagactgatcagaaagagttatttctaccggcaaagggttttgaaaattgttctcatacaccttctgctaaacagattcactatcaaatcagtcgcataatgaatgacgatgtaaaaatgtatcgtgctaaaaaggattatgaattcacacaacaaatgattgaaaatcagcaaaaaaggcaacaaaattttgaaatggaattctgaatgggcttgttagtggactttccagttttttgcctatgaagagttgcttggaaagaagcagtttttaggacatacgccagctacccatctacttgccagtcaatccgccccgctcacgctaggctactttctggcaagtcagatggcgggtaaatctctgagggagcaagctccctacagactccctcccaaaaaaagaaaggtggaagaaaaaaatgaactatccatattttaaagtctcggcttcagaagaaactaaagaaatattcaacaatttttacaaccaaaacaaaggaatttttggttcaaaggcaaatatgtttcgtgttatggtttcaaatttaccagtgttagctagtccatcaaataataaatttaatgatcctgaaagcattaaatttgaacaaaaaatttcagaactagaatcaatgataagtaatgaagtaattgaaaagctggatgacattgatcaaaagttatcgtattctctaaaaaacaaatacaaaacggaggagaaaaaagatgtttaaagtttacttcccgtttcagtggctcgttaaaggaattcttttagtgctactaggattgattctttttggaagttatctaacaattaaagccagacattttccagaagaaaagccaataaaaattgtaacaaaagatttaaaaataggtgaaacttatcaggcagatggggttgaactaacatttaaaaatattgaagtgaccgaaaaaagaaatgaatttgcacaacatgatcgtgtattacaagtgacctatacacttataaatgatacagaaaatccgatacgtccacaacaatggtcgattgaaaataaggatggtgaagaactttatgagtatgatatgatattggataatccagagtatattgaaagtggcaaagaagaaacagtaaattactattatgaattaccgattgaaaggcaggactaccaaatcgtagtacgtagagagaatggttacatagttgggttgccatttactttataagttttattttgttagtagtttttaaggtaatatcagttttgtgatttttgaaaatggaactgggagaatggctgaggaaaataaagttgttccgtttgaaacattagtgataaataaggaagagtttgagcaactttttcttgatttttttattcaatatgacatgatttatgattttagttcgtcactagatttatttgaattagaagcagaaataatagaaaacagtcgagagaagaatggtaaaatcattatttcagtagaaaaattcaatgaattattctcacaaacatttgaaatagatccagactattatcaaccacaagaagtttttcgagagtttagaaataagattattggttttagtcaaactacaaaatgaaagcttaataaagcaagtgttgatagaattattcctcaacgcttgctttattttatgggcacttcataatagaggtatagagaagagaggtgttcattttggatactattactccaacaaacttcaaagaaaatataggtaaagtgttgcaagaagtagttcattcaaattctgaaatagaaattactagggattctaaaaatggattgaacgatggcgtcattatgatttctaagagaaaatgggagttgttacaagaagaactttatttacaacgaacgggtacatgggcttatgtatctgatttaaatttttattaagttaaagaacggattcaattgcagcggtcattttcaatggagaagtttgtggtgcaaatcgttcgattactttgccatttctatcaatcaaaaatttagtaaaattccattttattgctttagtgacagtaccaggagcttcatttttaagataagtaaaaagaggatctgtattttctccatttacgtcaatcaattgatgcatagggaaggtaacgccataagtggttttacaagcttctgctgcttcagtcgctgaatctagctcttgtttaaattgattggaaggaaagcctaagataaccagaccttgtgtctgataagcttggtaaagttcttctaattgtttaaattgaggtgctagaccgcattttgttgcagtgttaacaatgattatcggtttgcctgcatattttttcaatgaatagacagtgccgtcttctaaagtagtttcaaaattataaatagacataaagttttctcctttctattttatataataaaaagagcgctaaactgaaaactagctatttgttttcccgtttagaactcttttcagacaataaatatttaataaaatacgaagataagatagctatattgcttctcatctttacgttcttttagaaactatgcttctacttcagaccattcatcgcgttttgctaaaaattcacgagccaaagcttgtgcaccttctagtgtatggctggcagcccagccacattgtgtttcattgcttgcaggtacttcagtagcttcaagaacatctttcattgttgcttcaagaacatctaaaatgtcttcgtagctttcatgattcaatacagtcaagtaaaagcctgtttggcatcccattggagaccagtctacgatgtaatctgcgtgattgcggattagttcggcagtcaagtgctcaagtgaatgtagacttggcatgtccatgtgttctttatttggttgtttaaagcggacgtcgtatttaatgatgacatcgccatgcgcacccgtttttcgatcagctacacgtacataaggtgctttgacttttgtatggtcaagattaaaactttcgacattcattctcatttgtaagactcctatctgtttgttcattcgttttgatgcttttcactaaagaattatttagtgaaatttacaaaaacgtctttctacttgattctaacacttatcgtttccaaggtgtagcaatctgaaatattttttagatttttctgctaagtcgtttattgggacttctagttcttgattctgtcaaatgcctgagctaaatcgtttatgagatcctgaccatactcaattcctacagaaagacggatcaagccgtcctttatgccagcctcttctcgtttttcttttggaatagacgcatgagtcatgacagaaggaatttccactaaactttctacgccacctaaactttctgctaaagtaaatagttggagtgattcaacaaatggaatagcagattcttcattttttaaagtaaaagaaatcattccgctaaagccgctcatctgctgcttagcaactccatggagttcatgatcgggtaatcctggatagtagaccttttctactgctggatgagaaaatagaaaatcagctaccacaaaagcatttttttgatgttcctccatacgaacacttagtgtcttgattccgcgctgaagtaaccagctatcttggggaccaagtacggctccgatagcattttggtaaaatccgatctgatcggctagatctttatggttagaagtcactaaaccagctactacatcgctgtgtccgcctagatatttggtaccgctatggacaacgatatcagaaccgagatctaaaggtctttgaaaataaggagtagcaaatgtattgtcagcaataactatcaatccatgttgatgagccagagtggcacttttttctaaatcagtaatctttagaagcggattgctaggtgtttcaagataaagtgcttttgtattgggtttgatggattgttctattttatcaagattactcgtatctatgatcgtgtactcgagaccatttttagtaagaactttgtcaaatagacggaatgttcctccatagacatcatctcctaataagatatgatcgccagcttgaaaaagagaaaaaacggcatgaatcccagaaagaccagaagaaaaagcgaatcctcgaacaccgccttccaaatcagcaatcagttcttccaatgcaaaacgagtaggattaccagatcttgaatattcatattgtttaggctggccgacgccatcttgccgataagtggatgtttgataaataggtacactgacagctcctgttgtgggatcttcactgatgcctccgtggatcaattttgtttgaatgtgcatgtttctttcctcctataagtaaatgttttttgataaatagcggtctgctgcgtctggaaaaatcgtaacgacacgatgaccaggtggtaaacgacgaatttctcttaatgctgctgcaaaagccgcaccactcgaacttccaactaatagtccttgttctcgtgctaactgcctagtatagttaaacccttctacatcagagattgtctcgatctgattgattgaaaggggagaaagaaacggcggaatgaattctacaccgataccctcaatttcgtgaggagctggatcaccaccatttaacacagagccctctggttctacaccgattattcgaatgtcgggatatttttctttcaaaaaggtagaagttccagcaaaggttccaccactcccaattcctgctacaaaactatggatattttctttgatttcatgaaagatttctggccctaacgtatgatagtaagcagcaggattatctttattttcaaattgaagaggcagatagctgtttgatatctcctctgcaagttttttacttttgctgatggcaccgatgattccttgctcactaggagaatggatgatctttgctcccaatgctttcatcaattgttgtttttctaagctaaacttctctggaacaacaaaaaccgttcttaatttgtatgtgagtgcggccagagcgatcccaattcctgtatttccggcagttggttcgatgatcgtcgttttttcattgatttttccttgggcaaatccttctttgatcaaataactgcccaatctatctttgatacttcctccaggatttaaatattctagttttgcataaatagcagaacctttaggcatagaatagtgctgattgtcaaagcgataaagcggtgtggaaccaatagcttctgtaattgtcgagataatcatatgggcctcctaaaaaaagataataaaaaaaggagctgactattaaatcagctccttgaaagacatagagaaaaattgagtagataaaaagataagttacctggtactcattctatgaagggcaattaatagacatgacaaatagtatgctgcttttatgcaccatacaacagcaacgattcaattgtttttggttgctgactgtcatgtgtatccctccaagtaaaatttttattaacgatagcatgaaaaaaaataaaagtcaaaggcttgaaagaaaaaaatatttcgatagcatcgtttacccgtgtttatttttctgacaaataggcatgagaccttaaaagatagagaatactctagttttctggccggttgtctgatacaataaagttgattatgataaagaaaagaaggagcaaaaataatgatctcagcaagtgatttaagagccggtatgactttcgtacaagacggcaaactgattaaagttctggatgcaagccaccataaacctggtaaaggaaatacagttatgcgtatgaaactgaaagatgtccgttcaggtgcaacatacgacacaacgttcagaccagaagaaaaatttgaaaaagcacatatcgacacaaaacctgtacaatatttgtacacgatggatgatacagctttcttcatggatttggaaacatatgagcaatatgaaattcctgtagaaacagtagaagaagaaatgaaatatatcctagaaaacatggaagtaaaaatccaattcttcggtagcgaagtcatcggcgttcaattaccaacaactgtcgtattacgtgttgtggaaacacaaccttccatcaaaggtgcaacagtcactggttcaggtaaaccagcgacaatggaaactggcttagtagtcaatgttcctgacttcatcgaaacagatgaattgttggaaatcaatacagcagaaggttcttatgtaaaacgtgcgtcaaaataattcgctaacggattgataagaatttgaaaacagagcttgacctcttgaaaggcagatcatcggatctgcctttcaagaggtttttttgtggaatcagcaaattgaaaaataaaaaagtatttgattttatttatattttgaaagatgaatggcaaaagctagagaaagaagaaactgcacttatttatgaagaaattgaaatgattcataaaattgaaaatatccgaactattccgaactatattgaagcgaaaatattttttcatcactaaatagtgttgaatttatgtttttatgtataaatagcttctaatagttcgggtattttgtttttataaccatttttattcttatttttaaaaaaatatttcgaaatatactagacaattcagaaaattttgtttaatattattccaataaaattcaaatctttatcaaatgaaattccaataaaaacggaaaaaaagtgaaaagaggaatgaaaaaatgacagaattgataattggcggagtcacagcaagcacattggcagaaaagtataagacacctctgtatgtgtatgatgaagaaaagatgagacaaacgatgctgtcattcaagcgaggctttgtatcgaaacgttttgatacaaaagtactttacgcctctaaagcattccaaacgattgagatgctgcatttagtccgtgaatatggattcgggctagatgttgtcagtggtggggaaatctataccgctttgcaagctgatttccctagagatactatctacttccatggtaacaacaagacgccagaggaactgatctatgcacttgaaaatgatttgttgcatattgttgccgataatttgatggaagttgaattattagcagaattaagccaacgctatttaaaaaaaatctgtatcatgcttcggttgaatgtcggagtagaagcacatactcatgaatatatcgtcactgcgcatattgattcaaaattcggcatgagctatgaaagtaaagagtgccaacaagcccttcagttgataaaagaaagcagctatctagagttagaaggatttcatgctcatatcgggtcacaaatttttgatgttactgcttggttagctgaaatcgacaaattgacgaattacttaaccgattttgaccaacctctttccttgaatcttggcggagggtttgggattcgttatacacaaaatgatcagccaatcccagtcgaagaggcactaaaaaaactgattgaatatacggaagaagctttggaaaaacgaaaactgaccattcgtcaattactgattgaaccgggtagaagtattgttggagaagctggtacaacactatacacgattggtttcatcaaaaagacaccacataaaaaatattactttgtagatggcgggatgacagataatatccgtccagctctgtatcaggcagaatacgattgtgatttagcagcaaaactgtcggaagaaaaaacagagaaagtgacgattgcaggaaaaatgtgtgaatcaggcgatgtggtaattaaagaagcttatttgccgaaagcagaatcgggtgatcttttagctgtttattccacgggagcttatggatactcgatgagcagcaactacaatcgagcgacacgaccagcagttgtttttgtcaataatggccaatcaagactgattgttcgcagacaagcattttctgatctactaaggggggaagtttcctatgatccttcataaatataatggctgcggaaatgattttatcttattagattacgcagaagacacagattatagtcaattagccgcttctttatgcacaaaagaaaaatatgatacagacggattgatcgccgtaaaaatcgatccgttggaaatgatctattacaacaaagatggcagccgcgcgccgatgtgcggaaatggcattcgctgttttgctcgatacgtaaatgatcagaacatgatgaatgaacaggaattcaacgtagagacattagcaggcacaagaaaaattacggtgttggatccctcacctttttattgcagcgtagatatgggagtgccagatgattctccggaaaaaatcaaagctaatcaaacttatccaataaaaaaccaggaaatagagatcaatggtgaaaaagtaacgatcactagtttatttttaggaacgattcatactgttgtttttgttgaaaatgcgcgtgaggaagtctggagaaaaagaggtgaactgatctgtcatcatcctttgttcaaagaaaaaaccaatgtcaactttgtagaagtagtcaatgaacaagaattgatcgtccgtacctatgaaagaggagtaggttggacacttgcttgcggtacaggttgctgtgcctcttatgtggttgctaaggaaactgggaaaatttcagcagatcaggtagttgttcacttggaacaaggagacttgatgatctctggtgaggatgcgatacaaatggctggctcagcagttcatgaatggacaagaatattggaggaatgaagatgataaaaggttcgatcgtggcgctgatcacgccgatgaatgaagagggatcagtagattatgctggtttggaaaaattgatccaattccatttagatgaacaaacagacggattattagttttaggtacaacaggagaatcttctacgctcacacaatctgaggaggagcagatccttcaactgacagtaaagaaagtggctggccgtgtgccggtgattgcaggagctggaacgaataatacgaaagaaacgattgaaaaagcgaagcattttgcttctttgggggcagacgcacttttggtcatcaccccttactacaacaaaacaagtgatgcaggactagctgctcattttacagcaattgcagaagcctcaccgattccgcttattttgtataatgttccttctagaacaggcatgtcgattccaatccatgtattagtaaatttagcagaacatcctaatatcattggtttgaaagaagcctcaggagatatggcttatgtgatggatgccgctcggttgattggaaaagaattcttcctttacagtggaaatgatgatttgatcctaccagtaatgagtgtaggaggaagcggtgtaataagtgtatgggcgaatatccaacctaaaatagtccatgaattagtaaaagatacgcaggacggaagatggcagcaagcaaaagaaaagcaattaaatgcacttgaactgatccatgccttgttcagtgagaccaatcctattcctgtcaaagcagccatgtcattattagacttaccttccggacctctacgcctgcctttagtttctctttcaaaagagaaaaagaaacaattagctcagcttttgttaaaagaaaggacgggtgaaaaatgagaatcggactgattggcagtggacagatgggagacagagtcgaagaagttgcacaagaaagaggagatacgatccttcttttacagacgtcacctaaagaagcaactacgcttgtttttccggaactgccagaaatgcttattgatttttctcatccagataatttagagaaaatcctttcgtatagcttatcatatcaacttccgttagtcattggcacgacaggttatacacaatcacagttccaagaaataaaagaacatgccaaacatgtacctgtgatgtatagtgctaatttttcgttcggcatcatggtgatgaatcaactaatcaagcaagcagctgcaatgttgcaaggctggcagatcgaactgattgaaaaacatcatagtcgtaaaaaagatgcaccatctggtactgcaaatatgctgcttcaaacaatccaagaagtgcaaaagctgcagcccgtatacaactggcaagggaaaaaaagagaagaaaaccaaattggtgtacacagtattcgtgcaggttctttacctggtgaacatgatgtattgtttgctgctactgatgaaatatttacgatcaaacatgaatctttttctaatcgaatctttgctgcaggcgcagtagaagcagcggactggttgaaagatcagtcaccaggttattacaaattagaagatttattaatggacaaaggggtgtaaaaaacgtggaagctcaagaaatcatccgctacattcaaacggcatctaaaaagacgcctgtgaaagtctatctgaatgtaaccgagccaatcgaatttaaagaaagtaaagtttttggtgaaggaagcagcttcgttgtttttggtgactatgagacgattgctccggttttagaagctgaatcagaaaaaatcattgaaatcgaaatcgaaactgctgcaagatacagcgcagttcctttgctagatattaaaaaaattaatgctcgtatcgaaccaggtgctattatcagagatcaagtgtcaatcggcaacaatgccgtgatcatgatgggagcgattatcaatattggtgcagtaatcggtgaaaacacgatgattgatatgggtgctgtcttaggtggacgagcgacagtgggcaaaaactgccatattggtgcaggagctgtcttagcaggtgtgatcgaaccagcatcggccaaaccggttatcgtagaagacggcgtactggtaggtgcgaatgcagtgattgttgaaagtgtccatatcggaaaagatgcagtcgtggcagcaggagcagtggttttagaagatgtggcagcaggcactgttgtcggtggaatacctgcacgtgtattaaaaataagtgatgatcagacaaaagaaaatacagcattgattgctgcgttacgcgaattatagaggagatggagaaaaatgcgcgaaatagatacctgtattgtgggggcaaccggattagtcggccaaacgatgctcaaagtgttagaagaatatgattttccagtaggacgattgaaattattagcttcaaaacgttcagccggtaaagtttgtgtattcaagaaaaagaaacacactgtacaggaattgacagaaacttcatttgaaggatatgatttagcgctattttctgcaggtgcttctgtatccaaagagtttgcgccaatcgcacgaagtcagggactatttgtcatagataattcctcagcatggcgggaagattcggatattccattaatcgttccagaggtcaatctggaagactatacattgaatcggctgattgcaaatccaaattgttcaaccattcaagcggtacttccacttaaagctttacaagaagcctttggtatccagcgagtcaattattcgacctatcaagcagtttctggttccgggcaaaaaggcattgaagatcttcatcgtacgcaaaatgacgaggaaccagttttgtatccttataatattagccaaacggtgattccggaaatcgatcagcctttagaaaatgggtatacaaaagaagaacagaaaatgataaatgagacccgtaagattctgcatcagcctgctttgccagtatcagcaacctgcgtacgtgtgccaatcgaaaatggacatggagtctctgtggcagttcaactgcaaaaagagtttacgacggaagaaattagagagtgtctcagccagtttccagggattcaattagaagatgatctagcagcacataaatatccgacgagcattcttgctagaggaacagatatggtttatgttgggaggatcagaaaagacacttctttagagaacggattgttgttctatacgactgccgataacatacgcaaaggagccgctgcgaatgccgtacagattgctgcagctttaatgcagaaaatagcggaggtggcaagatgagtaatacgctgaaagtagcgaaattcggcggaacatcgatgtctcatgaagagcaattcaaaaaagtccgtacaattgttctttcagatcccaatcgccaagtgatcgttgtttctgctttaggcaaacgtacgtcagatgatgacaaagtaacagacttactttatttgatttatgcttaccttcagcatcatgttgattggacacccctttggaaaaggatttgtgatcgtttcattcaagtaagagatgttcttgccctgcagttacctattgaagatgaactagcacgcatacagaaacaactggaagacgaaaagataactgaagattatttagtaagtagaggtgaatatctgactgctcaactgatggctgagtatcttggttaccagtttattgacgcaaaagacctgattttctttgactatgatgggaaaatcgatcaggaaaaaacagcacaggaaatcacaaaagcatttaaaagatatccgaaaatggttgttccagggttttacggggcgaaccctgcaggaaaagaaaaattattgggccgtgggggaagcgacattaccggcgcgatactggcgaagatgttgcaagcggaaagttatgagaattggacggatgtttcaggaatcatgatggctgatccgcgaatcatcgatcatcctaaaatcatcgaggaaatctcttttagagaactgagagagatggcttatatgggggctaacgttcttcatgaagcagctgttttcccagttcaagaggctgatatccccatccaaataaaaaataccaatgatcctttcgctcaagggacaaaaatatcgaatcacgaaatagaaaaggaaaatggactgacaggaatagctggacgcaaggatgttctttccatcactttattcaaacgtcatatgtccgatgaaatcgggtttatctggaaagcaatgagcatttttgctaaacatgagatatcaatcgaacatattccttcagggatcgacaatatcggagtgatcgtctcagcagaagcgattgccgataaattatttctcatcacgaaagaattaaaagaaacacttggcgtggaagaaatcgtcgtgattgaagacttagctttgatctctgtcgttggcggaccgcataaagaattgatcggtttatctggaaaagtgttatcgatattgaacaaattagaaattcgcacatcgatcttatcacaaggagcacaggagttgaatctgatcatcggtgtaccgaataatcaatatgaaacagtagtgaagggtatctatgaagggatggtgaatacggatgctgaaagaatatcgaatggcactccatcaaattcctgaaatcggatttcatgaattcaagacaaaaaaatatttatatgaacaagtaaaaaacagcggggccgttatccatgaaatcggcgaaacaggactactcctttattttgataatcaacaagaagaaacgattgcttttcgaacagatatcgatgcactgccagtcaaagaagaaacgaatctctcttttgcttctaagcatgaagggtatatgcatgcatgtggtcatgacggacatatggcgatgcttttagggttgactgactttataactaaacacattgaggatcttatttataatgtagtactgatctatcagccatcagaagaaatttccggtggcgcacaaagcgttattcagtcaggattgttggataaatatgaagtacaagcaatatttggctttcatctatggcctggactagctaagggagaagttttctctcgaccaggacctttgatggcacaaagcagtgaaacagacattatcattaaaggccagtctgcacatattgcttctagtgaaaaaggaatcgatagtctggaggcagctgtacgatttttgaagaatgtttatgattttgaccggcaattaccggcagagtggaatcatctaatgaaatttggccaaatccaaggtggaacgatccgaaatgttttagctggagaagttattgtatccggaagtatccgttcttacagttcagatatgcaaaattatttgaagaggggattagaccatttagcagaacagtttcactctacagctactatttcttttcactataatgacggctatccagctgtaatcaaccatagaggcttatatgcagcactgttagattcaaacaaactacatgaattagatgctccagttcttcaagccgaagattttggcatatatacgcaacaatatccatgtgtatttttctttttaggtgtcggtgatacccctgctttacatgatccgacgttcgattttgatatggatgttttagaaaatggtgtagaatggtacaaaacgattctttttacagaaaatcttcttgtaaaaatcgatagcagttcaaaagaggagcgagtaaataatgacgaatttatccaatcgatttagtcccaggctttctagaatagaagtatcaaaaatacgacaattcgatcagcaaatatcttcgataccagatgtgatcaaactcaccctgggagaaccggattttccaactcccgaacatgtcaaacaagccggaatagcagcgattgaagaagacttttctcactataccggaatgagaggattagaggaactgcgggaagctgcttgtatgtttcagcagcagcgttatggactaacttatgatccgcaaacggaagttttgacgacggttggtgcaacggaagcaattgcctctgcattgttatctgttttggaagaaggagacaaggttcttattccagcgcctgcttattcaggatatcagccattagtggaactagctggtgctgaattgatcccgatagatacttctgacacagggtttgtttgccagccagaacaatttgaaaaagcctttgaacaatatgaatcagctgtcaaagcagtcattttaaactatcctaacaatcctactgggacgacattgtctgcaaaacaattgaaagcaatcgctgaggttttaaaaaaatatccggtatttgttataagtgatgaagtatatgctgaattgacttatagtggaacgcatatgtccatagctacttatcttccagaacaaacaatcgtgataagcgggttatccaagtcacatgcgatgactggttggcgagtgggctttatttttgctcaaaaagcccttattgacgaactaattaaagtccatcaatatctggtgactgccgctacaacgatgtcgcaaaaagctgcggctgaagcgctaataaatggggtgaaagatagcgagaatatgaaagagcaatatcaaacacgaagagactatctggtccagcaattggcgcctttaggatttgaagtgacccagccaaacggtgcattttacttgttttgcaaactcccagctgccattcaaactgactcttggcagttttgtgtagaattagcggaacaggcaaaagttgcgtgtatcccaggaattgcatttggcccagaaggagaaggttatatccggatttcttatgctagcagcatggaaaaattacatgaggcctgcaaacggatcaaagactttttaacagaacagtgattcatagattttatcaaaaaaacaatcgttaattttgcggtatattctgcaaggagacgattgttttttaaatttagttcaaatgaacgcgtttcttttgattcataactaatgtaatgttaagtttaaattgtttagaatgattttaaaagaatattcaaggaggtttcatcaatggaaaaaatcaaagttgtcattgtaggtgcatctcatggagggcatcaatcgatcttggaactattgacacgatacggtgaaaatgtagatatcacgctatttgaagcaggagactatatttccttcatgtcatgtggtatggagctgtatttagaagacaaggtaacagatgtaaatgatgtacgtaatttcagaccagaaaactttccgcaatccaatgttcatattttaaataatcacgaagtaaaaacgatcgatgccgataaaaaaacagtaacggttactagcgcatcagataacgaaacaaaagaatatccttatgacaaattgattttgagtcctggtgtcaaaccaaacaatctgccagtaccaggagcagatctagaaaatgtctacttgatgcgtggatacaattgggcaaccaaaatcaaagaaaaattaaatgatccggctattaaaaaaatcgctgtcgtaggtgcgggttacattgggatcgaagcagcagaagcaagccgaaaagctgggaaagaagtcgtattgcttgatgtgatcgatagacctttaggcacttatttagatgctgagatgacagatattttagaacaacacctaaatgaaaacggtattgaagttttgacaaatgcaaaaatcgaagcttttactggtaacggaaaagttgaggcaatcaaaacaagtgaaaaagaaatcccagcagatctagtcattcaagctgccggtgtgaaggcaaatacagaatggttaaaagggatcgtcgacttagatgaacgtggctggatccaaacaaatgaatacttgcaaacgaatcttccagatgtgtatgcagtaggagatgctacacttgcttattctatcccagcacgcaaaaaaatgccgatcgctttagcgactgttgcacgtagagaagcacgttatgtagtaaaacatctttttgaagaagtaccaaacaaaccgttcggcggagtcgtaggttcctctgcattaagtgtctttgactatcattttgcagcaagcggattgaatagctttacagcagcaaaagcaggagtagatgtacgagtgtcttattatgaagatacgttacgaccaaaatatgtaccagaagaacaaggaaatccaaaagtgtccatccaattattctcggatccaatgacccatcaattgctaggaggagcagtattatctacctatgatgttacaggtcaaggaaatgtattggcactagcgatccaaaacaaactgactttagaagaactagcagaagctgacttcttcttccagccaggctttgaccgacaatggagcatgttgaatctagccgctcaacaagcgttaggagaagaaccatttgtagaataagaaaacgaaatatttgaaaagaggttgtgaaaaagctgccttgcatcaagtaataagaacagccaagtaaaaacagcttcttatgtttttaacttggctggacttattaccgcagatgcaagcttttgaacaccgtttattttcaaaaaagggactgtgacacgatttgtgtaccgacccccaaaagttagaccaaaaaatctaacttttggaggtcggtattttttatggttaaatatacttttgaacttaaattaaagatcgttcatgattatttggatggcaaaggcgattggaccgtaaaaatccagatcaagagattgaagcggaaatgcttaaaattcgggagaagcataaggattatggctgtttacggatgaccaatgaactaagaaaccgcggtttctctatcaataaaaagaaagttcagcgcttgatcaagaagctaggaataaaagtaacggcatacacgcgtaaatcacgtcgctacaattcttatcgaggaaaagttggagcagtagccaaaaatcggatccatcgtcgtttctacaccagtatctgccatcagaaaatcacgacggatacaactgaatttaaataccatgaagtggatgccaaaggcattatccgtcaaaagaaattgtatctagatccttttatggatatgttcaatagtgagattttatcctatcgtatctctgaaaagcccaatgcattagcggtaatggaaggtttggaggaagctatccagaccactaacgattgtcactatcgtcgtacgtttcactcagatcaaggttgggcgtatcaaatgaaagcttatagaaacaaattggaggagtacaaaatctttcaaagcatgtctcggaaagggaactgcttagataattcacttatggagaatttttttggcttattaaaacaagagatttttcacgggaaagtttataactgtttcgaggaattaaaatcagtcatcgatagctatatctattactacaataatgaacggataaaacagaaattaaactggcaaagtctcgtccaatttcgtaaaacaaccgtaacggttgtgtaaaaatatcattttagagcatgaaaaaaaggagtggatttctccactccaaaaaagtctaacttttgggggtcactacagtgtcacagtcctttttttagtaaaaggatacatttcttccttgtatattccatgcgtgttcgtgagaaagcatatataatttaattaacagatagttagggggagaaaaaatgattttttcaattacaatgaaactggtattcgggttgatcggtttattattagtggtacgtttgcttgggaagaaatccatgtcagaaatcacaccgtttgatttagtctatacgcttgttttaggtgggatcttagaagaatcaacctatgatgacaatgtccatgtagggcatgtcctatttgccattgcgctttgggcagtaatgatttatggtatcgaacgtatcgtccaaagaaatgaaaaggtcaatcgttgggtcaaaggcgagccatctgttctaatcaaagacggcgtcatcaacatgacagagttgacaaataaccatatcgagatggagcagttgcgagcaatcttaagacagcaggaatgcttttctcttgaaaatgccaaacatgttatcctagagaatgccggtcaaatgagtgtattgaaaaaatcagatgaagacaaagctttatcgatcctgcttgtagatgaagggcaaattcagcataaagtgcttcagtccaatcaattgactgaatcatggcttatggagaacttgaagaaagaaggctatgcagatgtaaaacagctgatttatgttgaatggtcagaagaaaaagggctctacatactaaataaagaagacgtcatgcatgaatcttaccgaatagatggatagacagaggttgtgaaatcagcgccttggattgttactcaaaactaagcgactttttcacaacctctgatatctaatatacgttgttccagaagttgcttcttcgaaaaataagccaaaattccacaaaaatttaagaagcaattttcgaaaaatcctttcttattttttgaagttgatcacttctgtcacaacctctcatgtcacaaaccatttttttgtttcctttaactcaatataccgtacgtcttcccacaatatcggctgatggtcaatcataaagtaatcttcataggcttcaccaatgaagtgcccttcgacctcatccaagagtcttccaaattcatcttttaaattgagctgaatgattactgctttacgagataaaaaggcttctgtcagtatactatcgatttcttgcaatgtcatttgttgtttaggaagaggctgtttgcgtgcttcttcttcattttttttgataccgttgactagttcttccatcgcaaaagcagtcccccattttaatccaaatggccgatctcgatactcgttatagtcaatgaatttttttgctgtccgtctcatcttttccaccttctaatccactcataccacctgcatgcccgccaacgagagaactacgtgcgatggcgcgtcctccttgcaagagactatgcgcatggatgattgattgaaagccgtatttttttctaatcgtatcgacaacaaaatcaactttcgcttcatttatctgcttttcaggatcttcaaaaaggttaagctgtaaacctgtcgcgtatacgaggtcggaacagttcacgcctacacgccgaatatcctggtagtggtaatgctggtggaaaatggtcaataaagcatctgctagatctctgctagcatttgtcgcttcgattttcatttgctggtgaaacccggtcttgccatttggatcaagatagcctaaagagtatcctacccataagctgactacttgtgtttttgctgcagatcgtctcaagcgagtgccgacttgatcggccatttctttgataacgatctcgatttcttctcgtcttgtataatctctatctaggatttgactatttccgatactttttgattttggtgtatattcttgtcccaaaaaacttcgatcgatcccccaagcatgggcataaagctgagtaccgatgacccctagcttgcttttcaagtgataataatccgcgtgagctaaatcataaacagaatgtatacccatttgtttcagacgttttgctgttcgtttgccgattccccaaaagtcagtgatatctgagattttccataacttttctggtacatcttcataacgccattcagcaaacatttgctttccgtcttttgagccattgtctaaggctagtttagcaagtagcgggttatcgccaattcctatagtcgtgtagattccggtctgcttaaacacatctttatggatcagtttagccatgtcgtacgcatttgttttaccaaagagtgccatgctatttgttacatcaaggaagctttcatcgacggaatagacatgatggttcgcttcgtctgcatattttttatagatagaattgatttctctgttcttttccatataataggccatccttggggcaacaatatataaatcacttggataggggaagggaagatctctggcacggctgatattggtgatgccgtaagctttttttgctgcaggactggaagccaagattaatccgctaccccgtgtttctgtcgaatcggacggataggacatgactactaatttagttgtaaggggatcaagatccttttcaacgcactctacggaggcgtaaaaagatttgcagtcaatacataaaatatctcttgaaggttctttttcataaacaaataccggattttgattcgcccacataacaatcacctcttcaacacaattagaacacatgttctctttctgtgtcaataaaaaacagcaattttcgaatacgagcaaaaggctcacatttgaacagcttctggatcgatctttgttgtcccatttccaatgtgtgcaacataaaattccggagcatagccgacaactttcatgtattcatcatagacattgtttttgaaggcaggtatattttcttctttgacaagagcaatcgcacagccaccaaatccagctcctgtcattcgtgcacccaagacaccttcttgtttttgagcagcatctactagtgtatctaattcgatcccagttacttcataatcatagcgaagagagtggtgagaatcatttaacagttgaccaaatgcttctaagttcccagcttctaattcagcttttgccttcaaagtccgctgattttcagaaacggcatggcgagctctgcgtatcaatgtatcatcgccgatttggtcaatagttgattcaaattcttcttcatctaagtctcctaaagaagagataggcaaagttttttgcaaacgtgccaaggcttcttcgcattcgctgcggcgttcattgtattttgaatctgccaattcccgccgcttattcgtattcatgatgacgattgcataaccatctagtttcactgggaccatttcgtatttcagcgtatttgtatctaataagattgcatgatctagctcaccgaagccgatggcaaactgatccatgatacctgaattgacaccgatgaattcattttctacttttttacctgtttggactagttccaagcgatctgtttttaaatcaaacagatcttctaatacaacacctactaataattctaatgaagcgctactggaaagtcctgcaccattagggattgttccttccactaacaactcaaacccatgatcgattgagtgtccagtttcttttaatttaaggaccattccttttacgtaatttgcccagtttgcttttttatcatattctagctcatctaaagtaaaactaatgacaccgatatcgtcaaagtttgtggaataaactaatattttattatcgtctcgaggtgctgcgacaccttgcgttccataagtgatggaagcggggaagacatggcctccattgtaatctgtgtgttcaccaatcaaattgatgcgtcctggtgagaagtattgtgtagtttttttaggtccgaatgtttcggcaaattttgtgtttaagcttcttttgatttccatgatgagttattcctttcttgttttgattttgaattctgtcactgtttcaaatactgatccggcttttaaatgaatcgaaccaaatgctgagaagcgctctgcacctggagctgtttgagtctcaaatgtgatgccaccatgatgtgccagttttcggttgcgcatttctggtgtttctgtgccgaaatttgcagtgaaaataaccacactagaagcatctgtagcaatatctacttggattcttttatcggggctagtcaagcgagcggcttctttatccaagccggtttcttttaagaaaaatggatgatcgattccgtcaacaagatttttttgatccaaatcactagcaaaaacggacgctaattttttaggtatttgaaaatcgaaagcacttcctgcagtattttcttttacccctataggaatactatctgttcgcaaaggagcataagcttcgctattgagccaaagctcatgttgatcgattgattgagaagcatctcccgtcaagttgaagtaaacatgatttgtcggattgaataaagtatcttggtcactggtgccgcgagaggtcactcgccagatattatcttgtgtcaaagtatagcggatttccacatccattgtacctggaaaaccatgttctccgtcgggacttgtagtagtaaaaatgacagaagcttcattttcgccattcaaaatgacataagaccatttttttaattcaaatccaggagcaccaccatgcagattatgtccagtttttggatctgtggctaattggtaagtttttccattgagagaaaagcggccattttcgattctccctgcggtgcgaccgatagaagcaccgatatacggatctttttcgatatattcttcagcggtatcaaatcccaaaactaattctcgatcatttgattttaaactgacgattctagcacctaaatcagagatagaaagtgctagcttgtttttgttctccaaggttatcaagtgataaccttggccaaaatctttttctgtaatcttcattttcaagatcctttcttaatgggaaggaactactgcatcgtgaagttcatcttccattgtatcagctggagccaatttgttttccaattcctcaacgatttgtgcatgttttttctctgtcaatgtaatcttccaagcaaaaataatagcggagaaaatcattaaagcagcaggagcatagaatgcataagctttgaaagtcgttacgccatgagcagtgatatcagcagcagtagcattaccagtcatcccagaagcgatagcgacaaaccctacgatcccgttagacaaagcaccagcgattttatctagtaaagggcgaattgatagagtaacagcttcgttacggataccatttttccattgaccatattcaacagagtctgtgatcgtcatcaaagcggataagaaaatcaattgttgagggaagtagaacaatactagcccgatgataacgattggcaaacttgaacctgcgatcgtaaagaaaaagtaagaagaaatcatcattgcgatccctccaaggtaaacgtagcgacgagagatgacgcgtgtaagcattgggaatagtggaacagctactaaaccaagtaaggcagcaaccagaccaacgatccaaaattcagttggttggccaagtacatatttgaagaagtagaataatacggcagttgttgctacattggcaatcgcataagcgatataagcaagggcaagccacatcaactgatcattttgagcaactgctttgaacacatctttgatcccagctttttcattttgctgacggatcgcagtatcgacttcttttgtgcccaaggcagtgataatcgcagtaccgcctgaaataacagcagcaatcacaccgaaccagaaccagcctgaagcgccttcaatatgtttatgagtaacaagataggtaaagaaagtaacgatagggacaacgactagagtagtaccatttgcacctagagaagagccgaaacgagcaaacgtagcaaatttttcacgttcctttgtttccgtactcaaagctggaatcattgaccaaaaagcgatatccttaaatgaataaaaactatccaataagatgaaaacgattgcaaataatatgataaataaagtcgtattatgagtagctaagccaaagaaattggtaaagattgctaccaagagtacggaactaacaacgccgccgataactaaccatggtttgaatttaccgtattttgtacgagtattatcgatgatgccaccaatcaaaggatcaaaaataatttcaactaagcggatacctacaactaagcttgtaactgtagcaatcatttttgcattcgttgccttatctgttcctgcgaacatctggcttgtcacgaataccataaaataagtgcttaatgtaacatagaatgtgtcgtgtccaaaagcgcctaaagcgtaggacacacgttggatcattttgcttttcataatctgtattcctctcctgttcaatatataatactaagtaaaccggttacaacgaataacaaagatcttttaatgacttaaacttaacaagaaatcgcttcctttttaatatatttctgtgacttttatttaactttttgttgcattatactaaaggagtaaggagggatagacgtggagcaatcgatttttttaaaaaaggaacatcaacaagtagaaaaagaattgtattttgatttttgtggtttctctaaaacgatgccgtttcattcttttggtcctgctattcgcaatgattacatcctgcatgtcgtgatggaaggcaaaggatcttatcatgtgaaaaatcaacaattccaattgaaaaaaggtgatctgttcttgattcgtccaggagactcgacgttttacttatcagatggagaagatccgtggatgtattgctggctttcatttggtgggagtgctgcagaagaaatcattcggcagtcgcttttcagagaagaccaatacacgatggtctcttctgacatacaaaaatatatcgacattattttagaatgcatgaaagatacggaagaaaccttggaaaatgaattacagttaacagcattaacctactgttttttatcagtccttttaaaagatggcggaaaggtcagcggtggtgtacaaaaggttcactcctctttagctgttgagacagtcaaatacatcgaggcacattatgctgaaaaattgtctgttgaggaaatcgcccagcatttagcggtcaatcggagccatttgtcgcgagtattcaaaaatcatatgggtaccagtatcaaggaatatttgatcggggtacggatcaatcgaggggcgtttcttctttctctgacggatgaatccgtggaaagtattgcctatcaagtagggttcaatagtctagtcgtatttagccgaatgttcaaaaagagtaccggagaaacggctacgaactatcgtaaacgtatgaaaaacgaaaattttaagaatattgctttggataccttgaaaaaacagttggaaaaacaaaccgcagtttcttggacaacctgattagtctggttaaaatgacaagcatcggcaaaagaaacttgtggcggttatgctacactataaagcgaagactaaaaaggaggaaaagggatgcgtacacttatcatcattagccatccaacgatcgaagaatctttaaatcagcaatttttcaaagaagcttctgctggtttaccagctacttggcatcatttggaatcaagttatccagacggaaaaatagatatagagactgaactacagctcttggcccagcatgatcggatcattttccagtttccgttttactggtatagttctcctgcccatttaaaaatttggcaagataatgtcttggaacgagcagcacatgtattaaaagggaaagaactaggaatcgtattgacaacaggtgtggcggaaaaagaataccaagctggaggaaaagaagaatatacgatttccgaatttttgaggccgtatcagcgaatcgcaaataaattccatatgacctatcttccgccattcgttttagcacaatttatgtatttatcccaggaaaaacgttgggagaagctaattgcttatcagcagtatctctcattggaaggcaaaccatcgctgactcagcggattgactggtttattcaaagagtacaggaaaatcagaaaatgcaggaagaagaatctgaaaaacaagcatatatcgtagaagcactgactgaggcaaaagagcagatcgaagacttgacctttacactgcaagaaatgaaaggaactcattatgacaaatgattggctgatccaacaattagatgaattaagcgaaaaatcagaatatcaagaccgtgcgctcttatatgaaataaagaaactgatggctgagatagacgaacgaacaatgcagctgcaaggagaaatcgacgggcaatcttggaatcatctcaactggtgaaattttcttataaataacaaagataaaaatgtgcacagcggcaattatttgctacaataagaatatgaagcgtttgataacgctattatacataaaaattggtggtgaaaaaaatgtatgatgaaaatgagtggggagaaaatgttcggatgacccgaagaagacagcaaaaacaggcagctcgtaagcggatgatcatgattggggcagcagttgccgtgtttttgatcatagcaggaggagttgcgggtctatattttcatggaaaaaattcgtcagaagcgaaaagtacgaccataacggaaacaacgacaaagaaaacagagacgaaacaaacaagtgagtcatcaactaaaacaaaagagacacaaacttctgaagaaaaaacagcaaatggtttgccagagcaacttcaagcaatcgtaaatgattattcgaaaaagatcgaagaaaagacgcctgcattgattgaagaataccagacagaaattcagggaaatcaagagggcatagctggtttatcagcagttgctaaccaaaaagcacgtgagcttcaagcaatctccgacgaagggatcagaaaattacgtgcagcgtatcaggcagcagaaaataaagacggtgtagacttagatactttgatcaatcaattatcggctaattatacgaatcatgtagctaagatttccgatatttatttgcagactagcgcctctcttcaagcagagtcaacaagcacacaagacacaacatcttctgattctgagacggcagagtcggtagaagcttctgaaatgcaagctcgaacaacacaagacacaacagattcctctgaaactaataccaacagcgcgacttcacaggctgcgacaaccgtagttttggaaggagaaggtccaaatcaaatagccgaacgaactggcgtaccagtagaaacgatcttgtcgctgaatgggatgagcatggagaattatttcctgactcccggtgagacgctaaaattgaattgataaaagcaataaaaaagaacgaagcttctactaaggtgaagcttcgttctttttttattttccggttcttttttcgcgtacaaagtaatggatcgtcatgtaaagcaagaaaacgagtccaataatcaatgagattctcgtttcaggattgataaacatgaaaatcaatacgatagctaaaaaagcaagtgtcacataattcgtataaggagatagtggcattttaaaaggatgatcatgcattttatctgcgtgcttctttttgaagcgaatctcgctgatcaaaatcactacccaaggaaccataccaggcaaaatacttgagctgtatacgaaaacgaaaatattttctgactggttgatgaacattggtagaagataatttaagatcagaccaattaagattccacctgagattgctacgacaggataaaaaggcgcaccgtgacgagatagtttcagaaattttttagacatctttccattcatggcaagtgtatagaccatacgacttgcgctgaaaatccctgaattgcaacctgataatgccgctgtaatcacgacaaaattaatcagtcctgcagcaaatgtaatgccgactttagaaaaagtttgtacaaaaggtgaaccaatctcactcaattgattccacggatagatactcacaatgataaaaatagcaccaatataaaaaatcaagattcgaccgatagtggactggacagcttcaatgatcgtctttttaggattctctgcttcaccagcagtcattccgatcagttcgattccttgataggaagcaacaacgatcgataatgcaaagaaaaatcctttgacgcctccagtgaagaatccaccatttttccaaagatttgaaatccctactgcctgaccatgattaccaaatccaaataagattaccccaagacctgcaatgatcatcaaaatgatcgttatgactttgatgatcgaaaaccaaaattctaattcgccaaacgccttgacagaaataagatttgccagcataagaaacaagacgacaatgatcccgggaataattgccggcaaatcaggccaccaataattcatataagatcctacagcaatcacttcacttattcctacgacaatatattgaaaaatattactccaagcggtcaagtagccagccacaggatggatgtactcgctcgcgtaatttgcaaaagaaccagtcgaaggatcaacgtaaagcatttcgcctaaagcacgcataatcaaatacaaaaagaatcctgcaatcgcataggctcccatcactgagggccctgtccagcgtatggttgaggaggcacccataaacagaccgacaccgatcgttccacctagtgcgatcatttggatatgacgggcactaagacttcgagttaacttttcttctttcatacaaaaactcctttcgttgttgagtcaacaagaaaaaataatcaaacgtttcaacacatgtttttcattattaggttagccttattgaactcttgatgtgattctacagaaaattttcataaaatgcgaggaaaattcgaaaaaaactttttcatcattctacttgaaaatgctttccattttagttaaactatatttaaataaaaagttaggtaaacctaaaaaggagtgtaagatttggaacgtacggccattgtaattcaagacctttcagccgcttatcaagggaaaactgttttgaaaactatcaacttgacgataaatccacaaaaaattaccggtattatcggaccaaacggtgcaggaaaatcaacatttatgaaatctttgctagagttgataccagctactactggtaaagtcaccttttctggacagccggtaaactcagtccgtaaaaaaatagcctacgtggaacagcgaagtgaattggatctttcctttccaattgatgtattaggcgttgtacttttaggaacatatccatctttacgaattggacaaagacctgggaaaaaagaaaaagaacgtgcaagacaagctttgaaaaaagtagggatggaagaatatgccaaaagacagatcagcgaactatcgggtggacagcttcagagagtttttattgcaagagctctagcccaaggagcagaatggatctttttggatgaaccattcgtagggattgatgcgttaagtgaacgaaagatctttgacatcttgcaggaattgaagaattcaggaaaaacgattttgatcgtccatcatgatcttcataaagtagaagaatatttcgatgaggttattcttttaaataaacagctgattgcttccggtccagtacaagaagtctttacatcgaagaaccttcaattggcctatggtgagatcatcagacatttagtaaaaggaggagagaaaaaatgatccaatcctttattgatggattaatgaattatcaattcctgcaatacgctttggtcacttccatgcttgtaggacttgcttctggagtcatcggttcttttattattttacgagggatgtctttgatgggagacgctatctctcacgcagttcttccaggtgtagccatttcttatatgtttggttttagttacatctttggagccactgcttttgggatgctaacagcagcagtgattggtttcgtgactcagcggagccgattgaaaaatgatacagcgattggaattgtctttagctccttttttgcattagggattatcttgatttcatatgcccagagtgcgacagatttgtatcatattttatttgggaatgtcttagctgttagggaaagcgatttgttgctgacagcactcgttagtggaatcgtcttgatatttgtctttttcttttataaagaattgaagatcacatcgttcgatccgacaatggcaaaagcttatgggctgaacacatcgctgatccattatcttttgatgttctttttgacattagtggctgtagtcagtttacagacagtaggaacaatcttggtgattgccatgttgatcacaccagccgccacggcttacttgctaacgaaccatttactgaaaatgatcattacagctgcaggaatcggtatgctaagtgcagttgtcggtgtgtttttcagttatagttacaattggccatcaggagctacgatcgtgttagcatgtaccgcattttttatccttgcttttttattttctccaacaaaaggaattttatttcagaaaggaagcagatagatgaaaacaaaaaaatcactctttttaatcttggcagttagtttcttggtattagccggttgcggaaagcaggcttctgaccaagcggatgaaggaagtaaagaaaagttgtcagtcgtggctaccaattcgatcttggcggacatggcaaaagaggtcggaacagatcaaatagatatccacagtatcgtaccagtcggaacagatccgcatgaatatgaagtactaccagaagacatcaaaaaggcaagcgatgcagatgttattttatacaacggtttgaatcttgaaacaggtaacagctggttcgataacttgatggaaacggctaaaaaagaagaaggaaaagattattttgcagttagcaaaaatgtagaacctctttatttaactagcggtgaagaacatacaaaagcagatccccatgcttggctagatctatctaacggaataaaatatgtggaggaaatcgcacgtatattctctgaaaaagatgcagaaaatgcgacactctataaaaaaaatgcagaagcatatgtggaaaaactaaaagaattagatacacaagcgaaggaaagttttgcttctatcgaagagaacaaaaaattattagtaacaagtgaaggggcattcaagtatttttcacgagcatatgatttgccagcagcttatatatgggagatcaatacagaaagtcaaggtacgcctgatcaaatgaaagcgatcattgatcagataagagcaaaagaagtaccggttttattcgtggaaaccagtgtagactcaagaagcatggaacgggtagcaaaagaaacgggtttgaaaatctatgataaactgttcactgattccatagcaaaagaaggagaacaaggagattcttactatcagatgatgaaatggaatattgaaacgatccatgaaggtttgtcacaaacaaaagaaagctgaaaagtgcaaggtctagcttgaggagcaggccttgcattttttataagagatatgaaaaaaattatgctgtttttcgtcgtacagataccttttttgaagaaattccgttatagttagagtaaggaaggaaggtgtggctatgaattttacacgtaaagataaatatacgattaaagaagaagtctttcgattgatcagccagcaggaaaataccgacaaggatcaagaccttcaatttcttgaagcagaattagctaaattattcatagcaaatcaaaatgagacaacagaaccagatgaagagctgtacataggcaaatggttgtttgatgaatttcagcctttagatgaaaataccggtatcggttattttgtgttcctttctccagtcggcttcacacctggcgtattagttaaacaaaacgacgaaataaccgtcaaagcatggcctgcattattttcagtcatcaaagcagaaggagtaatcaaaaagatccagtcggcctattataaaagtcaatttattgccaacagcaaattaatgaatatgttttataatcgtctagtagaaattgccaggcctgggaaaatcccgcaaacattcacgtacacacagcaaaaaaatctctatgaagaagtattgtattcccgcgatctgtctgagttttcgccatgggaagaggtaaggctccatgaactgttaagtacaaaaccagtttcattgaatttttttaatgcattagataacaaaagaaaattaatttcaacaaattattgggaagtatttgctgcaagaaaaaaatggatggaagaaaagaagattgccgatcagcagatccagtttgtccagctgaaaaaagaaaaactatattatgggttatacagccgttaacagcaagcgaggaagaccatgacattaaaagaagaaatcatacaagaaagcaaacgattaggaattgacaaaatcgggttcaccacggcggaaccttttgattcattaaaagaatcgttggaagaacaaaaagcagctggccatacttctggctttgaacatccaaatatcgatgagcgtctttatcctgaaatgacatttgatcagccgaaatcgatcatttccattgcacttgcgtatcctactaggatccatgaagaagtgcctagggatgaaaaacgcggacagtttgctcgtgcttcttgggggatcgattaccatgatatactcagagaccgtttgaaccgattgatcgaattcatccaaacaagagcagaaaaatggcaaaaagaagaggaatggcgtctagctccgcaagtagatactggagaactgatcgatgtcgctgtagcacagcgagctggtttaggatttattggacgaaacggattgttgatcactgaagagttcggttcgtttgtctatcttggtgagatcgttactaatattgtatttgagcctgataaaccaggagaatttggttgcggtgactgtatgcgctgcgtgactgcttgtccgacaaaagcattgcttggtgacggaagaatgaatgcccagcgatgtttgtcttatcaaactcagacaaaagggatgatgccggaagaatatcgtaaaaaaatgcgaaatgtcatttatggatgtgatatctgccagttagtctgcccttacaatcaaggaaaagattttcattttcatgaagagatggaaccaaaagtagacgaagtatatccaaaattaaagccaatgctttcgatgtctaataaagacttcaaacagcaatttgggcatttagctggttcatggcgtgggaagaaacctttgcagagaaacgcattgattgctttagctaatctaggtgatcgaacggcattgcctgagatttcagaatgtttaacagatgtccgccctgtcatcagaggaacagcagcttgggctattggacgtctaggaacaaaagaaccggaaaaatggcttgatgtattagatgaaatattagctaaagaaacagaagaagtcgttataaacgaattggaacatgcccagaaattattgcggagaaagttaaaataaaaaaatagttaacattattcaaagtttttgtccagtaattgttgtaacaattactggtttttttgtattttttacatttttttaagaggatttgataaaaatcaaaaatttttttgcttttttttatggattattgcagtaaatgttacagaatctgcgtttttcatttaaaaataaaaaaacatagaaaaacgattactttgcttatacaacaaggattttatggttttgtatcaaaaaaatatttgtttaaatgttacaaatattaaataattcgtcattttgtcattaaatgtcatgtttcttttacctatgaaatatttctaaatgataaagttaatagcgtcgaaagaataaaaaacggagaaaaaaaggagtttaatatgaattcatttaagaaaattgttttaggtacaacttttgctgctggtgctactgcaatgtttgtaggaactacaaatgctcacgctgatgaagtttatacagtaaaatcaggtgattcattatctaagatctcacaaaaatttgcaggagacaactcaatgatcgatgcaattgctgaaaaaaattcgatcgcaaacatcaaccgcatttatgttggtgaacaattaacaatcccaacttcaaatgattcttcagcaacaacagaaaacaaaacaacagaaaatacagcatctacaactgaaacagcaacgcaagaacatacatacgttgcacctgttgaaacagttgaagtagctcctgctgccccagctgctgcaacagcgccaacttcaagctctgcaaaagaatggatcgcacaaaaagaatcaggcggttcatacacagctactaacggacgttacatcggccgttatcaattagatgcttcatacttaaacggcgactattcagctgccaatcaagaacgtgtagcagaacaatatgtaacatctcgttatggttcatgggatgctgctaaaacattctggttagcaaacggctggtactaagccgataaaaggaaaatgatgaaaccgagaaacttgtttattcaagttctcggtttttttgtgtgaaaaataactcgtttgcttcccacagcgcagcagtacaaataaaaactcgaataatgtataataaagaaaacgtttttttgtttagggaatgaggaggagccatgagtacaaaagagagtctcgaattaaacgaaatcacaagtggaaatccactgttatccagtattcgatcgattgtagaaacgacattttacggtaataatgttcatgaagtttttgacaggaagacagcttatcaactagcaaaagggagtccaggaacgatcatcacagatttaacaatctcacatgctgaagaactagatttaccagctgatgtcagaacactagtattcaatgatggaagcattgtgggaagaacagcaagtgctcggcggatctttgaggacttagacaaggaacaaagcaaatacgagaaaattttaagagaagctgtgtatcaaagtcgcaagcgccagttttaccatacaaaagtaatcgttggcctatctgaagaattttctgtgcaaagtcatttgctgattccagaaggatttgagaacaatttgtattcttatttgctgaattttcagccagcgaattcgaagatcttagagacttatcaaaagtctgtttcctttgatgagggagatctttatatcttttgtgatcccgagtggacacatgaaacatttcccaatggactcattttgtttgatgctctccataatacagcggctgtgctaggattacgttactttggagaattaaaaaaagcgactttgacgcttgcttgggcattgggaaatcgcaatggctttattgcctgccacggtgggatgaaacaatatgctagtaatgaccagacctatacgatggctgtatttgggttgtccggttctggaaaatcaacgatcaccttagcaaaacatacggaaggtcactctgtttcgatcttgcatgacgatgctttcgttatttctcgaaaaaatggttttgctactgccttggaaccttcttactttgataaaacacaagactatccgtctgatgatccggccatttcttcttttcttacttgtcagaatgtgggcgtgacatgtacaagtaaaggagaaaaagtcctagtaacaggagatatacgaaacggaaatgggcggacagtcaaatcacgttatgcgacacccgaccgagtcgatcatcttagcgaaaagatcgatgctgttttttggatcatgaaagatgattcgcttccgccaattatcaagatcaatgacccggttttagcagcgtcttttggtgcaacattagcaacaaaacgatcagacgcggaaaatatcactacaaaaagacagctagatgagctagtcattgaaccatttgctaaccctttccgtgtctatcctcttagggaagactatcaagcttttcgagagttgtttttgaaacagcaaacagcctgctatgtcctgaatactggatatttcgatgataaaaaaatcaaacctgaaacgacattgtcaatcgttgaaagaatcgtgcaacaaacggcagaattcaagtcgtttggtccatttgaagacatccactatttacctataccagattttcctgtttcttttgaggatacgtcctataaaaatctggtgaaacaacgacttgatattcgtttacgattcattgaagctcagataggaaaagatctcttgccagatgaagcaaaagaaagtttggagaatttgattcagaaattgaactaaaataacagctttttcaagaagtaatccatgcacaatatcgctcgggatccttacttgaaaaagctgtttttctatgatggatttttcgtaatataggtggagatgtccttttgataatcttccgtaggccaatgaccagtatttaagaagttggctaatagatagccgatataaggacctgtggtcaagccagaagagcctagaccgctagcagccagtaagcttggatcatctggcagtacgccgaaaaatggggaaaaatctgacgtataagcacgggtacctacacggaacacgtatggccagttttttatctgatctgaatcggccaagaactgttctgtactcttagtcaatcccttataagcttcgctagtaggagccaaatcccagccttgatcgttttcatgggtagcacctaaaaggatctttccatccatgaaaggaatgaaatcagcttctccgtcaagcatagcaacaggccagtcttgactcatcttataagatgtctgaaatgctaagagctgccctttttgcggacgtatatctgcagcatagcctaattcttgtaataaaggcttaagtgccgggccaggtgtcaaaattacacgatcagctgtgtattctccaaacggtcccttgatgagccaagaatcgctcttcttatgcaaagtgacttttgcctggatctgctccatttgtttttgtgctaaacgctgaccaagatgttctaaatatgcttttccatccagacgaccaccaccactgatacgcagtgaaactgctggtttcaataacggaagtgcttgagatgtctgttcaggtgaaagccattcgatgtttccaatttctggcgcttcttcttttcgtttctcggcaagaacagccaattcagctaaatctttttcaggtcgaagcaaaagtgtccctgattgtgcgtaaatcgtttgatcaagttggaaatcttttataagtttagggaaaaaagcagcgccgtctttagccagacgataccattgtttgtttctgcgtttcgacaaccaaggggagataatcccagcgctagctttagttgcctgtcctgtcccttcatcaaataaagcaacattgaattttgatgtatctaagtaactggctagggtcataccaatgatcccgccaccgataatggcaattttttccataaaaaagcctccttttacaaacaaccattttcacacaaaaaaacggcagatgcaacacctgccgtatatggaatctacgcttttttagcaaagaacagataataggcgaatcgagcaaagcttacgagaagcaacagcaacaagacgcctaatgctgcttttgatcctaatgtagtagacacttcatagttatgggaagtatgatgctggacgtaattgataatgaccgctactaatgaagtagccacagcgccagaaaactgctgcaaggtattgaacattgcgttcccgtctccttgtagttcttcattcagtgcattcattccggtggtcatcatattgctgtaagataatccgataccgatcatataaaacacatgacaagcaatcaatacacccactgaagcgtgtcctatgagtaggaataatgctagccaaccaatcaaagaaagaatcagcccagcaaaaattggcttcttcggaccatattgatccagcattttcccggaaaaaggagaaagcaaagcaccaaccgctgcgccgggaagcatcgctaatccagcgacaaaaggactacttccttgaacgatctgaaggaaattcggcaagacaaaagatacaccaagtaataaaaactgataaactaagaagccaatcaaaaacaagcggaatgttttatttgaaagaatagacagtcggatcagcggatgctccacttttttacttcgatagtaaaaaaggaaccagccaataccgccgatgattaaagcaatccagctggaaactgttcccaacgtactcaaaaatgttagacttccactaaacaaaagacaaattcctaaaacgcttatccaatctaaataaccacttttttgtactgccatctcgggaatagcaaaccagccgataatcaaagaaagaatcaaaacgggcacaagaaacaggaagatatgattccatgtaaaatgtgaagtcataatgcctccataagtgggaccaattgctggagcaatggccgttgtcaaagtaccgacacccatcatcgcgcctcgtcgattgaggggggcaaatgtcaagataatatggaacatcaacggaagagcgatacctgtcgctgcaccttggagcaatcgaccaaacaataggaccatgaaggtaggagagaagaaatcgatcattatacctgccaagaaaagcagatttgaagctaaaaagagttttttgagactaaaattgcgattcaaataagtagacagcggaacaatgatcgaaatcatcaaaagataaatcgttgttacccattggacttgtgcagtcgttaaatcaaactgtctgataagagttgggaaagttacattcatggccgtctcgatcaatacgcccgcaaaagacatcatccctgttgcaattactgcaggtactaaaagcagctgtttttgttttgtcatttacatcacctctaaaaaatttcgtaaaaaaagagagtgatttctattataaaaatagaaaccgcctctctctcgacacgccgaaacgtgttatctgtacgatttatttacttaacttattctagcacaaactgaaaaatagtgtcaacacgattagccaagtcactcaaaaagaggtatgataataaataactaaatggaatttcgcggaggaagaaaaatggaaaaaattgaatggcgtaaagacaagagctatagtatgaaaaaaagcccgcaaatactagaggttcctaaaaaaccattctttagcatcagagggatcggcgacccgaatcaggaagactttaaacgaagagtagcctgtctatatgcagtcagctatgcaatacgcatgtcgcctaaaaaaaattggctgattcctgattatcagatgtatactgtctatccactggaaggacaatggggactgcaagaaaagtatttgcatgaaccagtgatgaaaaaagaacatttttcttatcaattgatgatccgacagcctgactttgttacagaagcgatagcacaagaagccattcagcgttctagcaaacttccggaagacttgaaagaacaagtagtattcaaaaagatggaagaaggtctttgtgcccaaatcttacacgtcgggccctatgacgaagaaccagcaacgtttgagaaattagaagcattcatcgcaaaagaaggctatgaaagagcttctaaagaacacaaagagatttacatcagcgatccaagaaaatcagcacctgaaaaaatgaagacgattttgcgtgttaaaatagaaaaaggttagcaacctgaatgaaaacaaaaaataaaagtaaaaaataccaaaatatgaagaaatattacttatcttttgctataatcaacattgagaggtgtctaatatgaaaaagaaacagcgacaagcactgatccgccagatcattacagaacaacctattgggacacaggaagagctgcttgcgcgactgcatgaagcaggcgccgatgtgactcaagcaacgatttctcgagacattcgagaaatgaagttagtaaaaagtcaaaatgaaaacaaaatagtacgctatacattatttaaccagccatctgtttctttaaatgaagaacgtttgcgtacagcaattagacgcgaggttttgcgtatccagtctgttcagttcatggtcatcgtattgactgaacgaaatggtgccgatgtggtaacgaattggctagatgaagtggcttaccctgaagttgtcggaacgatggccggtgtagatacattcattattatttgccgctcagaagaagaagcacagcgatttgcagaaaagctggaaaaaatgagggaataaatgaggaggacttttatatgaaagatatgaaagcgctacaaaatggatcggatattcgaggaatcgcattaccagttgaaggatatgaagtaaacttgacgacagacatggtaaaaaagatcggctggggactagcaaactggataaagaaaaagaagaagtcaaccgatccaaataaaaaatggacgattgggattggtcatgacagtaggataagcggaccagcactgaaagaggcgttgatccaaagtctgaaagaacaagggatacatgtcatcgatttcgaattagctactacgcctgctatgtttatgtccactcaatttgaacagttctcgtgcgatgctgcggttatgctgactgctagccatcttccctattattataatggaataaaattctttacctcagaaggaggagcagaaaaagaagatattgcttttatcctatcacagcagcaaaaaataaaaagcgaacaaactggaagcgtagaaaaagcagaccttttgacaccttatgcgcaagatttagtcacaaaaatcaaaaaagggatgggaacacaagatgacaaaccactaaaaggttggaaaatcatcgtggatgctggaaatggtgctggtggattctttgctgaaaaagtattgaatagcttaggtgcggattcaacaggttcccaatttttggaaccagatggccgatttcctaatcatatcccaaatcctgataataaagaagcgatggaaagtatcaagcaggctgttttagcaaatgaagcagatcttgggatcattttcgatacagatgtggatcgtgctgcagttgtcagtgcttccggaacagtgatcaatcgaaataatttgatcgcagtattaagtacaatcgtattaaaagagcatccaggaacaagaatcgtgacgaattcccctacttcttctcatctacaaagattcattgaagaaaaaggaggcatccaagttcgttatatttccggctatcgaaatgtaatcaataaagcattagaacttaaccgtcttgggaaagatacacagctagccatcgaaacaagcggacacgctgcattcaaggaaaattattttctggatgatggtgcatatgtcatcgcaaagatcctgatgcttttgccagaattaaaaagaaaaggtatcacattagatgaacaaatcaaagagttgaaacagcccgtagaagtacaagaaatccgactaaaattgttcagcgatgaaccacgcgaacaaggaaacaagatattagaagaaatgaagcgactgttggaagaagaaaaagggatgaacttcgacccggaaaatgaagaaggtattcggtatgatctagaagagccatacggaaacggctggtttttgatccgtttaagcttacatgagccgttactagtattacagatagaaaatgatgaattcggaaagaacaagttggcgttagtaaaattagcaaaattattcggacatttttctgatcttgaatcattaacagcagaataaaccagtctttttgaaaggctagttgcttggacggcaaaaaaagtggtatggttaaatcgagtgctggtagggagaccagcaaaaggaggaaaaaatggtaacgaatatggttatttttttaacagtattggtttatggggtcaactttctggtatatatgtatcttaaaatcaatcatataaaagattatgtagaaaagattgcaatttattttggaacaaatatgacgctgttgttcacgagtagtatttttttgttttttggaaaaatagtagaagacggcattctggtattcgaataagcagaatttttgtagaaagcgccttacttgtcatacactataattatagccaagtagcaaatggtcaatcgaaaggagcagtacaatgaaaaaagcatacgaaacagcaatgatcaaccatggcgggcgcaatggagaagtcgaggcaccaaatggctcgatgcatatgaaaatcactcctccaggaatccatgcagaaggaacaaatccagaacaattatttgcagcaggttatgcttcttgtttcaatggggcggtacaacatatgatcaaagaagcaggaatgacagcagagtccacagtaaaagcacgtgtctctctttataatttagatgatggcggctatcagatcggtgtagtattagaagtgcatatcgatggcatcagcgaagaagaagcccaaaaaattgcagaagatgcgcatgaattctgcccttactccaaagcaactagaggaaatatcgatgtagaagtaacgattgtttagaagaataaaggaaatcgaaccagactaaaaacgtgaaaggaccgctttttgtctggttttttttgacaaataaagcagatgatttggagaatagacaattatcggttatcatatttttgtaccaatcggtaggtaaaaaagaagcgagggaaaaatgatggaaaaatatcaaaatattgtgatcggttttggaaagggcggtaagactttagcaaaggcgttagcttcaaaaggcgaatcggttttagtcgttgaaaagtcaacacgtatgtatggcggaacatgtatcaacatcggctgtattccttctaaatcattgattttcaatggagaaagaggaatcgactttacagaggctgttgctcggaaagaaaaattgacgggcatgcttcgagccaaaaattatcatatgatcagcgatgaggcaactgggacagtgatggacggtacagcacgttttctttctaaccatcaaatcgaagtgacgaataatggtgaaaaagtgattgttgaaggcgaacggattttcatcaatactggttctgaaccaatcattttaccaatcaaaggattgaatacaagtcgctacttgattgattctacgcaagcgatggatcaggaacaattaccggaaaaattagtgatcatcggggctggatatattggcttggaatttgcatcaatgttcaatgaatacggatctaaagttgtcgttcttgatgcccatcctgaatttcttcctcgtgaagatgaagatatcgcgcaaatgattttagaagacatgacaaatgcgggaatcgaattccatctaggtgtatctgtagatcaagtagcagaccaagaatcaacagctgccgtcacctttacagaagatggccaagaagtaacaatccaagcgtcaaaagttttggctgcaactggaagaaaaccaagtacagcatcacttggattagaaaatacagatgttaaactaacagatcgcggagcaatcgctgtggatgaataccttcgtacagatgcagacaacatttgggcgattggagacgtcaaaggcggattgcagttcacttatatttctctagatgattatcgaattatcatggatcagttgaaaggcgagaatacacgaacaacgaataaccggaaagctgtgccttacagtgtatttatcactccaactttatccaatgtaggattaacagaaaaacaagccaaagcacaaggcgtcaattacaaattattcaagtatatgacaagcggtgttcctaaagcacaagtattagaagatcctaaaggggtattcaaagttttagtcgaccctgaaactgacttgattctaggggcaagtatctatgcggaagattctcatgaagtcatcaacttgatttcgctagctatgaatggaaaacttccttatacgttattgagagatcaaatctattctcatccaacaatgagtgaagctctaaatgatgtattaaaataaataacgaatggagaatttatcatgttcaacaacaaaaatacagcagtagttctaactgacccgcaagtcgagttcttgaaaccagcaggcggtggctttggtttgacaaaagatatcttagaaaaatacaatacgatcgaaaacatgatcgaaatggtgaaacaagcaaaagaaaaaggatacaaactctttatttctcctcattatttttatccacatgaccataaatggcaatttggcggtgcaggagaacatatgatgcttgagcagcagatgtttgctagaaaaagtcaatatgaaccagtcgaagaaggttcaggagccgattttatcgaagaattgaaaccatatttggatgaaaatacgatcatcagctctcctcataaaatctttggaccagaaagcaatgatttggcgcttcaattgagaaaaaatggaatcgacacagtaattctcggtggaatgaacggaaacttgtgtagcgattcccatatgcgtgaattggtagagagtggattcaatgttgttgtagcgacagatgcaattggtgctcctggccaagaagcaatggatgcagcgttgacgaactttggctttattgcagatcaagtgatgacaacagaggaagtattagagcaactatcataagataggaactgcttttgtcctcgcagttcttgaatcaatgaacatctagctatatgagaacacatgagaacagttttatagtgagggctgtgtcagataatttggcacagtcttttttaaacgattaagaagaaaaaatgatgaatttattgtataatataggactatgagaaatgaaaaaggagaatatcattgaaaacaaaggaaaagatcttggaagcgaccaaagatcttatttataaaaaaggctatcatgaaacgtcaatccgagatattctagcagcttctgagacggggaaagggcaattttattattacttttcttcaaaaaaagaagtttgtctagcggtgatccatgcgcatatggacgtgtggcagacagaattgttcgaagacatcttaaatgctggaaaacagccagaagaagcattagaagaaatgttggactggatttttgctgatcatgagacacagatcacttatcatggctgtcctgtaggtaatttgattattgagttgagtacagtggatgaagaataccgtctgttgctactagaattagtcaatcaatgggtcaagtatacgaaacaaaatatcctggcactttctgaagaaaaactgtccgatgaagaagcagaccgtcaagccaaagcgttgattgctgaaatccagggaagtatcttattgttgaaagtcacacaggatctatcactacttagacaaaattttcaattgatcaaagaaagattgttaacttcgcaaaaggttctttaataattagaggttgtgaaatcagcgctttgacctgagtattagagaaacaaacggcaaaatagttcctcatattttgccgttttttgagctaataccgaaggttagctgattgaacaccgtttagtggagaggttgtgaaaaagctgccctgcatcaagtaataagaacagccaaataaaaatagctgctcatgtttttcgtttggttgggcttattaccgcagatgcaagctttggaacaccgtttacccagaggtcgtaagcctgccgtttcacttcgggtcacaaggaacaatttcaaaaaacagcttctcatgtttgttgaatattgtgacttgtgaccgaggagttggcaggagaataccattcactggagagtttgtcacttgtcacaacttttttagttctacacaaaatgaaagcgttttgttggtgcgaacttcttgttgcagtgtatgatagaaaaaaagattgggagggattaggatgtgtggtcgttatttttttgatctagagtcagagctccttcagaattattatcgagaagcccagaagaaacaaccggagcaggcagcagaattagcagctggagaagtttttccttcaaatcttgttgttacgttaagaaaagaggaagaaaacatcctcactccggaaatcatgaagtggggatttaccggatttaaaaaaggacaattgataatcaatgcccgtgcagagacagtagaagaaaaaaagacctttcatcaaccatttttgcaaaatcgttgtgttttcccaatgagtggcttttatgagtggaatgaagaaaaagacaaatttatgttttcaaataaggaaaaaatagtgtatattggcggtttttatcgtagccatcaggatgaaaaaatggcagaatcaatcataatgactactgaacctaaccgcacagtcgcaccaatccatgaccgaatgccgcttgtcttgactgaagaacaaatcgaaccttgggtaacagatatttcttttgcgcgaaaaatcattactcagcagatgcctgaattagtaatggagaaggtataacataatcgatttttcaaagaaagagcggcaaaaaacgaaaaagacttcagcacagatcccaaaaacaaagagaacagaagaaatgctcataagctgcatatactgcatctatagggtcacagtcgacctttctaatgtatagcttctatttgttttttactcgtgctgcgagtcttttttatttatacctaacgatgtttatcattatgactctttgaattcttggaatctaaaattcaaagttaacgactggttggcagttgtatattctctgaatttatagataagaggttgccatttatccacattgatatgagttggatcatgtaaaatcccttcttctacaaaaatagctacgatctcacgttctacaatagcaaagtcttgtctagttgaaattcgttgaaccaatgtttctatttgaagcgggcattctttgatccgaacagttgaaacttcttcacctgctagtttcgtgaactttcccaattgaaatttgtcagagcaaaaggaatagccagctttttgtttataatcgggcatgataggatggcctgtcgtctttgcgattttctcccaaagcgttttatctgcaaaattgaaggtagcgggggggttagctatagtatttgggtagcttttggatccataggttcaatgtttcttggattatttttttagttaaagaaaaaatgaactggctacaatttatttctatttatatccaataagatatactttaaacaaaacaattttctagatagtttacaaaggggaattttgcgttacttagtgttatatagtatacttttattaagggagtgatgataatgcttgttacaaaatctagattacaaggaagttctgtagtggtaactttaccttctgataacggaaagaaaccttcagaaaaccaagaatatatcgttgtgtattctgatgatggaacaattacgttagttccaaaaattgaagatccatttagtggtggggaagaggccgagtattatgagaaagacgaatgggaagatttaactcctgaagggagagaaattttatagtgtcagaagaaagaatttatattcctaaaaaaggtaatattgtatggattgattttgatccctccgtaggaaaagaaattcaaaaaagacgaccaggactagtcgtctctcgttatgaatttaaccgtaaaacaatgttttcggtcatatgtccaattacttccactataaagaatttaccgacacgttactcattacctgaagagctagatataaaaggacaagtaattatttcacaattaaaatctcttgattttaaggaacgaaaactcaaaaaaatagaaaacttaccattgcaagacatggctaaaattgatcagattatacagtatatgttttaagcattgtaagtaaactctataatatttttatacgctaaacataacgaaattaaaaaaaggccaagtaaatgtcgttcattctactagtgtggtcgatgggatcaatttctgtatcttaaactaaagaatatatagcattttaaacgaatgattgaggtgatttcctcaagtcattcgtttttttgtgtcacaaaacttgttttttcacgacatatcttaacgtatacgaaaagtcgcgacaatactttaacagaaagaagaaaaagaacaactgacagttttagtcctaaaaaatctaagctctttagatatgagtaatgtcattttaaactatatcgatgcttaaaaacgtaacatttgggatcaagatctgtctaggaaagaatttctatagtttaactgaataacacaaaaaggcatatcatgcgacaagaaaaacaatgaaaagagaaatttgccatcactggaacatccgtacagaaattagcatagattctgaaaaatctaccgctagtttttatttagttgttctaacgacaccaatacttgtaatgctcgaaaatgtgcaattgggtcagatagtgaaccaaagtagaatctcaaagcgacaattatgaatgtaaaagtaccttttatgattagtttattctctaattgattacatcccgtataattaataaaattactttaccgattacacgatcttatgtcagtagagcttttaggtacactatcaatacagttcattccagtataatgtaaggttttttttattttgagtcactttttgtcaatattattatttacaataccttctataataaaagttatttaaggaagtgtctatgaatgagtaaaaattctaaaggatgcctaaccatcttattagcttttatagggtatatgttggttgggctgctaaaatcatacagtaatgagttgctgaatttttcaacatttattaatgatacattagttccaagtttgtttttcattgtattttttgctgttggttattttataataaagatatgatgactaatttagctcaactattccagcgtcagctgaagatattgcaattcccgattccttaatcatttatctggatgagacagaaagtgaagttgcaacagatgtgcatgtagttgaggataaaaatgatagtttaaaaattaatagttcagatactttactaagagtaagtcctatcttttcagctgttatttagatgcaagtagcaactaagttaggtagtactcctgcaatggataggtattggtgtgttcgatatataagtggtcgaagtatcaaggttatgtatactggatgggagatagaagagttaaaaattggagatcaccgccacaaatggaatttagatttagaggtaccttagatttggtatagttattaaacacaagatggcctggtttgtagggaaagtcgaagagtatttttccacttctgcgcccctttaatttttctagtaatgccgtgaatttgtgattaattggaaatatgaagaaaggagagtctatgaaaacaacactagttctattctataaaaagcatccttattttacacttctgataaatatattgttggctagtgttatcgggatttctgttgaatatctaataaataaagatttcataggttctggtttttatacggctttatttcttggacttcttgaagcattttccatttctgatgaaaccatttgtcgcatacgagactctacttctgcttttgagagaccagctgccggatcgctttgaagttggatgccaagaccatgtatttcgattcctcgttctttgagtgccatcgcttctccgatggttgcgataaacgtactgtcgattcttctggatagattgttttggtcaggtgcatcatagattcttgagattagagaagtatttcccggccgatcttgcgtattagaaaactgagttccgtaataattgctgcttgattgtgcgtgtacccgctgtactttataggaaaatgttggtacaccatccgtcagcaaaacgatcacttttttatgtccatttggaacggatagcatgtttcctgcatctcttagtgctttttgtgtaaaagtaccaccatttgtccatgaaggtgtaatggattttacttgatttttcactgaatcaaatgaacccatctgtactgcaccgttgctgtagctatatccttcgcttgagtagccgacatatcccatattgattttgtctgtgataccgctatctgctaaagtatcgacaaaacgatcgacaccaatctttacttcaccgatccgattattgtcgttcatacttcctgaccagtctacgaccaatacgagatcaagaggcgtgatatctttttgtacatttccacgagcattcaaataaacatcaaacaatccgggtgtacttgtttcctttgcatactttcgtatcgcatagtctgcttgattaccagttcctccatattcgatatacgaatgggtccgatcattaggatctccattccaagaatttataccatcccattgatttgtaccgtttttattgccttgatgatcaagaacatttgtatttcctgtaggttgccaactggctttaggataagtgccctgatcatctgttgtatattctgtaggaatcgtttgattagatggcacactcacagctggcaaggataatgtaggcaatgtaaatgggctgacagaattttcgttttcttttgatgattcttcttctatttcgtctggctttggtactgacacatctgtatctttcttattttctgtctcatcaataatgtcatattctttattatcgacgatcagcttgtttgcctggctgtggtaaagtgctggatcgattggaaaactcagatcgatagtttgtttagtgtttgatgagatttccaacgtaattttcccgctatttacctgataagcatagccatctccttcttttctttccacatcacttaagtaattttcgactagaccaatttctttttctatcttttcagcactggtgttattcgcatttagcttgatgttcagtgctttttttccagactgatccgaaatgacttcagctgaaattgtttctaaaactgttggatcatctgtagtgtctgctattgcagataatggcacaaagtttgataaactcaatattatcagcatgaaaataactttcagtttcttccctgtggtcgtcatttttcccctcctttttctttttttctgttttgacgtgaatagtgaaaattattaaaataaacaggcgttacataattttatttattttaatatgataattattatacgaagggcgctaaagggaatcacaccaattttcataccaattggtttcatttatgaagttgattccttcgattaatgagcgtttcattgaaagaaaagggttgagggagaaaaacatatgatcaggttgttggaatgaaactatagaaagatggaaaaaatcattcgaattctgtccatttctgacaagtggatgactaaaaaagaacttgccaaacgaattggtagttcagaatctacatttgtaaggtatatcgaagagatcaaaatccgctggggaacggatgtaacgattcaatcttcacaaaaattggggtatcgtcttgaacatttgaatgtaccagcttatttaaatgttctgatggaaatgtcgcaaagttctacaaacagtcgtttattaaatgagattattgtcaatccgggtaaaacgattgagtattattgtgaaaaaatttccatcagccggtcttcttttacacgtaagttgaaacaatgcaatcaaattttagaaagctatttattaaaagtgatcgttgaccaaggttttcagttaactagccttaaaagtgagctccagttgcgtatctttgtcacctttttctttttaagttactacggaagacgcacgttgccatttccaatcgaaaaaaagaagatcaaagaaattatggtcaagaataattgtcagatgaatttgtttcaggaagaaagcccatatgagcaatctttctttattatgtattttgttgtgcatctcatgagagaatcccaaggaactccatttgaatggaaagctggagactcttatgtacagttgataaatatcgataaaaaagacttcttaatcttgaaaaatctcttaggaaaattgaagtacagcagctatataaaagtagtgaactattttgtcaatacgattttttcagaattttcggagaaagaaaaaaatgaaatcagtgagcagatacgaaaaaatatgtcctactgttcgttttcatccgctgattgcaaagaaaaaaacgaagaatatgttgttcaattattaacgcaaatttattttttctcccgtattttcccatacgatacgactcatttgacgatccgtgcaacttactttgcacagcagatgcaacaccgccagatacgtctatatgctggatttcgtgcagaacttcaattttattccactctactgaatcagaatctgatttattatttatctagctatatcttttggatgcttatcggtaatcctgaaattcaccattatacttctgataaaaaaatactgattatcagcgacttaagtcttcgacatagtcaatatattgaagaatatatcagtgatattcttgctgtgcataaaattcactctgagacaactgctattactgaagatcagctgtcgaaatacaatcttctcgagtatgatctgatcgttacgaatcaacccattttgaatgcccatgttcctcatatattgattgatgatagtgtgtcattcgcaaatgaagaagaactcatccgcttattcgagttatgaataatcaaaaaacagctatgtataaaccaccctgataaaaatttcaggacaaatacacatagctgtttctttttattgtattccttcagcaatccaacgagatttatagcgaaagtcttttaacaactcttcttttgtccaattatttgcaatgagatccgtcaaagtgttcattacgagggtcatggaaaagtataggaaactaactgcttcttccgacgattgaatggagaaatgattgattcttaataattccagccatttttcgttcattggagaatcagccgatagttctctacgtttggttgtctgctgatcatttcgctgggttaacaagtataacctttgccaatagatactttcgtgatctaagtcgcagcaccactctaaatatttttcgatccccaaaaagaaatgttgtttgttttcgctaatgaattttaagatatcttgatggactatgtgagaactgcttttgatcgtatacaaataagcatcttccaaatcttgaaaatatttataaaaagcaccgcgcgacatccccatcttgtcaacgatttctgagactttgacttggctgatgtgctgtgagcaaaatatctccagtaataggtcatcgattctctgtttctttgcgttcgataaattgaaaaaagtttcttttggcatccacatctctcctttatctctgattatacgtggatagcccttcattgtcatgaaggattcattccttctttttctcttcttctgtcaagtacccatcttccattcgataaacgcgatcactccattgaatcatacggacatcatgagtaaccataatagtcgctttttgtttctcatgagcttctttaactagtaatttgacgacttcatatgcatgatctgtatccaaactagctgttggttcgtctgctaagatcaagcttggctcattatataaagcgcgagcaattgccactctctgtctttctccaccagaaaggtctttaggataactatttttaagtgactggatatctaaagattgcagcaaggaatcgatttttgttgaatcttctttttttgaagtaacttggtcaactagttcaaattgttcctttaccgttaaaaaaggaatcaaattagagctttggagaataaatcctatttctttaaagcgtaaatctgctcgttttttttctggaagctcagttagtgagtgaccgttgatcactatttctccggaagtcggtgtttgcaatcctcctgaaatggtaaggaaagtacttttacctgaaccagaaggaccaatgatgctgacgaattctccttcctttacataaaaatcaattgctttcaaagctgagacctttgtatgaccagaaccaaatgttttggtaacttttttcatcgttaatatttttttcatttttattaacctcctattgctgtaattgggtctactttggttatcgtacgtatcgaaaacaatccgcctagcattgcgacaatgatcaaaatcccactatatagcaaccattgtgaccaaaaaacagcaaaaggcatcgcgcttggtaaaatcagactagtcaaataagcaaacaaaagagcaagcagaacgcctaccaccccaacaataaaggactgtgctactaaagatttagcgatgaagaaatttttgatcccttgtgctttcattactccaaaaatagcagtcttctgaagtgtcatcacgtacatgaaaataccgatcacggcagcaaccactaagaacaaaaagtatatcatcgcatttaaggtcatattttgggcagaatagccaggaatactttcaatgaatgtcccaatagttaataactgtagacccttcgatgctttttctttcgaaattttagctgaatcctttattacgatcccattgatcggctgttcttcttcagaagcaaacggctgttgtccatacttcaaagcagtccacgtatctagggacgcatagatgacgggagaaactgtgtaataagtttcaggaaagataccgacaatcgtcaaaggatcgtcgtaactgccaattttgatcgtatctccaattttatagcctgaatcagccagattttgagagatgatgatttcattctttgttttaaattcatgccctttcgtgagttttggtaataaaaatgcttctttcgttgtgccgaaaactgtaacattttctttgttttttcctttgattgctccgctgtacaatccgattggtgctttctctcctccttcaatgtatttcagatctcctcttgttaattgtgaagctgcaaatacttgatttgcatcctccgacaaaacaatctcttgtgcgtcccaatcatcgattgcttttttaaactcttctgaaagtccattcgctagtcctgacaacatgaatacgacatacgcaatcaagaacataataccgacgatcaagccatatcgtaatttagaatagcgaatttctttgatagctagaaacatttgtttttcctccctatgatagattgatagtgacaaaatgtcacttgttgaatagtgtaactctaaagtgacaatttgtcacttgtgttgtttttttcttatcaataaattgtctaagacatctttcgataaaaccttaacatgagtcataaaaaatttatttaagccttatttatgctttccatgataaactaaagtgaccaaatcaatgaggtgggaaaatgattaaactattagtagtagaagacgataaagtattatccaataatataaaagaaatactcgctgcaatcggcgagataacacaagtttatgatggtagtgaaggactgttcgagttggaaagtggagtttatgatcttgcaatcttggatttgatgatgccggaaatgaatggatatgaagtgttagcaaaaatacggaaagaaaaaatacagactccagtattgattttgactgcaaaagatagtttggaagataagattgaaggatttgaacgaggtgcagatgattatctaacaaaacctttctatcgagaagaactgatcatgcgcgtgaaagcattattgaaacgctcgctaggtctctttgatgaaaatgttctgaagtataaggatatcagttgtgatttaaaaagcaatgaagtcttgtataaagaacaagttttgcccatacaaggaaaagagtttgaattgctcgtttattttttacaaaataagggaatcattttgacaaaagagcagatatttgaccggatctggggatttgattctgatacgacgattacagttattgaagtttatatgagcaacttacgaaaacatctgcgaagtactggattggataaagaaatcaaaaccttacgtaatgtcggttatatactgcaaagggtgtgatgcaatgaatggagatattacacgaaagcaacgtagtcgcttttttgcgacaaatgtagcagcatttgcttttatcttttttcttttgggattcattactttacagatattaaaccaatctgcatacagagaaacagatctgtcattagagaaaataaattttgattctcgaacagtacaattagagatacaaagatatcagcaaggcgatccctttttaaacccgactcaaacggaacaaaacagaacaaacatggaacagccattaatggaaccatcaaatgaccgttttaacactcaagtgatcttgtggtctaaaaatggtgagatattgaataaagcagctattggtgggcgtttcaaccaaatcaaagaattaaaaatggatacgaaaaatctgaataccatccaaaatattgaattaaatgaagacagtggctcatctgccctctctttccgttcgattacgaaaaaagcggagacgaatcaagatggcgttgcctacatccaaattttagaaaatacaaatcaaatcaagaattcattagcgacttttcgcacgattatgattttgtgtatgattgttttttggattctctctattggtatcagttattacttgtctagtctaagcatgcgccctattattctttcttggagaagacaaaaagaatttgttgagaatgcttctcatgaattgcgcacaccgttaacgattattcaaaatagtttggaacatctttttaccaagcctaatcatactattattgaagaatccgaaagcatcgctcaagcattgtcagagacgaggcgcctcactggattgacttcggatttgctgacaatcgctcggaatgattctgatcagcagctgctttcaaagcaaatgatcaatacacaagaatatatcgaacaacttgttaaaccatttcaagagatggccaccatagatggaaaagagtttattctccataacgatgcaacattagaagtaccaattgatgaaaaaaaaatccatcaagttttggttattttgctggataatgcattaaaatatacgaatccagaagataagatcattttggattcatctgttaaccataaagaatggctgattcacgtaaagaatactggcccttctatcagtgaagaagatcaagcaaggatttttgatcgattttatcgggaagatcaatctcgggcgaaagagactggcggatacgggcttggcttggcaattgcaaaacaggtaatcgaacagcatcatggacagatttctgtatccaattatcttccacaaggagtcgattttaaagtccaattgccgttgaagcctaaaaaataatgcttatccctaaaaaagggctgtgacaaaaatcttgtcacagcccttttttgttgcgaataaacggtgttccagaagtagcttcttcggaaataagccgaaatttctttaagctgaccacttctgtcacaacctctttagcttacgcttacgattttttattgcggtcttcaatgtgtacatcaccgcttgtgtcaatatccaattcttctcggctaacatcttctgtcactttttcaacatcttcatgttcttctttatgaatcccaacttcttcacgaataactgtatgtttgcttacatctacttgctcttctttgattgggatagtaatcgtgtcatcttccaagttttcgtctgttccctgtgaagattgatctgttactggtttgcgttcgatgacgatttcttcacgtttgaccggtacttctaccgtttcagtatcgttgaccacatgtttgtggatgtcgacttctccagttgtcacatcatgtgtatttacatctaatttttcttcttttagttgaattgtatcatcatctagatttggtttgcgatcgatgtcttcagtcttgcttgtacccattgtatcagtctcgccaggtacgtccatcggatcagttcctggtgtcatattcaatggatccgttgtattttgaaagcctgtcgtgccacctacgtccattggatctgttccagtgccagtttctaatccagtccccattgtgcttgctgggctaacagtatcttgtgtatccattgtatcttctgttgtttctggatgacgatagccttttactgtgatgacaaattttccatcagaaatatctcctctatattgatataaaggatcattttctggtgtagccgtctcagaatcataggtatcaaaagaaaaagtatcttttattttttcccataaagaacggtcttcttcaccatccatccgattttcatctgtttcaacatctataccagacaatccgtcaaatcctagtctagatgctgcttcatcagtagtataaataacgatatcatctcgttcatacccttcgttacgcaaccgttcaattactgataatgcttcttccctcgtactatagcttccgatgaccgttaaatttttctcttccatgtaaattcctcctagcaaatagatttatgattggtatattgttacttataaatttattctataggagacgattgttttctacaaatatttagattggaatttgattaaaacaatttaattgaaatttgaaaacatttatgttaatgaaagtcatattctaataaaatgtcatttgtttctatatgaatttttatgaaaaatttcatataatttccactcgttgtgatggtttaatttatccaatccatcaataagcaaacaacttatataaaaaaggattaattctcaatataattgctcctaccatagaataaatcttcatgtaaagtaatgaagtaccaactatttctaatacttctttaagaattatcccaacaatatcgttagacaaaccattattgaataaatggagagccaatcgattctgaaaaaatgttttctaatttttcggaaataaaagaaagagcctcctgccattagaacgaaccaaatccatttcattgctcatgaagtaaccacatagctaaaaagaggataaatcaattaaaagatcaaaagaatgactgcactaataaaataactaaaaatgtatcttcttacttcatatcttttagctagtacttagttaaaaatttgcttcctaagatcaagacaaactgtctatcttcatttgatgaaatgcggtaaaatatagaaaatgaacactattggagggaatttgtaatggacagcaaaactagaaaacaactgcaagaaaagttaaagcaacgtacacacttgctcccttccgtctttcaacagtttttagaagaaaatcgttcttccctttcattaggcagtcgctatgaatacgcaaaagattttcatctgtttactgattatttgagaaaagtattttctgaagaagtggatgatcagctgattatccatttagaaaaacaagattatcagaatttcttagctaaaatctatcgacatactcgttcgttccaaactacagcgaaccaagaaacggagcaattgtttgaaaatagctattacgggatttcaaggaagcaatattcattaaatcattttttacgatttttgtatcaaaaaggactgattgaagaagagatttctcttttgggtacaagtttaccggaaacaaccaaagcagctccgcgatatatcgatgcagaacttttcaaagattttgagcatttgtttatcccgattgaaggctttcaaacaagcagagaagctagctttgaagaaaagaatagaccgaggaaccttgcaattactgccattcttctgtattgcggattaaagatccatgaagtagtagaacttaaacgtaaagatgtatctttgaccaagcagattcttaatctgaatagaaaagaaaacagactgaataaagtaccaataccaaaagaagcgatgccatttctggagaactattttaagttaacagcacaaaatacggacgaaaattcttttgtttttcgttcctcacatgatcagcaaatttctcctcggactattcgccaaattttgagcaaaattacagtatataaaaacgtatcgccagaactatgcagaaaaacatatcgttattatgcagaactatatttagatgatgctgacgcggtaaattatttatgtggtaatcgatacctctcatcccattcttttcaagatatctgggaaaagatggttgatttttcttatcacgaattagcggcattcgttcgggtttcttccatataaaacaaatgtatgatctttttttcacaataaactatgttattatataaaggattatgttacgattatcttgaatttgtatattacttaacaaaagataatggagtgtgaatgatggagaccataacgtattcccctttgaacttatttacgaattttcaagaagctgcagctaacttttccgagaccccgattatctttgatgagccactttcagctttcccagaattaggacttgaaacaacttacaaaaaatgctgcgaaagtgtgttgaaacgggcttatcaattggctcatcttggagtgaaatccggagacaaagttattatttataagagttccgcttttgacacataccttctagctgtttctgtgtcttaccttggtgcagtgcctgtcatgacttcttatcatctaccaacaacaacaatggaagtatttatcgatcgtttagaagaccctttcattttatttgatgatgagacaaaaaagcgagtgagagaaatttcaaatggaacaaaatcaaaacagattcctattctttatttaatggaacaacctgctttgtctgtttctcaatcatttttagacaaaaatgaaatttcttatatgacccatacttctggtacaactggtatccctaaacttatttgtcattctgctcattctatgggatggcggacgaaatggcaaaaaacagttttcacaaaaatttcggaaaagaaattaatcgcttttcacatctctccagtgcattccagattcaatattggtatctcttctttgatgtccatgggatttcctatgatgcctttagcaaacgcacaaagttcaaaagttgttcatatgttggaagctcaccggccaattgcactagagacccatccgaataactttgttcagtggcgttttactgctaaggagcatccagaagctttttcgggtatccgatactatcactccacttttgatgctataaacaaccagacaatgaagacatttttgcgaacgtcgatggcacaggatgcggtatttcttcaagtatatggccaaagtgaatgcggaccaatgattcttaaggctcatacactagagagtttgaaaacaagtgatgcaagagatatgggcgttggactggaagacatgacaagcgctcggattacagattcagttgggaatgtcctacctgaaaacacagatggtcatatacaattactgtctaaaggacgggctttgacttattacaaggaagatgcacggttccaggaaaatgtttatggcgattggtgggatagcggagattacggttttatggataagcatggccacctatttttgaaagatcggcaagtggatttgatcgaaacgatcaatagtacattagctattgaagactttttattagattcgttagattttttggcagaagtagtgattgtaagggataaaaatcattctccacaaccgattattgctttagctcctgataaagaaatggattggaatcgatggtgggagcaagtccatgaacttcctcgcttgaacgtccctatcatccgtgattttgatgcaatcccgcgaacagctacaatgaaagtgcaacggcttcaaatcgagaaagaattaaaatcacaaaagtcctaactatttaaggaaagaaagatccattttggtctttcttttctttttgtttttttaaattggatgagataaaaatatgccaattggctgtttttcttttttgaaaatttcgttatactcttattcatggaggaaaatgttatgaaaagaatcttgacaattggcggttctgatccatttgctggtggaggaatccaaacagatttaaaaacttttgagaattttggtctattcggactaagcgccttgacttctataggggcactagatattaatgagcgatttatgctggaatctatatctttggaattgcttaaacgacagttagtttcgattgataaaatgacttcattagaaggtatcaaaattgggttattgaattcaagtgaagcaatcatggttgttcgagacttcataaaaacaaaacaaaatatcccaatcattttagaccctgttttggcattcaaagaaactgaagctgtgatcaatcaattgtatatttcgcagctcatcgaagaactttttccacttgttacgatgattacgcctaatttggcagaagctgctttactttctggtcaagctcttccctcttcgttaacagaaatgatccatctcgctaaagaactcactgcttcaggaacaaaaaacattgtgatcaaaggcggcacaaggatggctggagatgaagctgtggatcttctctattcaattgatcattatgaggtattttctcataaaaaaatcgacactacaacagtaaacggggccggttgtgccttttcttctgcaataacagcgaatcttgtgttaggggcagattttaccaaagcagtagcagaaagtaaaaaatttgttgcccattgtatttctaatggcgtgctgatgaacgatcataccggaagtgtctggtctggcggtattcaaaaaggaggaatgagaaatgaaaactaagcaattaacgatctatgctatgctgattgcgttgacagttgccctttcattaacaattttgatccctgtaccggctacgaatggatttgtgacattatgcgaggccgggatctataccgctgcttttctttatggtccaacgggtggattagttgttggtgcttccagtggtctattgatcgatttgatttcaggatatccgcagtgggcagttttttcattagtgatccacgggttacaaggatatgttgctggttctttcagcaaatcttctactcgtatgtggggattagggcttttattaggaagcttagttatgatcatcggctatggtatcgccggttggattttatatgattggccggctggagtggcttctataccaggaaacatcttccaaaatctgattggaatgggacttgcctttcctataactgcaagtcttcaacgtattcaagcacggaagcaatattaattgaaaaagaaggttttagaaaatgaagttgtcagaaaaagaattaaaagaccaattgactgaaatagttaatgacatattggctgaggcacacttgaaaaaaggtgatctttttgttttaggatgcagcacaagcgaagtcgttggaggacatattggaaaaaattccagtgcggaagttggtcaatggatcatccgtacgttaaaagagttgttggatcctaaagaaattgcgctagctgtccaaggttgtgaacatttgaaccgagcattagtagtagaacgaacagtggcagaagcaaaaaatttcgaaattgtctctgttgttcctgcactacatgctggaggtgcttgttctgttgctgcttttgaccagttcaatgatcctgtcgaagtggaacacgtagttggacaagccggtatcgatatcggtgacacatcaatcggtatgcatatcaaacatgtccaagtacctgtcagacctcgtttgaaaacccttggacaagctcacgtgacagcccttcgctctcgtcctaaatatatcggtggtcctagagcgaattattgaaatgagtaattgacagagcaatctgaaaaacttcctcgcaaagtccaactaatgaactttaacgaggaagttttacttgtttgttttatataaccgagcttcataaggtgctagtatgcctttagcttcaaattctccgctagaggaatttgacaagagtaatgtccaggactgatctgcttcttttggaagttcatagtcagcaagtgattctgttaagtttaccataataagatattgttcatcttctaaatatctttcatagacataaagttgtggatgttcatgaagatattctttataagaaccgtatatcagacctttattggtttgtctaatgcggatcatgttcttatagaattgcaggaccgactctggttcatattcttgttgttctacattgatcgttttggtatttggattagtgatcagccaaggttcatgtgtagaaaaaccagcatattgttccgaagtccattgcatgggtgtcctgctgttgtctctcgttgtttcaagaatgatatccaatgcttcttctcttgtcttaccttccgcaagcagccttttataaagtcttttcgaatctactgcatcaacttgatcgatcgattcaaagggcatattcgtcattccgatttcctgtccttgataaataaatggcgtaccttgcaaaaagaaatacatcatagcgattgcttttgcagacatagcccaaaaatcgggacgagtatctccaaacactgaaacggcacgaggaacatcatggttttccatatataaagcgttccatccgataccatccaatgaagtttgccaagcgcttaatgcatgtttcaatttaaggacatctaattgcccttctttttcttgctgccagatatggatatgatcaaattcgaatatcatatcgaaataaccgtctttccctacccattgtggtccttcttctgcagtgacaccacttgcttctccgacagtcatgatatcgtactcttcaaaaacatgtttcaaatcggtcaaatgttcttcgattcctgagacattttgaaagggtgagaaagggttctctgtggcttttactgaatattcatctttttttacatgagaaatcgcatctaaacgaaatccatctatccctttatccaaccaccatcggatcatattgaatagttcttctttcaatttctcgctttcccaatttaagtctggttgttcttttgcaaaaacatgcagataatactgtccagtttcatgagaatactcccaagcagaaccgccgaaaatcgatgtccaattattcggttctttgccatctaccccgtcgacccaaatgtaataatcgcgatacgggctttctttagattttttcgattcttcaaaccattgatgctgatccgaactatggttgatgacaagatccataatcactttgatccctaattcatgtgcttcttttagcaataaatcaaaatcttccatcgttccgaatctctcttctatatcttgatagtcacttacgtcataaccattatcgacaaatggagattgatagatcggattgatccagataaagccgataccaagatctttcaaataattaagtttttcacggatcccattgatgtctccttgaccatcgccattgctatctttgaaactagcaggatagatttgatagcctactgcttctttccaccatttttgttcttgtatcatatcgtttcactcctttaacggtccctcttgattataaccgattctattttagaagtatccttgttaccggtaactagaaacgaaaagctcaacgaatctgctaagtgcgttcgttgagctttattttatcatagatagcgggcaatcagttgaatcatttgcttgggaaattcattcaagtcagtaatatctacaaaacgactttcaccgtagatcgacttgatttcttctttgtcttggccaatagctgcggagacaaataggattccttgacgttcatattctttcaaaacagactggatatcttcttttgcttttttgcctgtataatccggcaacgcttttggctgaccgtcactaatattaagcaacagtttggttgttgcggattgtctgtttaatttttctgctgctaaacgaagtgcagcaccatcacgattgttttgccttggtttcatagtgactaatttttcatttaaccattgaaatccgtcttcaaattctttataagaaaacaaagaagtcttttctcttgacgaacggtctgctgtatctccgtaaatcaacaatgggatatcgactttcttagaaaattcggcaatggcaatcgctgctttttttgccgcttcgatccgatcatcccgtatcattgacccagattcatcgatccgtacagctaccgctaaagaaggttgctcatgtggcgggttctttttgtcaaaatttctcaaatcaccatatgctactttgcttgcattgaaccgctgaccttcgtattttcctttttggtacgtctctgtttgttcattatccagtaactctaaaatttgccggctaagtgattctactattggcattacttgcatgtgtagctcacgtgcttccggcgtttttccttggaaagctggtcggtgaacgatgagaccttctttttcatgaatcgtttccttcatgatttgtcgcgcttctttattcagttgcttcttgatttccttatcatgtgcttccatgtcagaagcagacatttcttgagaatcatctcctgtttgttgttctttttgattttttccttcgatatcgctactgcgttctttttgcatttgaggaggaatctcgtttttttctattgtttcttcttgtttctcttctccctcatttggttcttcagcagacaacgatttcttttcatctaagcgcagaatttcttcagcattttcagtgatgtttcgttcatttgcttcttcggcgctaatggttcttccttttgtatgctcagattgaggatgaccccatttttcttttctcaatatgtcctgaagttccagtagcaatccactgtcagacaaagcttgttcaagaattgccaattcatctgaatcagtggataatttatacaaaacttttggataaatcgactggagtaaatcttgtccttgcttataggtatttgcccaataaaaataagaacgcattcctgctacacctttgatggcgttagcttttgcagtttcatccaacaaacggataatctctgccatctttaagagaagttcttgtttttggatcatagttttcgccatcgcacgttctgccatgacttctaaggcaggaagatccattttttccgcatgttgcatccgatctcttaaagattcatttaatgggcgatttccttggtaatttcgatttgtagtgatcacaatgacgcaatctggatggcgacgaatgattcctgtcggtaaattcaacatcccatttggttcgagcgctgagttaagtgccacaagaacagaggcatctcggatgacagtcggctcttgaatctctaataaatatcctttttcaatcgctcgaacgatttcagaagggtaatagctgtaatggattgcatctggataatcagcttcgatcctttgaactagctctgctaatttttctttagcagaaaaaggatcaatgccgtaatggttctggatcagtgtcagtacagcttcaagtgtatctgtttggtaaatagcttctagtaattcttggtcttgttccttattagaatctactacaggtaataaggctccgaaaacatctgatttgtccatatctgcaaaacaggtcacttttgtatagggaagttgcagatcagcagatagtgctttggctaattgtgtcttccccgacccggcatctccttccaaaagtacgttactgattttcatttcaggatcttgccaattccctttgatttcggaggcgatccgccattcttctgcacttgtccgatggcttttcggtttcttccagatcatttgcttttctagccgtgaaaaggttcggttttctgttagtgagaaattctccatgcttctcttccccttttgatcatctctgtctattaatatcctagctcatctaaaagacgttttaaaatacggaatcgttccccaatcagttctccgtctttttgtagtgtatcgtaatacaaaatgatgtcttcatcgatctttggatttttggtatctacttctaccgtcattcggttcccttgtaatccaatgatgtctacgactggattttctggatcataaaatttttcataacgataagcatcttggaagtataaacttccttgcgcagctaagatcgctaaatctaaaatacgtgtgattggtaattcttccgactgtcgtgaccatttttctccagtatgtcgccataccttgcctgagatatcgacttttccacgatcattccactgagcaaggcccagtgaaagcccttttgcatccgtatttaatgcatttcttccatcaactttatcatagtcttctacaacgattactggtttatgttttaaatttgttggtatttccattattttaactcctcatccttttatttttagtaaataagtaaattagtagtttactcatttactaaactatatgcgacattatagaggattgaagtgaggattgcaaagaaaaagagcttcattgatagaaataaaaacaccatctcgttcttttacacgctcattagtaacatgtagaaagtccaagatgatgttggaatatttttggtatgttttttgaataaaaggaattattgcgctgaaatggcaatgccgatggctttttcacctaaatgtgtaccaatgactggtccgaaatgaccaatttcgatttctgcatttggatattttttctgcaatttctctttctccgcaatcgctacttctaaattatttgcatgtatcacgtaaagtttgactggcggttgtatttcgttatttcttctaccaataatttcttcagctcgagcaaatgcttttttacttgaacggattttttcgaataaaacaattttcccttcagaaaatgtcaggatcggtttgatttttaataagctgccaatcagcgctgcaccatttgtcaaacgtcctcctcgtactaaattgttcaaatcatctacaatcagataagcgtaggtattatctcggattcgatcgatatgtgcaagtatttcatcaagggactgaccttcatcatttaagtctaaggcagcttctaccatgtgtcccatcggcatactagtgatcttagagtcataaggaatgaccgttactccgctgatgtcatctttcatcgcaaataatgtgttgacaaagccagaaatccctgaagaaagatggatacttaaaatcgtgtcataccctttctctttcaattcctcatataaacccaaaacttcccctacgacaggttgtgaagtagtaggaaaatctttactgttttttaaaagtccataatattcatccgcttcgatatcgattccttcgttataaattttcccatccataatcaaagggattggaataacgaataagtcgggatggttcttgatacgttccggcagatatgccgaactatctgtaactactgcaagtttcatgtgtttaatttcctcgtttcaaagaatttttccagaccttataactatatcataagtaagattagatatgaaactaaaattggaaaatagaaaaacgacaagcgtaatcatacgagttgccgtttttcaagtgacagcaaaaaacgattagttaacctattctttgcttctgctatgatgtttaacatttttcaacattcgaaacccattttttccgaattgagaaaataaaaatactaagccgccaatacttcctacagccacacaataaatcattgcatagctttttgattccattgacaatcgctgattcagcaaaaagaaaacggcaaaacatactgcaagcataatcagggtggagcggaaagtttttaagaaaaaattgctgatctttgctaaaggtgctattcggtattctttgcacataaagtgatagccgcgaacaaagacaataccgaatgctaagccatttgataagctcatcccgtatccgccaactaatcctaatccgattacttggaagatgactttcaggataattgcttctacagttaatcggatcgcaaaacgatggtgattcaaagattgaagcatcgtagataggatcgtgaataaagagaaaaacaaagaagctagcaaagccatttggaaatatccgacactttcaggatcatagccaaaaaacaatgtgtatagtggtccagctaataaagacattccagtcaatgaaggaagaagaatcaataacgcaatcgaaaaactatctcctactgttttttcgatttgtatccgatcttttttcttcatcgtgcttaatattggcaagctgcttatagctactgttcctaccatggagatcaggatcaatgtcaatttatttggattgacagaagcacggctgaataagaattccagttgctgatctgcgatctctggacggaaaaagtgaagcagtggtttcatcgttacttggtcgatcatttgaacgatagtaatgactgagccgacaaaaataaacggtagtgtttcccgaatgatagagacagaggcagatcggttttctctttcgaaataacggctggaaatcaaaaaatctttaagttcgaagaagtcttttctgcgtccgacgatatacatatggataatcgcagctaacccaccgaagaaagaagcgactgtactgatcaatacagcttctaatatggttccgtcagtcaatacgcgcaagtaataagtaccagccaagataacgatcactcgcacagcctgttcgataatcaaagaagttccataaggccgcagatcattttttccttggaaatatcctctcattgcactaagaattgggatagcaatcaaagatgggcataaacttctgatagctagtatcccattattaacgttagcaatcggactgattccggctagtaaaggagcaaataaatacatcagtgcagcagaggcgataccgatgacaaacatgatattgatcgtacttctaaaaatcagccgacaagcagcgttatctccttcttttgtggctacagctactttttttgcaatcgcatttggaaatccgactgtaccaagcatcaggaacaatccataaggaagatagccaacattatacaatgtcgtagcaagcataccatcttgattgttccccatcatacttagccagggaatcaaatagactacccctaaaactttacatagaagattagcaaaggttagccaaaatgttccttgcatcaattttttattcatttaaattccctcaactattctttcataaaataaacatcttccctattatagcaaaaaatcatagaaggacaaatccctctctaattcctaaaataaaaaagagcttgcatcataagccaacactaatcttttttatccctacgaataaacttgcatccagaattgactgttgcaaatgcagttcggatagatcagtttgaacaacttatgtcgcaatctctgtttttaataaaataaaacagtttaaagcatagacagcaaaaagacagacgcaagtcctgtcaaaactgacaacgccatcgaacgtgttttgtaagccacgcctgctactagaatcattgcagctattttgatattccaagcaatatccagatgttcatgagtaatgaaaacatctttaaaagctaacgccgcaaataatgccaccggtacatatttcatccagtcactgaaccaggatggcacttttcgatgagtaaaataaagcatcgggaacaagcgcgggatatatgccacgatgaacagacaagcaactaaaagtagcaaatatagtttagtcatggtgattggcctcctgttccgggaagttgaagagcggctcattgacatctttaccgcggtctcttagtttcttagctttttcttttttgaatgccttctccagcataaatccggcaaatgaagcaatgactgttgctgcaatcaatccgaaagtattttggaataataccatgaatacgacccctaatacgcctgagaataaacctgtaaagatcagtagtgcgcttttcatctgcatgataaacatgaaaatgaacatggccgtcaaagcaaaatggacaaggtcagcatctactcgaatcaccgagccgaaaaaattaccgatcatattgctaccggcccatgcagtcattgagaaccaattgacatataaagcctttcttttattccagtaagggtcagttgaaaactttaagtagttcaccgcatagttttcatcattcagtgattgagaaaagacagccaaaaacgtccgcttttcttttttcataaaaccggcaagacttgctcctaataatgtatagcgtaattctaaaaagaaaaccatcaataatgtcgttgcaaatgatgcttgcgtcgtaagcatagatgcaactaaaaactgcgcgccaccggaaaagaccagaatcgataacagtcctgataagagaggatcaaatccaactttttgcaacaatactccgcaagctaatcctactggtatatagcttatacaaagtggcatcactgcatgcaaagcttgaagccatggcgcacttttctttttgttcattaaaatatctcctttaattacaacaaataaacagcggactcattgtaacataaattcgctaaattgtagccgttttatttaaaaacaagattatatttttctcatttttgcttcaattcatgaataaacgttttatttacgagaataatttgggtcatatttatctgtttcaatgtatatatacatcttcttgtcaggaagagactgacgcatatttttttcaatatcattgatgaccgagtaagcttcattctctttgttaccaacgatatctgcttttgctgcaactaaaatctccgttggacttaaatgaactgtttttatatcgatcagccgactgatctcaggacgttcaaaagctaacttgatttttgataaatcgcttgctgtcacgctttcaccgatgatcagactataaaattcttttgctaggaaaatggcggctcccatcagcaagaaaccgatcagcaatccgctgatcgcatcaaatgcagcaatcccggttgcataagtcaatattgttcctgctaaagccaagaccaaaccgattacagcacacaagtcttccgtaaaaataatcagtatttcactgtgtcgactttcgcgcaaaaagcgcatcgtggaaagtttttcagtattcaattctttgatttctttcattgccacgcgtaacgaacttccttcgattaccaaaccaaataacagtattgctataacaatgatcggattacccacttcatgggatggatgcgtcaacttttcaaaagcttccatcaccccaagtgccccaccgccgaagaaaagcatcattgcgacgattgtactgaaaaagtattttgctcgtccttcaccaaattgatgcaactcgctctgtcctttattggcttgtttatcaccgaataacagcaaaatctgattgctgcaatcaacgatactgtggatgctttcgtttagcatggcggcactgccactgattgcatagccgacaaatttgctgatagcaactagaatattagcccctagagcagcaattacggaaaacattccgctttttttaaaattttccatgttattttccttctttcatcaactgaactcactgaattatggcaatattcgccctttaacagttttttatgaaacttatagtttagacaaattgaaaatgaccgattgtccatcattcaatttgatctctttggcaccagtagtagcacttttcccgtccacagtaaacatccaatagagttgatttttctcatcctgtgagtgcccttcaagcgaagtgatgaagccgttatcttctttgacttcaaaatttcgtttcaaaatactcagtaaatcatcgccttttttgaagaccacttctttttccgaaaagttttgaccattttcttgtaacgtgattgttgctttttgcgatgtttttacttcctccttttggttggaagccgattgtgtataggttgtactgcaacttgtcaaaatgagtatactgacactcattgcaagcaaactataaattatttttttcattttttcctcctgaatgattgtaaaaacgtttgacgactggcagaaaaacaagaaagaacacaacattgcctatactgtgcatcaaatcaaacgacaccccttgaaggtaatagatccaaggttgaggcaaacgatataacagcgtatcaaaaacggtcatacctattccgtaaaccatgcccgccagaaaaaaacagactccctttaaccatagattcctttgcactgtttttctcaagcagacgattgaaaacaaactcagaacaacagtatagctgatccattggccgatgacccatggtccaacaccaaaataaaaactgctgatcgcaatagaaagactcatgacaattaacgcatcttttaagcttaagtaaagtactataaataaaaaaatagcagtcattggctggaaattcggaataaattgaaaagcgatcctacctgctacacaagcagcagacaataagctaagctgtgctattttatttgtggacattcctaatgaaatccctccttcatcagcaagttattcacgtccatttagtacatacagaaaagacttgtgacaattattctggataactgccgcaagtcctttggaacagaattatctgaatgacatctggtaatccaacttatccaatcaggactttctcaccattaatgggaccaagaattcgtaattgataaagaaatcaatgacagatcgtgggtagtctccagatgagatcgacaagactgtttgatctttttcgtttgttgttatcgttaaagactgtcctttatctaatcgtacttgataagtagtttcgttgatcttttccatatcgtaggatggatttttcattgccacgataaaaatatcatccaatacttcattcgtcaattcaaattcgctctgaagattcaaacgaagtggcttcgtattgtctagtaatgtctgattaacggtaaaaccaagtgttcttgcatgggctaataattgattcaatttgtgattgaatatcgtgatctgccctgcagagaatactcgatccactgaccagtgtcggatcaaagaaagcacccggtcatcttggacattgatttccattgtctctggtgatacgtttaggagactcatcgattccacttggtatcgttgatcgatggtcggtaatacaaaggaaaagactaattcgttttgtccattcaacgtataattgatcgaaaaatgtcttgttttccatgtgtcataagctgaatttgaccgttccagaccaatatcattcaacggtttcagtaattcatacgtgaagtattcgatcaggcttgtctttccgatcgtggagattggttcttcattcaatataaaacgatcatatgattctaataattgtggaaaatctgattcgatcaaatcttttctcatacgtaaatccgctaattctgcttccgctgtttcaatcaaactgacgatatcttgatgatcttgctcttttccttctaaatacccgggattttcagttatttcgtaagcatgggtgttttctgcagtattcgtattcgtcggagttactttttctttttcgtgtatttttgtttcctctagcatagggatttcttctgtgtcatccagaggattacttgtttgttcttccaatgaagtgttcgtttcttcatgatcttctgtttgttcttcattttttgtccattctgcttcatcgtgttcattcatactcggaacctccttcattagattgattattaggattctcattgccaagataattcatcaagaattcatggattgcttgaccgaatccctctttgctaccgaaatagcgtctgatttgcctttgttctttttctacgatggctgcacgaagctggtctgctcttgcttcttgcttcaatgcttctttttgctgctggattgtttcaggcgtctcaatataaggaagccagcctaatttttcattagatagtacttgcttcttcttctctaattcttgaatttcttcctcgatttttttacgattcaagaatcctttattgtcgttcaaatcagtcatttgtcgattgatttcttttatttgttcatctaaacgttcaatttctgtctgagcagtgatcacctttgcgtctagctcattgatttttttgtcatagtccgttgactccggttgggaatatttctcccactcttcatcgatcttaggcaaaacaaaaatttctggcagacttgcatcaataccgaccgtgggccgatcatggtaataagtgccgattttgtaatagctcatcgttggcgagatgttttctacttgttccataaaaggaaattcctgtaaaaaacgatcatggatcttacgcatcagcaattgatcgatctcgtgattttcatttgagcttctttttaattcttcattcaatcggccattgtataaacggtagatctcagggatatcttcttcgcggacagctttttcaaaagcctgtaagtcttctaataattgggaaagattcatgcttgctttttctttgatatcgtaaaaagaagacgattcttgtcctgtatcctgatccgcgttcgtctcctctagttcgtctggctcataatttgcatttgtatctggctctttcatactacttgcctcctcttactcatctgtttttcacttattaatacttcaatagtaccattttctgtaaaaaattgttataaaaaagagcgggcaatgctccataaaacaggctgcaccaaaatttggtacagcctttttttcgatcaactagtctttccatctgataggacagaatcgaatccgatgacctttatcttattttttatttactaggcagatctcttgttgtgaaatgaatgcgctgatgctcatcacgagttagctgcgtttcttcgtttagataagtaaacgtcaattgttccaattcgggatcttcaagcattctttcataaccggtaaaaatcgaacggatatagtgtttatatgcgtttttctttttctgtctttttttcatgtagcaccttccttatcaaaaactatcataccaatgaataactatctagacaagttggtttaaaccattttctttgtttttttgaggaatttcgctcttccagttgacgaatcctcaaaaaaatgaaaaaatgctttagtacttaaggagggaacctagtgaaaaaaattggttttgattcagaaaaatatattgaagagcagtcagcgtatattttggaacgagtgaaccactatgacaaattatatttagaatttggtgggaagctagttgacgacaagcatgcgaaacgtgtacttccaggatttgaagaagatgcgaaaatcaaattgctgcaaaaattgaaagatcaagctgaaatactgatttgcgtctatgctggagatattgaacgtaataagatccgtggtgattatgggattacttatgatatggatatcttgcggttaatcgatgaattacgtggttatggcttattaatcaacagtgtcgttatcactcgctatagtggacagcctgccacaaaagtctttatcaataaactagaaagacgaaacatcaaggtctataaacactcagaaatcgaagactatccagtcaacgtagaaaaaatcgtctcagaagatggttttggaaaaaatgagtatattgaaacaactaaaccaatcgttgtagtgacagctcctggcccaggaagtggaaagctcgctacttgcttgaaccaactgtatcatgaaagccaaaaaggacatgcagctggttactccaagttcgaaactttcccagtatggaatgttccgttgaaacatccgctgaacattgcttatgaagcagccacagtcgatctaaaagatgtcaatatgatcgattccttccactttgatgcctacaataaagtagctgtgaactataatcgggatgttgagacatttcctgtaatcaaacgtattattgaaaaaattactggtaaagaatctgtttatcaatctcctactgacatgggtgtgaatcgtgtaggatttgggatcgtggatgataccgttgtccaagaagcctctaaacaagaaatcatccgtcgttatttccaaacagaatgcgacttcaaaaaaggattgatcgacgaagaagcagttaatcgaatcaaactgattatggaagaagtcggtttacgtcctgaagaccgaaacgtggtagtccctgcccatgactatgcagataagattcaagcgcaaagtcctacaaaagatccttctgctgtgattgcaatcgaattaccagatgaagtcatcattaccgggcgtacaagttcattgatggatgcgtcagcggcagttatcttaaatgcagtaaaacatttagcccatatcgcagatgacattcctttattgtcaccattagttcttgaaacaatacaaggattgaaatcaaagacacttcattcctctttggatgcactaagcatcaatgaagtcttgatcgctttatcaatcagtgcagtaacgaatccaatcgctcaagttgcttatgataaactagctgaacttgagggagcacaagcccactctactgtgatggtcaataaaaatgatgaacaaacattgaaaaaactaggaatcgatattacctgcgcacctgtctacccttccgaaaatctatattaccaatagaaaaagtttacttataaatgttgaaaacgaaactattagcttaatcgatagtttcgtttttttatagactttactaagacgttacactttttaaaccttttattttgttcgctttattttctaatggaaaatgaatgcgtttcactctaaaaaagtaatgaaaatttcactaaagattagtattttatttgcaaaacaggtaaaataaaacggaatttggaataggagtgattatttgagttatttattaggtattattggtttatttgtcacattagggcttgcttttttgatcagcagtaacaaaaaagcaatcaaattgaaaccactaattgtgatgttcgttttacagcttgttcttggtttcgtattattacgtacaacttttggtacagcggttgtttctgtattggcaaaaatgtttgatcatcttcttgcttttgctgggcaaggtgttgactttgtttttgccggtgtagcaaataaaggaagtgcacctttctttctttccgtattgatgccaattgtatttatttctgctattatcggtattctacgctatatcaagattcttccattatttatgaaagctgttggtctaggattaagtaaaatcaacgggatgggcaaattggaatcttataatggagtagcttctgctattttaggacaatcggaagtttttatttccataaaaaaggaattacccttcctatctgagaaacgtttgttcaccatgagtgtatcggctatgtctacagtttctatgtcgatcgtcggatcttatatggcactgatcgattctaaatatgtgatcactgcccttgttttgaacttatttggcggttatattctggcttcaattgtaaatccctatgtattagaagaaaaagaagatcagctgatcattgaagaaaacaaagaacagacatttttccaaatgttgggagaatacattcttgatggtttccatgtggcgatcacggttgctgctatgcttatcggttttgttgctttgattgccatgatcaatgctatcttccacgggatattcggcatcactttccaagagatcctaggttacatctttgcccctcttgccttcatcagcggaatcccatggaaagaagcagtggatgccggtagtatcatggcgactaaactggttacaaatgaatttgttgctatgacagaattagcaaatggtaatttccattttactgagcgtacaacagcaattatatctgtcttcctcgtttcatttgccaacttctcttctatcgggatcatttctggtgcgatgaagggattaaatgaagaaaaaggaaatcttgtcgcaaaacacggattgaaaattttgctaacagcgactttagtcagctttttaagtgctattgtgactggcttgctggtataatatacaaaaaagcaaagttacttttaaaagctttggaaatattttccaaagctttttcacttgttcaatcatcaaaggagaaatgacaatgaattattgctatgtatttatcggtccttctggttctggaaaaacttcactcgcagaagctatttttcagccggaacaaaagatcattacttacacgaatcgatcaccaagacctggggaaaaagatcaagaggattattattttgtttctgacaatacattcaatcagatgatcaagggaaatgagtttgcagagtgggaccaatatgctcaacataaatatggttccagtaaagcagaaattaaaaagaaactgacagtaggaaattgttacgccgttttgacagcaaatggtttttggcatttatatgagtatttcgggacggtagtccgtcctatctttattacgatctctaaagaaacattgcaatcgcgcctgaaaaaacgtggagattcatctgaacagatttcagccagactggcggtttatgtagaagatttagcacagttgaaacgtttgaaagctatcccctcacttttagtcgtgtcaaacgatggagcgttccaagaagctgcagataaaataaaaaaaggattattgatataaatgtatcgaataatactcgtaggataagccgagaggtcgtgacaaaagctatgtcacgacctctcgatgaagggagtttcagaaagcagctatttcgtaaaatacgctaaaattccacaaaaatttgagaagcattttcggaaattctttcttgttttttgaagctggccacttctgttacaacctcttggctatcatatgattgtttttttcagtagtgttaatgtctttatctttgctcagatgattttatagtcaattgatgattatttgatatgcttttctttcgccgtgttcaaaaggaaattcaatcatcccttgataagtgaatccagcagaatagatggtcttttccatcggttcattagctggataagtatcgatacggatatcttggatatttttgctggctgcaatcgtcaacaaatgttctaagaacggttttgctagtttttttcctcgagtactttctgctaaagcgacacgatgaatcgataaataaggaccagttgattctttccaactaccatctatttttgtgtaaacgggatccacgcctgagactaatgcagctgttccagcaatttgatcttccactattaatacatagctttcttttctttcaatatcgttcaaaatcgtttcttttgttggtttctgcccgttttgccattgaggagagccttgcgaagcaatgaaatccgctgcggcattaatgatttctaccacttcttctacttcttctttccttgtttgccgaatatacatccagtttcctcttttctattcctttttcatttacattatctaatcattggatcacttcatatagttcctgaacttttgaataatatttaagccaatcttttggatgatctagcaggtgactaataagttccaaatgatgcataagtgaccactttttcaacactcccagtccagggaatttttgttgctggtaaagagccaataattcaatcattcctgaagtaatcaagagttgatgatggtgacgcatgatccattttttcattttatctcctgcttcaagaaacttcaatgcttggtctttagcagagtcgttactgtcagagacaaaatgtttcacgcgtatattgccgtaagcatcaatatacgttagatggatagcaagcgctcggctagggaaccctttatcgaaataacggctaccttcgatcgtgaaatcagaaaatccaatatatccgtctgcgtggaaaaaaagatagtcatcactaaaaaagtcatctgttttatctgcataactttcaacatgctttctcgtttgaaaagagtcacggatcacaattttgttttcgggcagccagatgcgaaagcgactagtatctggtatcaaaaatttcgaatcaactcctgccaactgtttccacacctctgtatcttttgggtagtgctgtccatcgaaaacaagaaacgctggaggtgaatccagtacttcactgagattttctggcgttaagatctgtgcagggacgacagagctattttctttgactgtccaactgtgcacatgctgatcgaataatttgaattgtcctacttggggattttggatcacagcgattggatggtgctttttttgaaataattcgatcacatttttaagcgtagcggaatcacgtactggttcgatcactggttggattttattggagagcaatcctcgcgacagtgcttcttttaatgctaataggtcaaattgttttcctcttaaataaggatagtacatatttttcactccaatggctctgtaggcaaccgacggatctgctgttgttgcctcaaatattcataatcatgctgaagcgcgataacttcttcttgcaactcattgattgcctgactagctatttcctctaaaaaccgttcataatatcgttcgttagaaaatggatcttgattttctgaacgtcttttcaattctttgtacaattgatctgttggaaaatattttacgcctcgctccatttgctttgcttttcttacttccctaaataaagaagccatgaagcggtttgtcaaagcttcttccggtacagcaagctctttctttgctgcttttttcgcaatcagaaatgtaccagaggcaggcatctcctcttcaaccgtgtacggacgatacactaaaacacctattcctgtagggatttcagtttttacttcttcatatagtttacttggtaaaacaaaataattataatgtccaacaaatgacagtttggctgtagagcgaaaatctgcttttgtcactttcagctcatagcatcgccattctcggcttccatcaaattttgtcaagcagctaagcgtatctacaattccttggtcatcaggcatcgtgacttcttctacaaccaagccgccttgctcgatgcaatattggtataacgaggattctatttcgatggttagcggggtcttcatgttttctacctccgaacatattttcgatttacattttacatgaaatggttttaaaatactaggcagaatatacaagaaacaaaaaatagaaatggtgccagccacgctagcaccatttctatttttcagattgactgatggatagaacgtttttctaaatactgttgcactttttcgatcccgatacaaatgacccaataaatcagtgcaactaaaatatagagagaaaaataatcgaatgtccgaccgcctatgatctttgctttttgaaatatttctggcactgtgattgttgctgctaacgaagtacctttcactagatccatagctacgttactgagtgccggtaccgagattcgaaaagcttgcggcaaaacgatatatttcaataccccaaagaaagaaaaaccagaagctaaaccagcgtcccactgacctgaagaaacgcctgctagtgatcctcgatagatttcaccaataaatgcactgctggtaatcgtaaagcagatgactgaagccgttaaggcacttaattgataaggtaacccgaaatataacagaaacagcaggactagtgcgggaatgcctctaaagaacgataaataaaaacgaataaatacattcagaggcagccaatccaaaagacctaaaactgtcaaaagcaaccctaccaagtttcctaaaagaaacgacacgaagccaatccctaatgtgtataccaagccttgcagtacgaaaggaagcgaagtccacatgagggaaaaatcaattagaggaaagtacatcactcactcaccgactcagccatcgtttctttcggtttgactgaaacatcagtttgaaaatatttttcagatattttctttgtcgtcccatcttctttcatctcttttaatacgccatcgattttctttttcagagcatcatttccttctttcaataaaaaaccactttcgttttcattgaaataaacgttctccagtatttttacagggatatctggtaaagcagatacggccattttctgcagataataatcatttagaataacatctgttcgaccatttgctacatcgcttaaatactgatcattcgtggcattgtcatatgtgactaatttagctccgtgtttttccgctaaacgcatatagctagtattgggttcgccagctgcttttttccctttaagatcttcaagtgagtggattcctgaatcatctttttttcgtacgatcatactgtcaaatgaatatttgaaaggctctgaaagggagaattttttttctctttcttttgtgataccaaaatcgttcgcagcaaaatctgattctccttttgaaacagaagtgatttgtccatccacgttgtattctttaaaggagattttgacatttaaccgtttagccacctcttttgccaaatctacgtcataaccaactaattcattttgatcattataataagatgcgggaaacagtgtgccagaagtcgctactactaattctttctttttttctacattactccagctgttatcttcctgattagcggcagctgtaccgcaagcgcttaaaataaaaaaggcactagttattagagcaaacaatctttttttcttcattcttcttctccttgtttctgctatttccatggatttggtaaatggaactgatgatttgcttcaaatagatagccgatttgaaatagcaaatcttctcttcctctggcagccataaattggattcctagaggcatgttttcttttgtcaaatgagtaggcaagctgattgctggttgtccagtcagattagccaactgtgtataaggtgtgatcttcaagctctcctcaaacatggaagaaacaacgtctaaagcttctacttcagaacaatcactgatgtgttccatctgtgctcttatcgcatcactttgcaaatcttcgctgattttaggggcggtaaatgcagtcgttggtgaaaggaatagatcgtattcttgatgtaggttttccatgacaattgctgcttcatcccatacatgcagagaatcgatgtaagtagcggcagagagcttctgaccatattggaacaaagtccaagaaatgggttcaagttcttcttttctgacagctcgctggatgcctgtttcaatcgagcggatcattgctgctgtttctgcgccattcatctgataataagacgtgatcagtttacgaccatctagtgggtaaggaatctctgtcaaatcatgcccttcttttccaaggaaatctacagctttttttacagcaagtactgcctcttcactaatctgtgagtggatcggtgaatcaacacaaaaagctatcttcaaccgtttttttcttggatgtgtttgccactcaactggcgatacttgatatggcgcaccggaatggatacttctcatcccataaaataaagcctccgtgtctctcatagaaactgtcaagccgaaatcaatagcagctccttgccatcctctccaagcatatggaccaactggcatcgtccctcgcgaaggtttcagcccaatcaatccgcaaaacgaagcgggtattctaatagaaccaccgccatcactagcaccagctaaaggaacgattcctgatgaaactgcagcagcagctcctccacttgatccgcccggtgtacattcaaggttccaagggtttcttgctgggccatagatgactgggtctgtaatatttttgaaaccaaactctggcgcattggtttgtccaaaaggaactagacctatcgcttctgcttgccgcacataattagatgtatgagaagctcggtgtgtttcaaataaacgagatcctgaagtagctagccatccctttttttcttgaccgagcatttttaaaggaaatgggataccagccaatggccctttttctgactggggaatcaatagctcgtgggaattactctcgaatggttcaagcgcgacaaacgcattcaattcatgattttgcttctttatttttttctgtatatccgtaactagttcttgaaaactaaattctttttctttaagctcttttgctaattctgttgcatcattcatattatcctcctttttgcctctgttattttcccacaagttcgtctaacatacaatgagtacgcttgcacaggaatgaacagacgagtgttttttataaaaaaagacgaagatcaatcatgaccttcgtctttttgctatgaaatgttgcgtaatttgcctttaaattcgtcaattgacgtatatcctttttctgacataatctgcgttaattcttttatgattctagaaaaaatttccggcccttctttatgaagctcggtaccaatctgtaacatgcttgcgccacatagcagatgttcaaatgcatcttgtcctgtccgaatcccacctgtaccaatgatttggatttctggtttcaaacgtgtataaaaagcgcgaacatttgccaaagcagtcggcttgatatactctccgccaatgccgccgaacccttcttttggtttgatgactactgcttcttgttctgtatcgatatacaaaccattgcccacactgttgatagcattgacataggtcaatggaaacttattcaagatatcagccatctgatcaaaatgagcaaaatcaaaataaggaggcaatttgattcctagcggcttagaaaagatgctgaatacttctttcagtgtttcataagtggcctcaaaatcgtaagctagttgtggttttccaggcacattgggacaagataaatttaattcagtgatcccattaaacccacttttttctattttctcaagcatttccaagttttcctggacactcatcccggcaatggaaaaaaataacggttgattttggttttcctgcactttttcatacgcaagagcatactctagataataagaaaaacctaggtttggaagtcccatagaattgatactgcctaaaggaacatcaaaatagcgtggttcgggatttccttttcgttcattgatcgtacagctcttagtgataaatgctcctgcttctgaatgagccagttcatctaattcctgggtagtcatgcagtggacaccagatgcattcatcaaaggattggcaaagatatgattggcaaaggtcgtttctaaactcaagtaaatcgctccttcaaacaagttattttatctagtgtatcatgactaaaagaaaaatcaactcttgttttccgaagaaattcttaatcatcttgttcagttgacagtacttcgcctgtttggctattgatcttgactgatgtactttgattgccgtcttttactttgacttcccaataagtagtacctaaatctttatccaaatcccaatctgttgccgtaccgcttcctactttgtcgacggcgatttttgctgcttcctcaatcgtgatcaatttatcaacatccagaccatcttcttttttcttttgaccattttgttcatctcgatctagagttcctggattctctgtctccattttttcattttgagcatcaattcttgcttcgtattctttttgatcatcgacaccttctatcttgtagaagtaagatccccaatcactatctaattccaaactagtaattgcagtatctgggtatttatcttggaacaattcgatcgcacgagctgcagacactttgatatctgactgagtacttgcttcactagaactttttgtctggctagacgaagatgtgcttgcttttgttgaggagtccgatacctgtgaagagcgctgttcgctactggaagacgtattcccagatgtgccttgattggtatttgattgacaagcagctaaaaacaaagctgcaaataaactagtataaataacagtttttttcattgattcgatcccctttgttataaaatagtattctattacaagtataacgaagaaaaaattttctgtcatgtttaaaaattaaagaaccaaatttttattatgaaaatataaagaaaaagaaactaagctttagagacaatcctagaagttagacaaaaaatctcacttctggagcatcataaaacttagcttctttttaaatagtctttaaacagtacttttgcctcaattatgcacgatgcattgggatgtcattgtttccaggttgaacaagcaaatattgaatcacatcgatattacttgattcaaatgaagctgcacaagcttgtaaatatagatcccacattcgatagaaggaatcacccatttctttcgtgacttgatcttggacttgatgaaaattctttgtccaatgttctaatgtcaattggtagtcacgacgtaagctttccaaatcaatcagttgcaaatcgttttttgtaatattatcaactaattcagtaacaccagggacataaccgccagggaaaatatatttattgatccaagcatttgtcgcaccgccttgttgtcggctgattccatggatcaaagctgttccttttggtttcaataaatcttttaccactttgaaataaccttcaagattttcagaacctacatgttcgaacatacctacacttgtgatatgatcaaacgtttcgccttttagttcgcggtaatccattaataatacacggcatttatcttctaaatgttcttcatttattcttttggtaatcaaatcgtattgttcttcacttagtgtgatcccagttgccttgacattatactctttggcagcagtgaacatcaatgttccccagccacaaccgatatcaagcaacgtttcgccttctttgataaagagtttgtctaagatatgatggactttattgatttgtgcttgttccaacgtatcttcaggtgtattgaaataagcacaagaataagtcaaagttggatctagccaaagtttataaaagtcgttacctaagtcataatgcgcatggatatcttctttgtttttttgtttcgtatgtttttctttctttggcagccattttagataatcttttcctcgtaaaaagctgtttgcttgctgataagcatcgttgatcaatgcttggatacttccctcgatctcgattcgatgatccatataggcttctcctagtgccaaagaagcgttacttgtaatctctttcattgggatttcttcatggatattgattttgatttggggaggagtgtccgtatctccgtattgtttcgttgtaccgtcccaataatttacttcgacagggagcgagaaagaacgtgaaaataattgattgtataaagttttctctaacatgattttcctccttaaaaaaactaccctattacgttaatactaaaaaagaaaagaatcaactaagaagtttaattttttcagaaatttttcaaaaactactttatttttcatttttttcacattcattgtcgcataaatcgcttaaacttgtcattcgacacgcttatctttgaatcttgttttgacaaaaacccataaaagcagcaagacagttatcgttgtttggacacttagcatcaagataaagtcaaagtggataaaccctacaactgctgctgccatggaacctattcccataacattcagcatcaaatttgcactctctttgaatgtatgaatggatgaaagttggctttttcttgtcatccacaagaaaaaggaagccccgaataaaatgagactcgtcatgacaaataggacaagaccaagacttaaactataagataaaatgattgttggacgattactggcataaaattctctttctaaaaatcgttggaaatcttcgggcgtacgtacagaatctggttggaaagatgggctataattcatcgtatagcggcgtataccagatttatccttttgttggatcacccattgttccttctcaaaatcaataaaagttccatgatcggattgttgtttctcagataaagacacacctaccaaaatttcaggggtcacagctatcgtttgttgcgatgattgtaacccagtttcagataattcaagttcagaaaattttttggttccttgttcatcgatcagcgaatgaacggatagaaattgttctaatggaatcgcttggatctgattggcataaaaaagagtcacaggcatgaccatcaaggaaactaaaaatacaaatatcaagaaaaatttaggccatgataatagtttgcgtcccgcaaacacttgagtcggcgtacgtaaagtggaaaaataatttaacggaaatgtttgcatgatcctctgctcctatccttttgttccgccagatgtcaggccggtaacaaagttcttttgtaaaaagaagaataatagacaaatcggtagtgcaatcaaaattgccccagcagcaaaaagagagactctttggtttgtcacatcagaaataaatgtttgtaagccgacagcaacagtctgattttcaggtgttcgaagcaggaacttagctaacatgaaatccccaaaaggtcccataaaagcccataatgcttgaacggcgagcatcggtttgacaagcggtaatacaatctggaaaaaaatcctgaaatgccctgccccatcaagtttagcagattcatctaaatctattggtacagtgtcaaagtatcctttcatcagccaagtattcattggaattccaccgcctatatagatcattgtcaagaaccagtacttatcgagcgcttctaataagaaagccatgacataaaaggcagtcaatgctgccatagtcggtaccatctgaatcactaaaaagaacatcaaacttgatttgcggccgataaaacgataacggctatacgtatagccagctaaagttactacagttacttgtacgatcatcgttaggacagagatgattaacgtatttttataccaagtcccgtaaagtgtttcactgaatagccgagtaaagtttcctaaagtccagtcacttgaaagatctaaactaaaagctgcaatatttcctgacttgaaggcagtacttgctgtgatcaaaagcggatagatgataatgactgacagtaataaaagaaaaaagtaagtaaaaaagtgagaaagtcgtttttggaatcgagcactcgaatgaaattttttcattgttaatcccccatattgaacgcatttgtctttttaaataccagcaatgacacacagataacgatgatggagataatcaacgtgattgctgaagccatagaatattgcggagaagttccagtcgtaagtttatagatccaggaaataagaatatcagtagaaccagctcctccgcctacgcttccgggaccaccattgttaaacagatagatcatggagaaattattgaaattccccgtatactgtgtaataaatgttggcgctgccactaggaagacagcaggaagcgtgatgtttgaaaagcgctgccatgcatttgctccgtcgatttttgctgcttcatataagtcttctgaaatcgattgtaagattcctgtaaccatcacatagatatagggaaatcctaaccagccctgcactaagataattgctactttcgtccagttgggatctgttttccaagagattgcactgatatctacaaaaggaagctggtttaggaaaggaatcacttgagtattgatggctcctacgctgtcgttgaatatattcgaaaaactcatgatagtaataaaagctgggactgcccatggtaataagaaaatgataccgaaaatacgtttgaatttaataaatttctggtgagcaacaaccgctgtgagaataccaagggtgatttgcaaagttgttgcacataaagtccaaatcacggtccacgaaaagactgcaaaaaaagtattacgatatgagcttaaaaagaagatactaaaaaagtttttagcccctacccaatcaatcaaactggctggtggaatatgattgaagtcataattagtaaatgcagtgaacaatgtaactaggactgggaaaatgatcgtaaaaatcatgagaagataagcgggaagtgtcaatagataaggaaaaccttcatcacctatattatgtatgacttccttcatcgtccgattgatttttttgccctcttgacgcatcttcgctactcgataagcgtctaaaagattcaaaccgtaaaaaatcaagaaaatgattgtaatgatgaattgcaaagtgccttcaatcaaaataaataatgaatgatcttccattggtatacttcccaaagtaaccaatcctaccaatgcatgaaatccgcccagaagcatctgaccaatgaataggacgaatatggcgaaaaaaacgatacctttaaaagcttggccatttacaaactgccccatccctggaataagtgaacaaagcgtgatttttttttcgttgatattgcttgttttatcttgctgcatctgaatgccccctctaaacttgctaaaccgcaaactgcttttaagataatggcaacaagagcaagataattttccatctcgctcttgccacttttatctgaagcacctgttccattttttataaaaatggacggttatcattttaatcagtatttttgttctatggcttcactgattgtttttactgcttcatctgcggattcttttggtgtttttgaacctgatgctgcatcgaacatcaagttttctgcacctgtccaaacttcgcccatttctgggatgtttggcatcgcttgagctgtttcatattgttcaatcacagctgttgttaattcatcgtttttagcctttgctgtttccctagcttgttggtttgcagggatttcatttaccatttcaaagaatttttcttgattttcctgattcgttacataatcaagccatttttgagagaggtctttgtttttagcataattgctgactacccatccttttcctccgccaaacggttgataaggctgtccattatttagagtaggaattttggctacaccataatcgatattgttttctttgtatgtttgcgcttgccatggaccgtcaatgattgctgcagttttattggacatgaattgctggctggcgaagtctcctgcactttttatgtcttgcattccctttggccaaacatttttgaaccaatctgttgcataagagattccttctacagcacctgcattattcaaaccgatatctgaaggatttgtaccatcatcaccaaatacatagccaccgtaacctgcaattaaaccataggaataataaaagtcagtccatttagctaaaaatcctgtattttttcctgcttctgactcaaaagcaaaacgactgtctttggatagattctccaaatctttaaacgttgatggtgctgtatcgactaaatctttgttatagtacaaaacaagggtctcgattactgcaggttctccgtagatttttccattataagtcacttgtgctttgtctgtttcatcgtaagctgcttcatttcccagttttacttccgccagatgtccttgctgtcctaacgcaccgatccggtcatatgctgccatcataacgtcaggtccctttccagcaggcccatctaacgctaatgattccaactgatcgaacatgtccttttctactagcttgattttcacatcgttttctttttcgaaagtgttttttatttcgtttatataatctttatatccagaatcaacggaaactgttaacgtttttccttcatcggcttccccttctgctgaagagttaccattgccacaagccgctaatccgcctaagattcctaaagagattaaccctaaacccaactgtttcacacttctttttttcatcttcatttcctcctgtgtattcaacgtgctgttacacccttattataatgggcacaaatcttcatttgcaaacgctttcttgttgttaccggtaacagttttcaacacatgatcaaaaatccgtattgtcgtatctctgctttcccgtcttctaacaactgacaattttgactaagaatcacctcattttcctgttctactacccaaggttcttttgactgattaaagtaaacatagatgatctgtccctctagttcccgtgtgaaatagagcttatcttcacgatcatttactattagccactgagtagaaccttcagaaataatcttagacaactgtttccttagagaaacaagttcttttataaaaccgaatagctctagatcttgttcctccttctcccatatcatacatttgcggcaatccgggtcatcttcaccagtcatccctatttctgtcccgtaatagatacaaggagaccctttttgaagaaacataaaggccatcacagacttcatcaattctttgttgccttggcaaagggtcaagatcctggcagtatcatgagaatctaataagttgaatgttccttcgttcacctgatctctgtaaagcatttgctgatgattcattccactgaccatttgtgaagctgtgattttcttttttgcaaaataatctttaattgaatctgtaaatgcataattcatcactgcatggaattcatccccttgcagccaagcttgagaggaatgccaaatctctccaaggatatagatgtctggtttgatttctgtaactgcttctctgaattttttccaaaaatgatgatcgacttcattagcaacatcgagacgccatccatcaatatcgaattcttttatccaataagttgcgatatccagcaaatatttttgcacttctggatttgctgtatttagtttcggcatgaatggagtaaaagcaaaagtatcatatgggatattttcagcagtttctggtaagtcagtcatctgataagaatctactgggaaaaaacggatgtggaaccagtctttatagatcgatttttctccgtttttgagaacgtcttgccactgtggtgaatggacacccatatgattgaatacagcatcgaacatgatacgtatccctcgtttatgtgcttcatcaattaagttttttaaaagttttttatctccaaacgcgggatcgacttcataatagtcgatcgtatcgtatttatgattggaagtggctttaaatatgggacaaaaatagatgccattgatgccaaggtccgtcaagtaatccaaatgatccatcacaccttgtaaatccccgccaaagaaatcttcacgatctggctctttgcttccccaagccaaagtatgctcggggtcatttgctttatccccatttgcaaatctttcaggaaaaatttgataccatactgtttctttcacccattctggtacaacgaagcgatcgatttgatgaaaataaggtattcgaaaataaaaatttggttcagtaatcacattttctcgataaggaaaaattccttgatcaccgtaaaaacagtccgtgttatcttccccaacaacatggaacgcatactgtaagcgccttgtttcgctcgtcacttcaatttcccaataatcatgaacattggtacttagacattttttcattggtcgttgtttttgataccatttttcagttgttatggtatatggatctccacatagcacatatacttttttgatatcatttttcctagtacgaagccgaatacgaaatcttgtattcgtatatagaaatgcatattcactttccggtcgatgataaattgcagctgtatccattgatttcctccttgtgttttaatatgacgtcatcactataagtgatagagaagcaaaagacaacgctttcaaaaatgttatcggtaacagttttttgataccgaatttttattttttcctgctatctttttctattattctaccttatttgatagtagatttaaaactttgcaacagaacccccatagatatattggacttcctcttttaaaacacaaaaataaatactaccttatttaggtagtatttattaaaagttacgtcaattttgattaaaaatatactacttgaacctctcatgagtaaagtcacgaaatttttgggaatagagcgtacttgatatcttattttttcactaatagcagtgtctcttattcaccaagcgatccccgtagttcctacggttcttaatttttctctagactaatgattgtatctttagaccttcggccataacatggagcaaaataaaaaggtactaagtcttatatatcaatcttcgagtaaccgacggttaacaaccatatcgagcggcattaatcacccacctgtagaggatgagcgacttttgcctaattattgttaaaagcctagtttcatttgtttagattggaaaatacgtcctacaagtatctcttttttttcatggtcgatccgataaaataaggcatagcttttgccgatcacgatccgatatgttgggatatccattccatagatttcggaaacttcctcatgcatagttggaaaatttttggttagttctaaagccttctggatcgcacctacaaatctttttatgctggctggagaaagagcaagctcattttcccattcttctattatcgtttcaaggctggtctggaaacttttagaataaactagcgtgtactctttcatctattcactccagccgtattttccgaaagcttttaccatttcaatttctgaaactgttaaacctttctcaaagtcttggaaactttcttcaatcaatttgcgatcgtgttcttttgctatttgagtagtatctaatatgaataagttgccttcttgtttggcttggatagtgtctccgctttttaatccaagagagcttggaaggatcactcccacgctattgccgatctttctaacctttagttcttttcccatgttatcacactccttttagtttttgataaataaattataacatgttataacaacaattgccaacggtgtttcttaagggattccactccatattattattggacaaaataagccacttagaacgctgaaaacatgtacaaacgatatcaaaatacgagtgaactactcaccatacacttccgttaacatccatttaagtaggtatttttattatatatagatttaacatatgtcggtcggttgattgatatagctaaagttataactcaaccgaagccgattcatctacacgaataaagttgcgagtgttctcggctaattcataaaaattgttatgtgttccatatagcaatactggaataactttattttcttgaatctcataagcaactctatacacggtgaccgcatacttaaatccattagaccaattacctgataaacctccagttttttgctcttacttaaatggatcaatagcaatttcatcacaaacctatagaggatgagtgacttctgcctaatacgttaaaaaatattgaaagtaactctatgtagcaaaaaatatctagaatttcatttcctcaaaactgatcgatattgtatctaaaaatatatactacctaaaataggtagtatatattaaaatatgtgcttttgttagaaaaaacaatacatcaattatcatatctgtatatgtcatttaggtatttcagttatgttataatagttttgctgtctgctaccccggcctaatctggcaaggggaggaggagatataatgaaatacctttttgattttgtttttgcaatcaagccacttgcagatgtagtgtgcagttacctctgcaaatggcttgattgcaaaattgccaaaaaagacagtaagcctaccagttaattctataatatagaaacgtaaaaaaaaccccatcagcctgcacgctgatggggtttggtgatataatgaaacacctctttgttactcacaattataccataattagtcacgaatgcaaccaatagaaaaaactacttagaacggtagatcatcgctaataacaatgcattgtccaccaaatggattttgtgaagcattaaatacattgttattaattgtcgctgcttttaactaggcctctccccttctattataaaagaagatatatattatttcttaattacctactaccttaaaccaaaatttaagtactacctaatttaagtagtacttaaataatctaaaaaatagttatctcaattgttatgcttttataatacgattatttgtaacaaaatgaatattatataattaaacactaccatatttaggtagtgtttaattattagcaaaacaaaaaatatttattctattctcttaacttcaactaagttatgctgcacacctttatataaatcatatgcaactcattagctagacaaactacaagcatgtagttttatctgttaattatgtactacctaaataaagtagtttataattaacaagtatatatatttaaaaatttaagattaatttttttatgacttgtacaaatttatctgatattctcttattaagaactacctaatttgggtagttcttattttttacattttaagtagtatttaattgcaatttggtagtatttttttattatcttattcctagaacggtagtacttaatataaatataggtagtatctaatttaagtattaatggtagtatctaatttaacaggtagtatgtaactactttaaagtaatttttttcagattaatacagtagtatcttattaaataagttaattttaatggtagtacataattattatatatatctgacattggtagtacttattgtattttttagtagtatataatctattgttttctagcctaaagccttgtcttataagaataatataatatatactactgaaataaggtagtatatattactagtaatggtagcatgttttatatgcataaggtagttcttaatttattttttgttttgacactggtagtacttaattatctttaattttaaaactaaattttattcatacgttcttctggtagtatttaattataaataatatttatttaaagtagttcttaatgactttaaaggtagtacataattcattttatttctgattttaggtagtatttaattaaaaaacagttttaatgcgtttgcattttttatttatctttgctattttcgaaaagagtaggtaattttacataaataaaacaacgtgaaagtagaggatctacaatgactgattttaatttttttaaggcggatagagtttacaacgaattattttatcaatttccaaaagtctttattgtttctgacgaatacaaaaaaatgaaagattcaactaagattgcctatatgcttttaaaagcaagattagagatcgcaatcagcaaacggcaaatcgatgaagaaggtaatgtttattttacttatacgacaaatgaactatgtagcgtattaaactgccaaaaacaaaaagcgatagcaatcaaaaaagagttggaatcctttggtttattattacaaaagcagatgggatttaacaaacagttagggaaaaataatcctaatagactatatctagcagaattaaaagtctcagaaaatgatatctacttactcgaaaaatttgatagagagaatagggaaaacgttgataaatcagagggtatgaaaatcatacccaccctcgacgaaaaatcagacgctgaatcccttggggctcaagagggtatgaaaatcataccgtgccaaaacgttgataaatcagagggtatgaaaatcataccagaacttaataataatatattagacactaatagacacaatatagacactgaaaaagaccgcctacaagatcaattgttgttagacaattttgagacaattatgacaaacgacagcattgctacgtttatccctgaacgagtattaaatttaataaaaacattttcttcaagttacagtgaagctcaaaaaactgtccagactattcataatgcaaagaaaaaagccgaaacagaaagtggtatttcaataatttttgaagaactcgatagttattatgtcaatgcagaacaagaattatacacgacactgttaaaagcctatcaaaaattaaaaaccgaaaaagttgaaaatatccagaacctgatttttgtctatgtaaaaaattggtttatcgaaaaaccaatagctgctaaagtatcaagtgaaaaacgtttgaattctgaaagcttcccaaaaactattacgaaagactggttagagtgaaattttactgacaaattgattgttgcttcatggagtagcattaaaattaaaaattttttattattctaattatattacaaatgttacaaagaaatagctattttaatagaatttatgagttaaaatattatgataaaaatcacaaacgtagctttttacgtcataagtgttaatagttaataattaatttccaacacaaaaaagagaacaaatgtttgcatgttgctgttttttagttataataatacgcgaagagaggtaatttcattttttaaaaaagctaaaaaccttgatattacttcttttcaggcaatacgaatattattcgcttacatttttttgtataaatttagttgttttaaatttaattgtctgctatgcttgtgatgaattgattttcgttctgcacttttggacgataaatttggacaattgaaaatacaaaaaaaagaaaggccctgtgagactcggaaggctggtaaccttcgtcgacgtccacaggtggcattaagacaacctttaatcccttaatgcgtttacctttcagtgttacggtattacccgcaacggatttagtataacagatattcaaaagtgatgccactttttttggctgtgttaaggttaaaaatacgtgatattacgatgaatctatgcctaagcataatgttataaaaatgtccgtgtggctctttgccgtatgacgaacgctgaaattagagggaacgcatgtttggatgcgttccctcttttttgtttgtcatgaacgaaaatcaattctctatttttgaaaaataacaagaaaaacttattaaaaatatttaaagtaagtgggtggattattttatgtcatatacaggaattttgagtctcgaagatatttgtcactacggtaaacggtgtaccgctacagagaaaatcacgaagaaactatcaactggccaaagtaaaaccgttgtgcagtgtaagaaatatataatccagaaagacaaagtctcagaggaaatgatttattacgctggtaaacaaaagcaaataattttaaaagatcctatccctttaaaagaactatatccaacaatcaaacatgtttatgaccaaaacggtgtactgattggtcgaagaaaaaatggagtcttgcgttgtaccgcaaaagggatggggcgtttaatcagctgaattgatcattctcataacttgtattttatcgtttttcgcttgcttgaaaatattgtcgagacttctaaaagaacttagaattactagaaaaataaggagtagacttgatctatcaacaattcctttcggggggtgacggggtaggtttttacgattggtaacgtaaaaaattggtcaatcgagtaaatgcccttgtttggatagtggtgaaatgaatttgtgtaaataatatgcacagagtaaacaagagggaatttagaagttagacaagttagaatagcgcctagattaatcatgagcagctactaagggatctaggctttgacgcaaactcatggaataaggagtaggtcttctcgtaatggggaggacgcacaagaaattgtgtcgtgtgctgcagtacatgtagatacttgcgaggacgttggtcattggatcaatcgagcatttaccgatttctactagggtttctcgtttcggacgccataaacgagtcgatattttttatgtatttttaagtaaacgaaaaacgataaaatatgaacgagtcctgaataaagtgaaaaaattgatataaaacatagagaaaatgaaatttacgtaatggaggaatgacaaatgaaaaattatgatccgaatatacgattgggcacacatactattaaggtttctttccaacgttgggattacaaaggatttgtgacgtttagaagaggcggaaattgtaaaggattagatgttttagcattagacgaggatgatttatactatcaaaaattgactgataatccaattggattcggcttgctacctgaagatgatgaaggtaatgaatggtttaaaatgatgcttatgaatgataatggagacgaattatctgttgaagatacttggtcatatttgagtgattatattgtcagcgttgaaatcattgaatttgtagcggataaagaagaataaaaactggaggaataaattatgaaatttttcgaagtaaaatcaccatactattatgcgttaatcgcagcaaagaatgaagaagaatgtgcagaattgtatgaacaagtagtaacagatatcgaaaatcgtgaagaatttattcgatgtttgcatgagttaaatcgaaatgaagcaattcaagaggatgcgaaaaaaattagtgaagaaacgttacaaccaatcggtatggaggaagctacaaaagacatttttacaattattgatgaacaaaaatcttgtgtattaagcattgattctacattggtttaatagatccaagattctataatttttttcaaagtaaaaagaaattaggtaatgattctcagaccaattacttaggaaaataaccatacaaattagattttacagataaaggattagaaggaatcacggcgattaataaaaaggtagtattaccttaggcattgagtaaggaatttatttaggaggaaaattagatggcgcgaccagttttagatgcgatggatatggatactttgacaaaaggaaggtatgtacagctgttagctcgtggttattcacctaaagatgtattcaaagccctatctaaaggaacagatatggaaaaagaaagattacgaaaagaattcgactattggagagagcataacggaataaaagatttaaaaccagcacgtccagttattagacgaaaaaaattgaagaagtaagaccaaagcgtatggcgtacataggcttttttattttgataaaaataatgaaaggaaggaaaactcatgaattgtaaagaaatcgaaaatagaaaaaaagtgtcgaaagaaatggaagaaaagttactaaaaacaatgaaacaaaaacaccttaaaagattatctgtcgcgcaatatatcaatgatatgcagttaacaggaaaagagaaagcttgtttgttaggttcaatgaaaaactttgaacagttgagacgaacttatgtgaaaaaaagttctaattgtcaactattgttagaagtctcatgacattcattaatagaattcatttttaaaactttttctatggaaatgagaaaaagtttttttgttttgtctgaaaggaggcagatggatgaaaaaatggttatttggttttttaggagtcgctttaatcgtcttttgcagtgtgtttggctatgttagctaccaaaaacatgaaggagatgtgtttaagcaaaatatagaaaaaaagatgcccgtagatcaaatcaatgcacacgcaaagagttataaggaggatgcaacgaacgtcaataatgatatgtctttggggcaaatgttgtccatacaaaaagaagcaatcgaaatgggcgtcaataaacaagtatttgcacaaattcagattcctgcacttggtttagcattgccgatttttaaaggggcaaatcaatacactttgagtcttggagcggctacttatttttatgaggatgccgaaatgggcaaaggaaactatgttctagcaggacacaacatggaaatgacaggtgttttattttcagatattcaaaagttgtcattaggggaggtgatggacttagttagtaacgatggcgtctatcgttacaaggtaacgtgtaaatttatcgtatctgagtactttaaattaattgatggcgttcctgaagagaactctttcttgtctttaccaaagaaaggagagaaacccttattaacgttgtttacttgtgtttatacgtcacaaggaaaagaaagatacgtggtacagggagagctacaataacaaggttgtaatcaacgcgagtcgttgaaatatgaaatgaggagagtaaaaaatggcaataaatcggtatgtaaaaaaagctggaatgcttgttggaatgttaggaatcattgcaggctgctttcagggatatcgagcatatgcagaagatgtcacgcaaaaaacgccaccagagaaggtcaatatcacggttcataaattaatgtacgatcaaggaacgcaattgaatgttgatattgacgggatcaaaaatgatggttatacgcacgatcaatatcctacaggtgtaacgaaatacaacaaggcagattatggtgatgttgagtttacgttaggaaatattacggatcaagtattaccgagggaagattctgatctaaccaatgcgaaagtggacgaaatcgttaaagatgtagaagacaagggatctaacagtgagtacgttaagaatgcaaccaataaaattacttcagctgtagatgaaaatggtgagatcacttttgctgatcaaccagcctatgtcaattccaaagggaatgtatatgtggtttatgaaagtaaatccgctgctggattagtcacacaaaaagcaaaaccaatggttgtgattgcgccaatgactgataatacaggttcaggttttttaaaagacattcacttatatcctaaaaatattgtttctaagttgagttttgaattaacgaaatttggtgacgatggcacagctcaaagcaaacaaacacctttaaaaggggcaaaatttgagttatacaagggcgaacctggaaaaggaacaaaattaggagatcttgtatcggatgatcaaggaaagctgactgctactgatttgacgttaggaaaatactattttgtggaagttccttcagaagttgtagtgggatcagataaagaaccaacagcagatcaatatttattaggcgcagacgctcgcaacgatgcgcacaataaattaacctttgaaattacgaatgatggcgtgacaagtgacttaaaagcttcatacgtaaactataaagcaccagtgatcgataaaacagtaacaaatggaacaggacaagaacattctttccaaattggtgacgcagtaaattatcaaggaacgattcatatcccaacagacattgcaggcggagcagacggtatcacagtaaacggagtgaaaagcgaaacttctccttacagtgtatttaaatggggggatacagcaggacaaggactttcttatgtcgctgctaaagcaaatatcaaagtaacaaataaagatggatctgtggtattaaaagaaaatacagattataaaatccaaaattcagaaaatggctttgtgatcgattttatcgtgaataatggccaagtaagtgatactgtagcaagtttacacggacaagatcttcaaatgacttataacatgtatgtaaatgacagcgcagctgttgccaatccattaacaaatagcgtggatttcgtttataacaacaatccatttaatcaggaagaacaccacgaaaaaacgaaagctgacgttgtgacttatggtgcaaaattcttaaaagtcgatagcggactatttggaacaggaatcaaagcaacaccgcttgaaggcgcagaatttgctgttaaaaacgcagaaggaaaatattatggtggattagttgatacggataaagacggtgtcaaagaagcagtatgggtagacgatgtagcaaatgcagcgatcctaaaatcagataaagaaggtcactttgaaatcactggtttaactgaaggtgaatattcactggaagaaacaaaagcaccaactggttaccaaaaattaacagaagatattgcatttaaagtaaacaaaaactcatttaaagaggaaaatcgaatcactgttaaaaataatcaaaaagcagctattccattaacaggtagtaatggtttccaaacgtatgtattgatctcttgcttgttgctaggagcagggtcactttctgcagttgtttactttaagaagaaagcctagaaggatcagctaatgattattcgtaagcccccaaaaagaagagtcatgcacaaactgatgatatttttttggttgctgtcggcagtagcagtctatttaattccagttgtggaaacaaatgtagctaaatttcaacaaaagcaaagaattttagccattgaaaatcttgaaaaaacagattcttctttggatgttgcgaaaatagagttaggcgatcctgttggtgttcttacaattccaagtatttctttaaaactaccaatttatgacggaacttccgaaaaaattttagagaacggtgtagggattacggaaggaactggcgatattacaggaggaaacggtaaaaatcctttaatcgcagggcacagtggactttataaagataatcttttcgatgatttgccttcagtaaaaaaagggcaaaaattctttattaaggtaaatgaagaacaacatgcctatcaaatttatcgaattgaagaagttaaagcagaagaattacaaaagaattatttagattatctcatgcctgaaaaagaccaagataggattacgttaatgacctgcacgccaaaaggtgtcaactcacaccgctttttagtgtatggtgaacgagtttcattcagtaaagaagatttaaaactacagaaaaaagcaaaaaataggaaatcaatttcattggattggcgattagcactgctattcgctttttttgcgttcctattatttttatttataaaaaaataaggaggagatcggaatgaataagagaaaatggctgtttgtttgtgtagcagctctctttgcaactgcagcttactcacagatatcttttgctgatagcagtaccactccaactaccagtcagacaacagatagttcaacaactgcaacaagcgacacggacagttcgaagaacactgcagaagaaacggcagattcaagtacgagttctactgaatcagcggaatcaacgtcagaaagttcttcagagacttcagaaaaactgcaagaagtagaagatacgcaagtaatcaagcaaaacattcatattcaaaaaattatttcttcgaatcgaatcaacaatcaaggaaggcaagtagctcagcaagaaggtgtcaatggcgcaaagtttattgtctacgatatcacgaatatcttagaagaaatgacacaagatgataatgagaaaaatcaatcggtagaaataattgagtcaaaattgaaagatcgagcaaaaaaactttcatacgaccagttgaaaaaagtgactgaaggagaaaccaaaacaattgatgatcaggaaggtgtgattgatttttcaattgaagtacctgcaaacaaaaaacaagcatactatatcgtcaatgaatcaagccctgaaaacatttcaaatagcgaagatattattttattgacacctatttcagatgaaaagggtgaatttttgacggatgtttggttatatcctaaatcaaagaaatcagagccgaaagaagaaattaaaaaagttgtatcaactggtgtaaagaaaaacttttttgataattgttgggattttttcactcatttattttttaacgattaggatgaaatgatgaaaataataaaaatgttagcttttaatctatcttttttagccgcaacaatattgtgttgcggtttagttttttctcaattatcaatttatccaagatatcaacgattgttcgttcattttctaaatatccagcatgcttccatgccactagaagtgattaacatgctcttaatcaatccaatttttatggctagtttgtttcttcttgcaggattggtaacgtgggtattaggaaaaaaagaatgagaagcttacaatcgtttaacaaaataatagatggagggcattatggaaaataaaattcattgcactacgggaagagtatttactttagtgttgtttttgttccttcttctttttgcaaggggaactgcagtccaggccttagaaaaagttgatccgagtcaaatcagagaaaataataatctggtactttatcatgatagtgattcattgagaaatatcgaagtaactgggatcaatggatttaagatactagatgagtattcaactaaaaaacaaaaagtacttgcttggccaaaagtcaaagatttgaaaagcacgtcaaaaattgttgcccattatcaaaaggtgggcacttatctaggaaaagaaattgattgcgacgtaactttttctaattttgtagcgcacgctggggttaaccaagacggattagctaaaacaattaatgggaaaaagtattataattatttgctctttgataaaaacatttatcgaggctttttcatgcagtcaatcaacgttatgaatgtaaaactagattttaagtattcaggatcaaaaacaaaagtagctttgagtgaaccacagccagaaattaattcaaaaatgagatcgatgagagcagctggtattgagttgaatgatacatttctatctatttacagtttaaatggacagtatcagcaacgtgtgtcttggtataatgacaataatgaatctgtcggtgaacgtaatattgatatgagagaatttgttgggtatgaaaaaatgggtagcttaccttattttgtcacaacagatacagcatgtgcagaatacaaagctcctgcgttatcaacaaacaatttaacttcaaaagtagtgggaggacgtgcagaaaaggcttatagctcgaatgatcatttcaccgatgttgtaggagctgatacttatcacagaagtggtgtaacgtatacgcttcaaggcgcttccccaacattcatgattggcgcaaatacgaatagtatgatgtttagctttgatactgcattgctatggacaccacaaccatcgaagcctacaaaagaagtgtttaacaaagctaatactgaagaggcagcacacaatattgacaaaaaagtgattccacaaggatcagatgtttactatcatattcaccaaaagtttgatgcattaacagtcaacacaatgaacaaatacaaatcatttaaaatcactgatacctttgacagcaaaaattttgatatggtatcggatgggaaaaactatgatggcgcattgtggtatgttgaagcgaatgggacttggaaaaaagctgatacaggaggaaaattaactgtatcaggtaatacagtcacttatactgcttctgacagctttttagataacgctgcaaattacggtagggattatattttgcagctccatatgaaagcaaaaaatgatgcaaaaggaattgcaccaaatgtggctactgtaacgtttaacaatgatccgaacaaaggaacacaaaaaacaaatacagtagaaaactatttctctcttaaaccaaataaaaaagtggaacaagatgggaaagatgttgatggtcgaaatgatggtaaaaaaggaacgcctacagctcctttaaatgcaggatctgaagtacaatatctagtcacacaaaaatggcatacaaaaggtgtagacattgcgtcagatcattacaagcaatttagtattcaagatccagtggaagctcgtttgacgtataaagaaggttctgcgcgagtgatagatatgagtacaggaaaagatattacttcagaaggtacactaacctatgatagcaatttaagaacgctgaaatgggaagcttccgctaatttcttaagtaaaaatcttttagatggacgagaaattcaactgatatttacagctaaaactccactacagtcagaaaaaaatattgataaccaagccgtagcagcagtagagaatgtttctaataaaacgaatgttgtaacaattggtgttgatcctaacttgccacaagtcattgttcctagaacaggttctacacatttagtaacaattttagtggttagcttagtattacttgtgttagctactcttagttatgtggctctgaagttcaattaaacaaaaaaacaaggctgaaaatcagccttgtttttctatttgaaaattggattggcactaataaatacgttgtctgaagaaagtgatccatctgcagaaacttcataagcatgagataacccaacgatgctttgattgttgtaaagtaagtttgcgttatgagcagcgctatctttccacataatcatggcattcactgctcccgtatctgaaaggatctcgtcaacgtaaaggtagaaactattgatattttctcctttagcgccgtagcagcctaaactttctaagagatcttggaaagtaccgccgccaggtcgataatgactgaagcttacttgtaattcttttgcacgtatatcagcagcttgttgaacgatatcattaaattgcattggagctgcaccgttttgttgacgataattatttaaccatacaagttctttttgacgcacatagttgtttaaatcacttaatgagatatttttgtatttgaacgtgatcgttcgattttggtcaacattattgattactcgttggccgtttttatctacgctaatggaaggatcgtcatttctacacaagaaataattttgatcagtcatatttttccaaggagtagagaagctatccccttcgtatactgtttttgattcactagagagaacagcgttggtatcagcatttacatgattaacagtcacattaaatttacgagtgtagttgaaaatataattttgactttcagtcacattgtttaaggttactgaatttgttggttctacccgatcgtctaaaacatgtccttgaatagaaggcgcagttaaagtgacactgtcaccgtgagtgacgttgactatctgttctttcaaaatattaactcgtccttcatttttgtagttgttattgcacaacaaattgatttgatgcacttgattataattgaatgtgattgttgtattacctgtgatcgtttggctttgagtatcattaccaatcactttgtagctaaaattatctttagcgccttcgctatatttaaatgcttttgccttagcggtgtaagtagaaccagaagtcacttgtgcttgatctgtagcaatcacttgacctgtttgattgtcaatatggttaatggtaaccatatatggcgtttcaggtttgtgttgcaaccctttaaatgcagcatctagactatttttagcattatttacttgggcttgagaagccttagaatcgtctagtacttttttagcattggataaagcagtctgaaaattattccaagattcttctgtaaaatctcctttagcagttgattttactcggttgtataaagcttgtaattcagctttattcacagtaggtgctagttttttctttaatcccttgtaagcagaatctaaattatttttagcactatccacttgtttttgagtcgcttttgagtcatttaacactttattagcattatttaaagcagtttgaaatgcgttccaggtattgtcggtatagtcaccttttttcgttcccttaacgctcgtataaagagcttctaaagctgatttattcactttgggtttagaggtgtcagcgccataccaaccgataccttcgtatttccagccatagtctttggttaaccattgtacttctttccaacttgcagtgtagtgatgtgagccagattttacaccaggaaggaaaaggcggtagatcggtttattatttttttcggcagaacgccaggcaggcccttcataagtccagccgtaatttttagtcaaccatttcacttcatcccaactagctgtgtaatggtgatcacgaagacctttattgtataaacgatagacaagatgaccaccgctagtcggtgcttcccaagcggggccttcataattcccccacttaatcttcactaggtgatcacgttcttttgtgctagaggtgtaaaaatgttcatggttatttggattataaaggcgatacatgacgttagttgaagcagcatcagcagatccagcgaaaccaagtgtggcagcaaatgttccaatagctaaaacagtttttgggtttaataatttcatattttcaactcctaaaaattagttaaaatcgattacaaaatcattatatatcggtaaaccgatatggtcaataaaaaaattaagaaaagcctcatgtatttctggcttttcttaatttgttacttagttgaagcgttagtatcaatggtttcttcagctaatttatttaattttatagcattgatgaatctcatattgtctatactagagcgcttatttgcgagatcactgaccgtagttaaaggtacgccagattctatagatatagaacgaactgatttaccactatcaaacagcaaccattcgattttctttttatcagcgtacattgcaatgctccctcttgattttttctttattatagctcttttttgtaataaatcacaatatcaagagagaaagtttttatagaaaggtgggaaattatgagtatccgttccccgtgtatcaaaatgaggtttgttgctactttcgttatttgatatactaaaataaaacaacgaaagaaggaataaaatgaagaaaaagcaactatggtttgtctctatgtttgcaatattttttattattttaagtggatgttcaagtaataagaaatcggaagctaaagaagataatagtttattgcaaccaggaactgtttggaaagaagaagtaggtggtcttgttaataatttgaaaattatagacgatactacatgggaatattctgaaagtgtatggcatccagatcctgtacaaatatcagttaagagacaaaaagactataaaggtttagaaagatacaaaatagtagattctgcaggtattagcgactttatcaataaaccagattctttatttatcgttgttccttacgagaaagatggcgtaaaaaaaatggtttttcttggatctagtaaggatgaaaaacgaacgaaagagaaattaattcatgatggatcacaatcaaataaatacaaattacaaaagactagcgagtgattgctagtctttttatttgtcctgaaggaggaatcacagtggcaaaagctaaaacgccatttgaaaaagctgcgtctaaaatcttagaacgtcgtggtgtttctgaaacacagtggaaacaagaagtccttgaaaaagcacaatttgacctattacggggaaaagacaaggacttagaaggatatatctatcaacgtgaacgtgaaaagcttgttttcgatgaaattattaaatactaaaaggagcgaacaattttatgtttgaatcaattacaatgaattttttaacacaaccgaaagtagtagctgcggttgatatttttagagcattacaaactgcagcaactagtttaaaaaacaatttgatgatttttgctggtgttgcggccgttgcttccattgttattggggggcttttcttcctatttggacgaagaggagctgaaaacgggaagatgcacgtaggttatgtattgatgggggtaggtgttattctaggggctgcttctatcataacttcgttatttggattatttgggcaaacacctcaaggattataagaaagtaaaaaagtaggagtaagaagtagtcgatactttttactccttttttatgaaaggagaatattcatgtactttacgattgcaggcaataccaaaacagataaagagttaataaaaaaagcaacgaaggaagtaggaaagcgtacttcttttttaccgaaaacaattaaatattctgtcattgaaacggaagaaccgctacatgtgttagggaaagtactggaacacgaaagtcgatcttctgttaagttgactctcacgttacatgacacagaaggaaaaatagagaaagctggtacagaatacgtttttggcccgctggattatcaaatttcagaaggtttctatcctacattgatggatttaatccgccttgatgtgtttaaagaaacggatgaaactatgagtgtggaagaatcttatcgaaacgaaaaacttttacaagttttagaagaagagttagagagcgaccaaagaaaagtgaatcaagtgagtgaagtcgaagtaaatgaagaagtaccatgggaacgaccaatctttccaaagaaggagtcaaaagaaaaagagacagtctatgttgacgaacaagctgatattccgactcagaaatcgatatttgaggaagagaacgatgtgatgggtcaattggaggtagatccctttgaagaaacaatggaggatgaagagacggccgaagtagaagttgatccagttgaagctaatgaagagtcaatatggactgaaggggattctcaggaatatattgaaccacttatcagtgaagaagtagagaaaaacgaaacagagatacaaaaggcaactgtatttgattatattttggatcaatatccgccagagcatgaatggatgaaagaaaaaaacaaattatttttaaatgagctttattcgaaatatcaattaccccaaacctatcaagcatttttagagagtaaagaagaattaatctcacagggtaaaggcacacttttagaacagttagagtctgtccaatcaacaaattggcatgagcttgcacaagaagatttattagccacctttgaagaacgtcaacaagaaacagatcaagaaattaatgagtatgcgacggaacagtcgtctaattgggagaaagcaaaagaggaactaaataaagaagaacagcgagtgattgaagaagaagtacaaaaaattaaagagcgatacgaaaagaaacgcgacaatgcgtattccttgtgtgtagaaaagatcaataattttacccagacgaatcaagaagcgttatcgaaagaaaaagaaaacttgttaaaagaacgtataagagaacgaaaagaagaattttatcaaggtttgcgtacagataagctaaagattagcaaggaattaaatgagcaactgaataagctatatcaaacaacgactgaagttcttatggaaaaacacgagcagatccagcaagaattacaagtacaaattccaaaatggaaaaaagagtatgaaattcaacaacgagaattgaaagaacaagaagaaaaacaacggcaaaaagaaaaagagcgcgaacaattagaattaaaaaaacgtgaacaggatcttgcggaaaaaaaaatggcgatagaaaaacaacggttagagcaagaaaaggaaaaagaagcagctgctcgtaaggaacgtcaagaacaaatggatacattgcgacaagcacagttaaattatctagcacaacctcaaccagtagctgctgttcaaacgccagtgaacaaccaagcaaatttaactccttcaccacagcgttcctttaacggatggatggtgggatgtattgcaagtttaagcttgcttctaggtggaggaacagtatttgcttttaatcatatcaatcaatcttcacaggctgattctgtggccacaacgacgtcaatcaaggaagaagcccaagaacaagcaagaaaagagtatgaacaacaattagaagaattattgaatcgtaccaatcagtcaacaacagagtcaagtatggaaaatagcaaagagagtgatcctagtaaggctaaagaaggatcaagcgattcaactgtacaatcaaacacttccgaaagttcagaatcaaatgaggtgaaataatgcgtgttagagaaacaacgagacgaaaagacaaacgattcaatttagaaaagaataggtatctttctcatttctatcgctatactccttcaggagaagagctaccagaaaaacatgacaaacgtatttctcaaaagattttttatagtggcttagcttatcttcctttaaactatgttgttacaagaataccagaagcatttcatcgatttgagattattccaggaagtttacaaggagtgaatatttttcagttacaagaaatgccgcagttattccattttgattcaactggtttttggaatcctttgaccccaacaacaagtttaggcacacgtttagttgtttctacgatttgtgttgttccagctgtacttatgggattgaaaatggacatgtggtttcgtcctctagcagatgggcaaaaaggagataaccgattaaaaacgttaaaggaaatccaacaaatttatccgcaaataccagaatcaaagggaggttttcctggttatggcggaataccaattactcattataaaaagtactggtatattcagacggatacagtaaatacttgtattgttggtacttcccgttcagggaaaggacagatagaagttttagcaaccattgacaatttgtctcgtgcagaaagacaaagttcaatggttgttaatgatccaaaaacagaattatatgttgctagtaaagatgaactagaagctagagggtatgatgtgtatgcatttaatatcaccgatccactgcaatcaatgagtgataatccattggcactcatcgtgaaatactggaagcgaggagacatagacacagcgacacagttaaccaatactttcacgaatacgatttattatgatgccaacgcttcagacaataaatactttaacgaaaatgcgcaaaaagctgtcaatgcgcttatttttgcgttattggaacaagcggatcagacaggggattactccaaattaacaccgaataatctcgtcgaacttctttctgagattggtggttttaattaccaagatcctgataatgaattcaagcagctcaatgctttagatgaatttatgaatcagttaccacctggaaacatagcaaaaaaacaatatggggcaacaaaaattggttctgataaagcaaaaggcaacattctatcgacagcgatcacaggactaaatccatttacactgacgaaaattgcgaaaatgacttctcaatcaaccattgattataagtccattggttttccgaagtatttggatctcaaactacacgagagtctgttaaaccagcgaattgttgtagagttttatcatcaaggaaaaaaatttcatgaggaacgtgtcaaagtaggctatagaggtttttgtgaaattaactttgattgtcatttagaacagggagatcatgtttgcttaaaatatgatcatcgaggaaaagaatatgttgcttggtatgagttttctcaaagagtattgaaagacgaagagggaaatatcgtttatcgaaaaaaacgaggagaaacccatttgccagaattagaaaaagaagccgttctaacattagatgaggataaaagtaacttattagtagagtctattcggatgcactataccgataaaccaatggctatttttatgctcacacctgattatgatccatctaaccatatcattgttagtatttttcttagtcagttgtataaagaattatctacgcaatgtgttaagactaaaggagataaatgtcaccgtaggattcattttattttagatgaatttgggaatatgccaccaatggataatatggaaggaatcatgacagtcacagctggtagaaacatgttgtgggatctgtttattcaatcttatcagcaactttatgcgaagtatggggaacaaaacgcagcgattatcaaagaaaattgtcagacacatatttatattatgtcgacagacgataataccatcgaagaattttccaaaaaagtggggaataagacggttgaacaagaaaacagtaccatcaattcattaggtatgaatactcatatcaatcgcaatgttgattcagatcgtatcttaactcctgaaagaatttctacttttttagaaggtgaaacgattgtactcgctcctttaaaacgacaagatttgaaagggcataaaatacggccgtatcctatttttaatcatggggaaacgaatcttccttatgcttatcaatacattgaagatttcaatccatcgtgggatatcaatgatatagacatacattgtacacatgcagaccttgatttgaagtctttacaaattgattatgattatttcctaccagatgaatatgctagaaatctctatcatggactgcatgatcaattagaagaaaaaaacgaagaaaatatgttttataaaatcgttcaatctcttgaaaatgagacagcccaaaaattattaattcaattttacgaagaacaagcaacggatcgtcttcaagaatatgttgaaaagttgatcaaaaatgaagaaatttctgaaatgattgggaaacggttgttattggaagctgaaaaggcggtgaaagaatgatcattggaggaattttttctggcatagccgactggtggtcaggtttattcggagaaggggatgcaaaccccaaaaccgtaacgaaagtcttacaagattatggtaattatttgcagtatcaagatgtgttcagttggatttgtaatacttttttatggggattgatcaaagggttatataatctcaatactttattagaaaaaacaatttatcaaagctttgatttaaaagacttattgaacgccgctggtgttaatgaactgtttcaaagtttgattagtaaggtattggctcttttttgtgtcgtcacattaatttatttaggcttgaaattttttatgagtaaacacccaccaaaagtcaaaaatatcttggttaatctatttatggccatgattttgatttttggtggtagttctttaatcgatgaagggttaaatatcagtaaaaacttttacggagacgtcactgcagcaaataaagcagataaaactggttcacctgcttttcaaattattcaaaataatgtgatcgatgtaagtacattactagcgactgacccgaataatgtagaatccttaccaacagataaaagaaatgctttaacagcgaaaaattttaaaactgctaatattaattcagtgattattcctaaggaagccgctaagatggcggggaatgataaaagtggattatcagatatagaaaaagatcgactaaaggcattacaataccgattggaactggatgataatgggaaagaaatccctgtggagattagtgatgaaggattagccaaatatgtatatacttcaggctatcgtcgatacattagtagtccaggtattattttagctggtgaatcttctttggcggtggcctatttatttatcctatttacgatcgttacttgcattattgagctggtatttaaaaaattctatttagtgattgccgcgtcaacggactttgagacaggacaacggatgaaaagtgctatagaagatatttctcagtctttcttgttattggcgtttacgattttagaattacgaatctatacattaatgctgtctggtatcggtgatttgcacgcagcaggcaagatcaacggatttttgtatgttgtcgctttaattgtactaaccattgcgttattcaaaggctctcaatctgttacgaagattttcggtgttgatacaagtctgaaaaacggcagcaattctcttcttagcatgtttgccttaggaaatattgcgaaaaatgtgggtagcggagctaaaaaccttgcaagtgctggtaagagtggtttaagcaatttaaatgatattcgtaaaaatggatttggcaatcgaaaagatgttacccctgataacggggaagaacaatcagacgataaagctacaactgtacctaatagtaagaaaacagtttccgaaatgttcgggaaagcgaaaaatggtgtttctaaagccgcagaaggtcttggttacgtcaatgaacgtgggttaaaaggaacagcggaagatcttacagaaaaagccaaagacaccttagaagagaaattagacggcacaagagctaaagaattggctgaagctgtgaagaatccatccgaagcactagaaaaacaaaaagaaaaagcttcagaagtcaaagaaggactaaaagatgcgtatggtgaaggacaagtcaatgcagcagtaaaagctaatacaacaaccgaaaaagaaaatcaagaaggtgcagcgattccttcagccaaagattaccaagatgagttggattctaacgaaaattcagaagaaggacaaaatggtcaattaccaaaaacagatccagaacaatatcgttataaatctaacattaattctgaaaatgaaaagcgcatttcagatttaccaaaacgaaatcaagaagtacaaacggatgaggattccatcgatttgccaaatgataatggaatcgaagttggaactgaaaaatcaacgaaaattggtttgcctaagacacaaaatttaccaatgaaagatagtcgtttgaatcaattcaaggagaatgatcaaagctttgttcaccaatcaactgcaggtactgttcaaatgaaaccaagtcgtttgcctgaaaatggaaatctgacaactgtttcttacaatttatctgaaagtggtgagacagggaatgcgtccgttcaaaatgttgtgacaagagaagctgcaccagaacctattcaaaaagttcacacaggttacaaaccagcaaatgtggcatttacttcaccaacaaaaataaatgtaacaagagaaactaaaaacaggaacaatgagttgaaagaacaactattgagggatatcaaacaggatatcaaaccataaaaggcctacaagttaggctttttttctatgtatgaaaaggagaaatcatttatggataaatacattaacatgaaaaatcccccaaggtttagtggggaatggaagtttttcgcctttttctttttagatctattaacgcttggtggttgctttttttgggcgaaaatagtcaataatcttgtccacttaccactcttttttgcactcttgaattatggcttatggattgcgatagctctagtgattgtttggcgaccctataataacccagggcaacgacaaatttttgcgattatcgagtctattttttttacggacaagaaccattatcatgcgttagatcctaaccgaaattatcatggtacgtataaggaggatgaataaatgcgagtcaaaggacaaaattcagttgataagaaatccatttttcagtttggaaaaccagaagaacgatctatcttggatttatttccttataaatcctgtacagaagagggagtcttagttactaaagaagatcattttcaacgttattatcgtgtagtttctacagacgtggaaggattaaatgaacaagagaaactagaacgaatgaatcagttgaccaccgtcatgcgtacgtatgtgccaacaattaagttagttagtttgaccacagagacggatctaacggaacaaatcgtacaaaagcggcagttattagataagaatcgtatggaacaatccttaggaagaaatctacagcgattaagaaaatatgaaaagaaattagtagaggaaatccaggaattgaaacgagcagaacaagaacgtcctgacttaagcttctttttcatcattgaaggaaagacaatcaaggatttacaaaccagaaaccgtcagttaatgcgatctagtggcattttagggttaaaaccactctacaaaaaagaattgatcaagattctttatcgaatgaacaatatgaatgatgagtaggaatggagaagagagaatgaaatatccgttgatatggttagaaaaagatattccgaaggaagagatcactagaaaatttcctcacactttaagcatgggtaagttgggaaaagggcaatcttttaaccaagtaaagaatcaaacaagaagaggtgactgtacatgttagaagcgattaaaacagctttttcaccacaaaatgatcaaaaagtacttgatccattaaagcaactaggaaatcgggaaatagaaattttaaaatccaaagggtatgatttagattttttaaaacaagtgatgccacaaggtggattaaatttcgatgaagagtatgtgacctatggaaatggttattcacggtgtgtgacagtttatcactacacaaaaaatcctactcttttttggttggccaatctcatgaacaatcctcatacagtggccacactagatgttagcacagatgaaaagcaaaaagtgattgatcaaatcaatcgcgcattagatgaattaaatgatcgatcagataatgaacgaaaagcgactgaccgaaataaaagtgcggaagaatacctggaactagcagaatatgcccgaaaattgacttctaatggggaaatttctaaacaagtcaaagtgagagtacatgtttacggaaacacgattcaagaagtagatgaacgggcgcaggaactgatcgaaaatctaaaagggatagattatcgtgcggtgacttatctgcataaaaccaaacgagattggcaatcgatgtttaccttgttcgatgaacaagctgaatggttcggaaatatcaaagggcaatcactaccatcgttaaacattggcggaggtttcccgttccaccaccaaacgctaaaagatccaggaggtacacaatatggggaaaccatgacaggcggcccatttgtctggaatgcgacgtataaaaatagtgtacggttgtctactaataccttgcttctaggaatgatgggagctggtaaatcgaccgttcttaaaatgatcgcggaagcccatttagctgcaggagactttatttggggctttgaaaagggaaaagactttattcctttcttaaaggaatataacggtattatggtgcgtttagacggatctgacgggatgatcaatcctttagagatatttgccacacggacgtatgatgaagcatccagtttatatgacgatggatcagtcaaagatttgaagatcaatgaagcagcgtcctatcaaacacacttagacaaagtggtctatcaggtacagttagtgagtcctcagctaaaaggaacgatgaaagcagaatttaagacctacttaaatcgtttttatgaagagtatggaacagtaccacgcggctttacttcctcaaattcgcgttcaaatactgagacgcaagtcacagggaaagatccagaagcttatccgacgttcaaagaatttttagactttttaggacaactggaattaccaggtgcttcccaagagaaaaagaatcgaaaagaagaaatggaatccatcgtagaatccttatgtgagacgtatggcatgatttttgatggtcacagtacgattcgacaccttgaccaacaacagttggtcttttttgacattgactctattacaggcttagatcgaggggtacaacaatgtcaaatgtacatggctatgacgttgatttggaatcaggcattgattcaaggaagaagacaacgacgtttaattaaagaaaaacaaatggaagaacaagacttcaaacgcttcttggcgatgattgatgagtgccataatgcgattaatccagattttattgaaacggtaaattatgtcacaaactttcaacgagaaatgcgtaaagtagaagcaatgactgttttagcgacacaatccccacaagaaatggtgccagaaaatatgtcttctgataacttctcgaaactgaagaaagtctttgaattttcttctacgaagatctttatgcgtatggatgaatctattttacgtcatatagaaggattagttggtaaatcaatgacgaactcagaactagaatccattcctcaacaaaatcaaggagacgctgtgatcaattttggctcaaaagaaaccattcgtgttcattttagtccgaacaaacgtcaattaaaattgtttgatggaggaaaataatggaaaaccaaaatgaaagtttaatcaagcagtatgttaagcgtcgtgcaaagcgacgcttatttttgtggttgtttggtacttctgcaggtttgattactattttgatcactgtgttcgtgaccctttttctaatactggcggcgggttcgattgataattctgattcagattcaagcagtggtggcgaagcttttacaggagaatattcggaaggattacccatttataaagaaatcaaaggaagaggccctttttctgatgagattgcgcaatatgctgtaggtgcagcagtgaaatataaattattaccaagtgtgatcctttcgcaatacggttacgaatcagcgtttggtacgtcggcgtccgcaagaaatgatctcaactattttgggattacgtggttcgatggctgtttgtttcctaaaggaactgcacgaggaattggtggtattgaaggtggctggtacatgaagtttcccaactcaaaagctgcattctcctattacggctttatggtagccacacaatccaattttaatgcatgtgtaggaaataaaagccctggcgcaagcttattgatcttaggacgaggtggttatgccgctgcaggaattactgaagatagtccgtattatacaggttgtatgtcaattatcacttctaataaattaaccgaatatgatgaattcgcgatgaaacattggggtgaaggtggtaatgataatggcacaattactggtgaatggacgaatccattccctggcagcagtttagataaaagttccttcagcggtggtcaattatttggaacaaatccaggcggtgaattccgtccgaatggcttccatgatggtttagactttggttcagttgatcatccaggaagtgagattcatgcggttcatggcggaaaagtcgtgtacgttggaaatcctggtatttcaggtttaggcgcatgtgtgatcgtgattaattacgatggcttgaatatggtgtatcaagaatttgcaaatagtacaggaaattctcgtgtaaaagtgggcgatcaagtgaaagttggacaagtaatcgggatacgagatacagcacacttgcatttaggcttcactcgaatggattggcgtcaagcacaaggacacgcattcacagatgatggtgcatggatcgatccattaccatttttgaatagcagcaaaaaatagatcaggagaaaaaatatggaaaataaaactttaaaaattgttttaacagttgcaattagcgttagtttaatcggcaatatcgcgttgttttggcagctgaaagaagaacaagagacaaatacctttaaaattgaagaagtggctaaaaacgcgtctgagaagctcaaaaaaaattcctctgaggcacaggcgaagatcgacaagttaaatcaaaccatcaatgagaaaaaccaagaaatcgatcagctgaagcaacaagatggcacaaaagcaaaagaggaagtaactgaagcacaaagaaagacggcagaagagttcggtcaattggccattgataaatcattaagcagaaatgaattaacggaaaaactaaaagatgtcgcaacccaagaagtgatcgacaaattaagtcctgcagacgataatcaccaacatgatgattacggaagttactcttttacattaggtgacgtgcaaacttacgctcaaacaagcagtgtaaaagaggaacaaaattttgttgtatttgttgattatacaatcggcaatcctcaattcaaagatgtcaaaccgcaaaaaataaaaggtggattaactgtcactgaaaaacaagtagatggtcaatggaaagtcacagactttagttatttcactcgttaggaggaagaaaatgagtaagaaaaaaggagcaagagaacgtttcaaaaaacgaaaaagttatcttagatggctgggaatctttatgattctcggctttttaattcttgctagtccgatttatacgcataagaaggtagacataccagatgaggtaagcacgaacgcatttttaaacacgaaggaactgacgatggtttcaaaagaaaaaggagcgaaccagcaattagtttttgaatttgcgatcgacgatgaagatcaaagcttattaaaagaactggctaatcttaattatcgcgtagaagtaaagacagctaaaggggattatcaagcaataaaagccaaagtgattaaggtgtctgatgattattttgcagtgaagctatcgcatgtaccagaagaatatattgctatgcgattaaccattattcctgaaaaaattgatacaaaggtggacatgcaagaaccgcaagatctgattttttacattcacgaagataaggtcaaagatcacgtgaaagacgaagattatgaacaacatgcgatcaattacaaagtgaaaggatacaagaaagaacaaaaagcagcacaaaaacagattgaatccttgcaagcaaccattgatttgaatgaagaattagtgaataaactaaaagaccaattgccttatcaagtcgcagatgatcaggaaaatactgaaaataagattaatggttaccagcaagaaattgaaacatcaaaagcgcaaatgaaagatcaagaagagatcattcaaaaacttcaagaaaaaattgatcgtattagacaagaaaatatttagaagaacaggtggagtgtaagaaatgaagcgagcgaatttggtcggcaaagatactttcgctgagcagaaagtattgattaaagcctatcttaaagttgtaaaagccaaagaaataagtcaagaagtgaagctatctaacacgacaatatctgagttgaagaatggtagaaagaatttagataccttaaaattcagatcatttgaagctttgtatttagctgctaaaaaatactttacagctgatagcaaataaaaacacaggaggattatatgtgaaaaaagtatatcaaaaatgtttatggatcagctatatcaccttaggtatagctgcttttttatttagtttagctgttatcgtcggtacaatttttctttggtttaccaatgaagatttatcatttaattggttcatgagtctactatcgtttattatgttgatctttttatgtttagaaatacgcgaattcatgccttctcattggcaagataagaggaaagagtttagggaagaaatcgaaatgaaatcggacgactggattgaacacacctggtttcctctgaaaagaaacagcaaacgaaaggaattttgggtgctgcaattatggccaataggaaaactttttagttacatggcttcacttatggttactttaatcggttatttggtggtggtctatggggtggcctattacttgttaagtgagccaaaacagattgcggcgtcaattatattcacggtagtaataacattaatgtgtgtcatgtgcttttctatttttagttacttactcgttcaatttgtcaggaaaaatttaacaatgagtaatcttttcaaaagtttattggacttacttatcttaggcagtatgttaacgactctagcagattggtccgagcaatctggaagaacggtagaggggataaagaacttcttaacgacgatcgatcaatttataaatcgatatatgtatttgtttgaagtaggatttattctcgctttgtttggttatgtattcatgaaacttattaaaagatcaatcgaaaaagaaatggttattgatctaattccgaagctgagtggctatgagtattacgttgattttggaaagtatgaggagctgatccatacggatgttgttcatacgagtattcaagaagcgaccgttaagggcatcagatctattttaaaagatggccaggaaatgaaagcaatagaccgaagaaaagaggtctacaatttttatgaagtcgaagcaagcctacgatatggcattgagaaattatggttagatgggagtaaaaattcaacaaaataaaccatatgttttcaggaaaagtggtgatttatagctggcatggagttaaaaatcttaaagaaggagcagttattcaaagtgaaagaacgtcataatcagttactatgtagtaaaacgggtacgatgaacattgaataccgaacagaatatttagaattaacgaatcaaactgattttttgttgattcgaaagcaacaagagcaagaaaaattaatggctacttatagccaattgattgatgaatgggaacaattcaaggaatctaaaattccagaacgtctctaaaagcctttatttgtaaagagcataaggaaacgtgatatcactttcttacgaaaggtgctaggtaggctgtgcctaccacgtttctaaggaaaaaatctgatatcaaaattaactaatttaggatagtaaaaggatagctaaggatagtaaaaggagggtagtaggatagtaaaaaggataggctcctttttactatcctaatgaatgatggatttaattttaagaaacatcgattcaaaatatgtaacagaaattgatcaaaggtgcaaagaattaagcaatcgtacaggaaataaatggagtcgtaatgattatttaaagctactcgttgaaaatgattttgatcgtcctctgatggaatacaaacaagaaaaatttgaccagttattagaaaagttttcagaaattcaaagttataacacaaagatatgagaagaatatgttagccaaaataatcgtattatagaaatcttgatcgagcaaaatagaggaagtgaactttgatatggcaaaggttatagacaaacacatttactttcaccaaacacatatcgatgtattggatgaaattatttctactcatgcagaggttaaaaactatagtgaagctgttcgctttttatgtatgaactatgatccagaagtggagaaaaaagtaaattccaatcaagcaaagttgaatggaatgagtaaagaaatttctattttaaccgaaatggtttcagagtttgcggatcttcatttgaaagatacaggaatactaattggtaaaaattcaactgtttatcaagaagcaaaagaacgagtggaagggaaaattaaatccaatcaaaccaaaaaatattcccctcagttgaagaaacctgtgaatggatctgttcatgccagagtagatccatttgatccaacgaagattctaaaaagataaaaatgaaggaggacaataatgactcaatcgccttcagtcattctcacttgtcaatttactttgccgaataaaaagtcattttctacttatattgactatattacaagggaacaggctcttgaagaaaaggaacgacgtacgcccgaagaagaacaggaacttcaacgaatcaagaatgctttagaggagttttatattcctgaaggagaaactttttcggagagtaagacaggtaaagaattcagcgaaacgacgaatgaagctcaatcgttgatggaacatggaatcaattttgacaagttagaggaacaagattttaccaaatatctttcttatatgacacgtcactatgcgttagaacaaaagaaagaacttaagcaaagtgaacaaaaagaataccaacgcttgaaccaagcaatgaaaaaatatcaaacagaaccccacaaaaaagcttcaggaaatcttcctggagttttttctataacttcagacgaagtaaaaggaagtgatctgaaggagatcaagcaaatcttccaaagaggacaacaaaaaggctcaatcatttatcaagatgttgtttctcatgataattcgtatcttgaaaaaataggattgtacgatcccaaaacagatactttagatgaagaagggttaaaagcagctggaagaaaaatgatggagacattattcgagaaagaacaactgaacgaaacaggctactggatggcaacgattcaccgtaacactaaacatatccatattcattttgcagttgttgaaaaagaaaatacgcgtaaaccttacactgaggttgaaaatggtgtgagttatatcgtaccgaaaggaaagagaaggcaagcaacattagacgcaatgaaaaccaattatgtgcatgagttagaacgtttctcttatgaaaaggatcgaatgattggtatggagaaacgaaatttattgacacgaaaaagtgatttgcgtaacagcttaacaaaagtggtaaaagagccagtacgttatgatcgacacgcaatgaacttattaaatgaagtatatagaaacttacctgacaaacgttcggaatggcattatggggatgaaaatcgaaccaaactttcaccatacacaagagagaaactcgacgagttaacccaatatgtgttaacaaaagaacctgaataccaagaatatatacagatttcaaaagcattgaaggaagaagcaaaaagtctttatggggaaagcaagagagaatcaaaggatgcagagaaaaatgccctctttgatttaaaaaagcgcacaggaaatgccatcctaacagagctgaagagacaggatagtcaaataaaaccattaatagaaagtatggatcagatgcaatctatttacaatgaacgatcctttcgaacgcttaaacaattgccaacgaatgaatacaaatatagttacgaagaattcatgaagcgtaggaaacaattccaacaaagagttgtcacgcagcggagtttgcgtcaattaaatcgaacgattaatgcccatgaagaaaaataccacgcaagtaaagcatacgaagagcaacaacgaagaattcaaatggaacaagaaagacagtaggaggaagagaaatgaaacgatatttgaatcaatggaaagtcatagaaggatcactaaaaaaagaacgaatcgaccaacttcccgattgtttaaaaaaagagcatttgtttcagataagagaaatgttgagaagcgaacagtttgatccaaatcaatttttagtcgttgagtacccagctactggtgtgtattgttgtaatcatgagaacggtgaaaaatattttatcattcaagaatatgagggcaagttagcgccttattatactacctgggaaatgaatgaagagggaatcaataactttccgtgtaaaagcattgaagagtctatttcactcacagagtgttagttgttaagtgaataacagaagtaaaagagtcctgaacgtgattgtccaggactccttttttcaatgaattgttttccgccaattcattgagtggtgcgatttccgactacattatatcaaaagatagagaagggaggaagaagaaatggcttattcaactattggagttgttgttgaaaaaagtagagacaatctcgtttttgtgacagaaattcaaacgggcaaagcttttgtcgtcacagacaaagcggcaaaagcttatcaaagtggcgatattttaacgttaaatctgactacgaagacgttcgtcgatgtggcagaagattatccatttgtttaggaggaaacggacatggcagaagaaaaagaaccactagacaatagtcgcttgggaaaatccaaaagaaaattagtacggttgcaaaatgaattaaacgaacaaatcgaaaagatgtttgaacaccagagaaagacaaacggtcaaccaatgaacgataaaagaaatggccattcttggtttaggcaacaagaacgtttagaaaataaagtgcatagtctgagagaagagatcaagcaacaagaaaaacaggtagaaaaacttgaaagacaagaagaactaaaggaaatgggctataacaagtacggcggactggatatgacgatcgagaatattccaataatcaaagaagaaatcgaacgctttgaaaaaggtgaatcgactttttcagccgccacgatccgaaaataccaacggaagttggaaacattagaacagctgaaagaaagatcagaaaaaggaaaagaaaatattcttcctgaagtacaagcaatcattgacagcggacgagtgacgcaatggaaaaaaaatccgaccatttattttcttaaaggctatcgaaaagtcgctttagaactgaatgaaaacgggggatttgaggaatctaaaaaataccaagccacgtcggaagaggaaaaagcagctgttcgtgaattacttgaagaggctgcgccaactgattctttgaaggagaaagaaaacgatcatttttatcgagtaaaattcaacgaaaatgatccagaaaaaggattgaaaagttatggtggggagatcgtaacattagaattgatcgatcaactcaaaacattggataaccaatacgctgcagaagcaggttattataaattctattttgaagaagtgaagaacggagaagtagtcgatcagatccgaatggatctaggggatggcgtcaacagtaatcaacccatctatttagagttagcaaaattgtgcgaacaagtacctgagaaggaacaaaaacaatcggtcaaaaatgaacctgtttcgaaagaagaaatgcagtcgaaagaaacaaaaacaaaacaaaagggctatcaaaaacgaacggcagaagagattaaacaagaagttaaatccctttcgcaacaggcactggatgcggtgaaaaagcgtacccattctcctgaagacgtcaaagaacttttgaactttatgtctcgttttccagaacgatcctttagaaatcaattattgattgaggaacaatttccaggtgcaacagcttgtttaggtcgtgccgcgttgaaaaaagaaggaatctatatcaaaaaaggggaacaagggaacaagatctttgtcagaaaaacggtcaaaggattttatgagaaaggacgtggctttgttcgagaaacagaagctacaccagaagataaaaaacgaatcgaaagtggtcaaatcgaagtgatcaaaaaaccttactacacgattgaaaaagtgtttgatatcacacaaacacaattgaagcctgaagactatccgaaaatcttcccgaaccgcgtctttgattttcaattggataaaacagggcagacagaacttcaagttgggattcaagcggtagccaaaaatattggaattcaaattcgagatatgacagaaagtgaagtctatcaaagagaattaggacaagcacgtggggcgtacgttcgtaacgaatttactggcgaagaagaaatcgtcatgaatactcgaaatactcctacgcagcatttagccacaagtattcatgaattagcccatgctagaatgcacaaattttcagaattagataccgcaactaaagaactacaggcagaaatgacctcctatattgtgtgcaagcattttgggatggacacctcggagaaagctattccttatattgcgacatggacgaagaatggtcagacgttggatgataaggaagctgcggaacgtgggaaaatcatgaatgatgtcagtcgtgtcgcaaatgaattcattcaaaccatttctaatgaaatcaatcaatacagagaaagagaaccagagatccagccagcagaagtgaagcaggagcataaaaatactttagaaacgccagagaataagaatattgtgcccgttggttcactttggatcgacaagaaagacgggaaagtaatggaagaagatacgggtcgaacgttacatttgaaggatgcgtcgtttattgaagatccgcagcataatcaagtgattttaaaaggaaaaagttatggaaaagagatccaaacggcgttaccttcagaagaatttgcgctaggaaatccattccgattttcacttgaaacagtgtcagaagtggccaaacgaaaaaatgaaatctattatgaacaacaattgtcacaaaaagaacgtgtataaaacaagtaaaaaagactatctgaaaaacggatagtcttttttcttttgggaggtttgaaaatgaccgagaaaaaaatgagtcttattgatcgatgtaaacagatcgatatagtggattttgctcgaaacaatggaatggctgtagtcaataaaggacgagactatcgcttagaagaccatgattcatttgtttttgatcgaagaaaacaacgtttttattggaacagtcaaaatattagtggcgacattattgaattagctaaacttttttttatagacaaagcgatccaagatcctaagcaacaatttaaagcagccactgattttattctaaagaatgaagacaaaacagaacgagtagaaaatcttcattttgagacagaaaagtacaaagatcgccccgttgattatcaaccacttacagaaaaaggaaggaattatctgaaggaagaacgaaaattgccagagtggctgattgattatgcagaaaaagaaggattgattactgaactaaagccaaaacatgaacggcaaaatttcttagttcgagacgatcgtttagatcatgcggttgcctttttatggaaagatccacagacaaaagagacagtaggggcgagttatcaaggaacattcattgattatgaacgttttggtgagagaggcacatataagcatatagataaaaattcgacagcgaatcatggctttaacctaaagatcggtgaccctaaacagttaaaattttttgagagtagtattgatttacttagctacgctgcactgaatcgtgatcagttaaacgatacgtggttagtctctatggaagggttaaaacaccatgtgattagtcattattttggtgaggcagtatctgaattgagaaagaaacaagcctttcctcaatccatcgagatttgtgtggataatgaccgtgcaggacatattttctacgaaaaagaacaattaatgggcgcagtcgatccatttacgaatcagaaagtacattgtgaacgaggaatcgctaatgattggcaagtgccaaaagaatacaaaatcatttatgaagaagtcgcaaaagaagaaaaggtcacaccagaagctattatggccatacacaagacagaaaacaatctgcaattaacgaaccaactggtttccgctcacaaagtaaatgcgtcttttggccagcggctttctgttaacgattcaatagaagctattaatttgaaagatatttgtagagaagtcgcaaaagaattaaaagcttgtgaacgcgtggatggtacgtacgattttgatcgtttttatcaagaaaaaggggatattaatgctcagattcttttctcttataaagcagaacaatactacaaaggctataaaaatcatgaacatgaatttgtacctgaagtaaaaaaggactggaacgatcaattgaagcatgagatccagcaacaagaaatcagaaagcaaaaacgtgccatgttgtttcaacaaggcagacaacaagaaagggagtgaaaccgtcatgatgaaaaccgttattttagcagaaaaaccgtcacaagcgaaggcttatgccgatagcttttctaaagctactcgaaaagatgggtattttgagatccaagatcgattgtttacaggagaaactgtgatcacgtatggttttggtcatttggtcgagttagattcgcccgatatgtacgatgaaaaatggaaacaatgggcattagaacatttgcctattttcccaaatcaataccactatcatgttcctaaagataagaaaaagcagtttagtgtcgtcaaacgacagctgcagtcagctgatacgattgtgatcgcgactgatagcgatcgtgaaggcgaattgattgcctggtcgatcattcaacaagcaggcgcagagcagggaaagacctttaaaagactttggatcaactccttagaaaaagaagctatttatcagggatttcagcagttaagagacgcaggagaaacctatccgaaatttgaagaagcacaagcacgccagattgctgattggttgatcggcatgaacggcagcccactgtatagtttactcttgcagcaaaaaggcataccaggaagcttttccttaggtagagtccaaactccaacgctttacatgatttatcagctgcaggaaaagattagaaacttccaaaaagaaccatattttgaaggaaaagcccaagtaaccactcaaaatggcacatttggtgcgaagcttgatccgaatgaaacacaagcgacgcaagaagcatttgaagcctatttaaaagaaaaaggcgttcaagtaggaaagcaaccaggcacgattcttgaagtcgaaaccgagaaaaaaagcgcggcaagtccacgtcttttttctctatccagccttcagtctaaaatgaatcagcttatgaaagctagtgccaaagatactttggaagctatgcaaggcttatatgaagggaaatatctaagctatccgcgaacagatactccttatattacggaaggggaatatgcgtatctgttggatcacttagacgaatacaagcactttttaaaggccgaatcaatccctactcctattcatacaccaaatagtcgatatgtgaataataagaaagtccaggaacattacgcgatcattcctacaaaaacggtcatgacggcagcggcttttgaacaattaagtccactgcagcaggccatttatgaacaagtgttaaaaacaacggtggccatgtttgcggaaaaatatacctatgaagaaacaacgatcttgacgcaagttcagcagcttcagttaaaagcaatcggaaaagtgccggtagatctaggttggaagaagttatttggaaaagagagcgacggaaaagagaaggaagaagagccgctacttcctaaagtgacaaaaggagaaatggtgacggtagatctacaagtccttgaaaaagaaacaaagccaccaaaaccttataccgaaggcacgttgatcactgcaatgaaaacaactgggaaaaccgtggatagtgaagaagcgcaatctatattgaaagaagtagaaggaatcggtacagaagcgacacgggcaaatattattgaaatcttgaaacaaaaggaatatatcaaggtagagaaaaataagctcgtggtgacgaataaagggattttgctttgccaagccgtggaaaaagagccgctgcttacgagcgccgaaatgaccgccaaatgggaaagctacttattaaagattggagaacgaaaaggaacacaaaccacttttctagctaatatccaaaaatttgtctctcacttattggaagtcgtaccagggcaaatccaatccactgattttggatcgacgttacaagaagtgaaagcagccagtgaaaagcaagaagccgcgcgtcatttaggaatttgtccaaaatgccaggaacaagaagtcatactttatcaaaaggtggcagcatgtacgtctgaagtctgtgattttaaattatggacaacgattgccaaaaagaaactcacagcgacacagctgaaggagattattcaaaatagccgaacaagccaaccagtgaaagggttaaaaggtcagaagggttcgtttgaagcaacgattgttttaaaagaagacttcactacaggctttgaattttctgaaaagaaaaaaacgaacttcaagaaaagaacacgacgcacgacaaaataatggagggttaatcttatgcgtaatacaacacacaaacaacaagaaatcgaaaatcaaaaagccaaaattcgttcagaacaggaaaaaatgcgtgccagcaaacgaagactgcagcaattaaagaaccagcagcggattcaaaaagaaattgaattagatcgatagacattaaccttgttacaaatacactatcatgatacatttaatgtagtgtatttgtaacgaaaggggggaagtaaatgcaaatattcatttttttccaatacaagagtaaattttctaattcatcgttatctataagaaatcctttttcttttaatttttgtataaatatcgtttttggatacttgttatttattaattctaatatacttgaatagaaatcaatgttttctgtgtattctattccatccataccagcgacagaaataaataatgtgttttcggaggttatattacaagtaaaactggtattaagcacataattaaccatttttatctcctttattaataataaaagaaacgacatgcttgaccatatcgttccttagtgtgaaaaattaacgttcggctactgagcccatacacatcacttttgtttgtgtagaagcaacaacgggtttagttaatttgattttaacttttgtattcatggtaacacctcctcggtaaacaaatttttcaagaaatatttttctaattctttgtaactaatctaagagaactgcatgtgaagaacaaatgagttcttgtataaattgataaaagttttagataattaaaattaaaaaaaacttttatcgatctaatataattataaagcgtttgtataaaaataaaaaggttaattataataaaagtgaatatttaatcattcagaaaagctagcgttacatttgtgaaatataaaatttgtaaagtgttagtttggaatcaaaactgttaatatagttttttttataaatatttattttttaaaataagtaatgttgtatatatatacattttgtgttttgagatattattcataattattttaggggtgaattaattgaaataaaaatgtttctcgatttacaacgctgatttttactatagaaaagaatacttaaggtacattgggagaaagcaaaactttctcagtaggtctaactagcttaaaaaacgacaggccgattttattcagccgattatgctggattgacaggaaatatttatgaacggagttgtgacaaaagccttgtcgcagctcctttttctgaataaacggtgtgccagagatagcctatcggcaataaggcacgattttgtaaaatatgggaagctatttttcaaaatcgcttcttatcgctcaaggctgaacatctctgtcacaacctctccactaaatggtgtttaaaagcttgcatctgcgataataagaacaaccaaacgaaaaataggaagcactattttagtttagttgttcttattacttgatgcaggacagctttttcacaacctcttttttgtatagatgggcaaaatttttgtaataataggcgtatgtctttttcgttgaggagatgaaaaagcatatggcttattttttgtttgctttgcttactttctttccacttcaagtggcagaaatatctactttttattatgtaagcggaaccatatacttgaaatcagaaggagatcatttctatgaaaacaagaacaattgaaatacttcacagaatcatgacagcccaatatccagtaaaagcaaaacatctagcaagtgagttcaatgtcagtcagcggacgattcgtcaggaagttcttgaagcgaatatctggttgagcagtaaaaagcttccggagatccgtacaattcgcaacaaaggttttttgttgaagctggaaaaggaaaagcaagctcgattagaaactgaaataaaagatgtgaaagacggctttttgaatcggcgcgaacgtatttttgatctagttttagccgttgcttacagccgaatcccgatccatctaaacaaaaaagaagaagaatttcaaatctctaaaagtacattagatgaagatatgagacggttacgagcaacactggtcagttatgggatagagatcgtcagttatggaaagcaaggactggtttataaaggttcagaacgatctatccgtacgatgatctatgattttatcaatcagaatctgggaatgaccgacttctttatgaatcaagatgcacaattaacaccggctcaaaaaatctttctccattattttcctttggtggaaatcaaaaaaatacaggagatctattccaataagttgttgaaacaagaagatgatatttataaaaaacaaatcctgctttttacattgatctggatccagcgaatcaggaaacatgaatttatctctgccattaattggaaaaatacagaaataaaagacagtagcttttctgcatttattgaccacatgatcgaggaatttcaattggacaatgtcccgcaagtagaaagaaattatcttcgtttcactattgagacattcaatgctagagatatctccaattcaatcgagtgggtacaagctcaattactaacgatccaattgatccaatttgtagagaacgagacacacgtacctttccatctaaaggaagaagctttattcgaaaatctctataagcacatggctgcactgattgtaagaatcaagaatcatatccaagtcatgaatccattgaaagaaaacatccgaacaaattatttcccaatctaccgcgcagtcactcattttgttcctacgatcgaagaagtaattggtggcaagatactggaggacgagatagcttttcttgtcatccacttttcgacgatcgccagtgtaatcaagcgagacttgaattatgtttataaatcagtcgttgtctgtaaccatgggatggctactggaaatctgttagcagagaatctgaaagaaaagtttcctcagatcgagattactgcagttttaagttcaaaagaaatcgaattagtagataaattggatgtcaatctggttttcagcacctttcaattgaattatcgaaataagccgcttttagttgtcgatccgattttaactgagacgaatatcttggttatagaagactttttgaaaagaaatgaagaactacagcggttagagcctaacagtcatgaatcgacggagttattcactcaaataatagatgtcatggaagaaagtggtggccgagtagatcgaatcatctatggcaagttagaaaaattattcgaaacaaacaatttagaaatcaacaaaagggagatccagcctatgttaaaagatattttgacggacagcaatatcatgatcaaagaaaaagccactacttgggaggaatcgattgaactagctgctagaccattggttaaagaaaatattgtcgaagagcgctatgtcgaagcgatgattcgtgcagtgaatgattacggaccgtatatcgtgattggcaaacacatggcactagcccatgcccgaccagaagatggggtcaataaattaggagtcagcgtagctacgattgagcaaccaatcgatttcggtaatcctgaaatggatccagtaaagattattttttgtttggcagcagtagactcctactcgcatctgaacatcatgaaagaactaattgaattgatcaacaacgaagagaagttggatcgattgattgaatgcacaaatatcgaagatttcaaacaactgcttttttcagtagttgagaaataataaatgatacgggggagaacaaagatgaacaaattgaacattttattcgtatgcggcgcaggtttaggaagtagttttgcagcacagatgtctgctgaggatgttttgaacaaattaggagtagaagccaaactggaccattgtgatatttcttccgcagtttccatgaaaccagatgtgatcattacagcagaaaattttcgttcgcagttcgaaaagttcgcagttgatcctaaaacggcgatgatctatttgaaaaatattgtttcaaaaaatgaaattgaagaaaaaatcaccccagttctgcaagataagggagttatctaaatacaaaaagaaaagagggtaaaaacatgagcgttatcaattttatcatcgaaaatattttgactcaggcatcgatcaccattgcattgattgctatgttgggtctactactgcagaagaaatcagcaggacaagtcatctctggcacgttaaagacactcctaggatttcaagtgttgagtgccggttcgagcatcatcgttggaagtttaacttatttcgggaaaatctttactgaaggatttcatatgcaagggatcatcccttctattgaatctatcaatggtcaagcaatgaatgatttgggtttaggtagagatattgcactgacgttcttagccatttttgtattcaatattattttggctcgtttcacaaaatggaagtacatttttttaactggtcaagcaattttatggatggcaacgatgacgacagtctttggctattttgccggtctgcgagggatcgtattgatcttggtcggtggttttatcggagcttgtttcgccattgctatgccggcagtagcgcaaccgatcattcgtaaaatcactggatcaaatgatattgctttaggtcatttttgtacgatcgggtacttatttgaagccggtgttgctaagctttttggtgagaaaggcgaaaataaaaagtcgatcgaagatatcaagttgccgacacatttcgaatttctgcaagatacttatttgtctgtcatggtcgtaatggtcccgctatatatcatcactgttttatttgcaggcgaaccattcgcttctgaattatcaggagatcaaaactatatcatgtttgcctttttacaagccatccaattcgtagtgggtgtgtatgtattgctagctggtgtacgtctactgttaggtgaaatcgtgccggcatttcgagggatagctatgaaattagttcctgatgcgatccctgccttagattgtccagttttctttccttatagcccaaatgctgtcattttaggtttcattacgacaacgattggtacgattattgccatgtttactttgcccatgttcggcttagcgatgattttacctggtatgctaaccaatttctttgccggagggacagcaggaatatttggcaacgcagttggcggacgccgaggagcgatcattggcggtattgctcatggtttctttattacattattgcccgctttgctagtaacgatctttaattcgatgggattcatcaatgctacagcaaccgatgtagatacagtagccgcagcactcttatatgcctggatcttaagcccagttttgaaagcattttaattgaaagtagggaaaatgatgtttggattttttaagaaaaaagaaaaagaaccgaaaaaagttctggcaaaagaagaaaaagccctatcgccagaagcgaccgaaaagattcaatcagagatcacacaattgaaacaagagatttccactacccaagataggcataaattagcggaactttatgaacaagttggacttaaattttctgaattgtatgagaacgatcaagccatccaatatttagaaaagagcttggaaaataaacagacgatcggagatgggtataaaaaactgatgagcctctataaccagaagcgtgcagatgctgctcgtgctggtgatgatcaagggatcgattactacatgggcaaaatggatgagatgcgacaaattgcaaaacaagtaacgatcaaaggaaacaaataaaaagataaggtggcaataaaagatgtatacaacattgaaagaagtaacaaaaacagcagaagagttgaattttacagttggagcttttaatacgcataacctagaaatgcttcctgctatgctaggcgcagcaaaagaaatgggttcgccaatcattattcaaacaagtgtcgataccgctaaatatatcggtatgcatgtgttagtcaatgtaatgacagctattgcagaagaagaaatggttgatgcagtcttgcacttagaccacgcccgagactttgatgatatcaaagaagcaatcgacagcggatatacttctgtcatgtatgatgggtcccatctgcctttcaaagaaaatatcctgaagacaaaagcagtagtagaatatgcccatgcgcacggtgtttccgtagaaggagaacttggaacaatcggcggtacagaagaaggaatccatgtcgctgaaaatgacaaggtatatacaagaccggaagacgcagtgaaatttgtagaagctacaggcgtggatgcattagctattgctatcggtacgaatcatggacaattcaaatcaaaaacagaagtaaacattcccttgctgaaagaaatcgatgcagtagttgatgtccccctagttatccatggaggaacaggtgtgaaagaagaagattatcctgaattgatcaataacgggatccgcaaattcaatgttggaacggagcttttagtcaactggacgaaagtagctaaagaaacctttagtgaaacagaaatcaacaagtctcttcgccataatgtgattccagcaaatgaagcagtaaaagaaattgtcaagcataagattggactgtttatgaacttggaaagtccaattaacttaggaaataaatgagatgaaaaagtatttcattcttctggctggtagtcctggtacaggaaaaacatatcttatgaataaactacgggaacgatttccagatatgtatgccatcacgctcgatgaaatcaaggaatactatgcagaatccatcgggtttaacaatttggaagaacgggcggaacaagaaaggacgaaagtttatcctttctattacaaagcacttgatttgtatatggaagcaggaaagaaagtgattgtgtccgagtatccttttagtgataagcaaaaagcacgactccaagaattagcagatagatacggatatcaggtgatcacgattcgcctaacagcagactttgaagtgttatggcaacgtcggtacaaacgtgatcgtgaatcagatcgtcatttgagctatatcatggatcattatcactatggtgacgtattggaagatcgaacgaaagggaccaatcatattacgaaagaagcattcaaaaagatcatcgccgaccgaaaatatgacaaattccagttaggaacactatatgaatttgatgtaacagactatactcaagtggattacactccactattggataaattagaaaaagaaatcaatgacaataagtaacaaagaaatggcttaatatcgaaaaattggcttttgaacgccgtttaccgagagatcgtgagcctgtcgttcagctccgagtcacaaggagcaatttcaaaaaaacagcttctcatgtttgatgaatattgtaacttgtgactgaggagttggtaggagaacaccgtttaaggaagaggttgtgaagtcagtgttttaatatgagtattatagaaaaaaacggcaaaatagctcctcatattttgccgtttttttagtgaataccgagcatcagctgattgaacaccgtttagtggggaggttgtgaaaaagctgtcctgcctcaattaataagaacagccaaacaagaatagctcgtcatatttttcgtttggttgggcttattaccgcagatgcaagcttttgaacgccatttattcacagccccagagaagtcgaatgtcttttgttctcgagttttttaacattcttttatttattgcagatttcattatatttatttgccgtaattaaaccagtcttctatacttgattacatagtcatacatttgctaaaaaagaagggaagagaatgaacaagaagttggctcaatacaaaagactactcgcactttctcaagctggtctatattatggaaaagatgtatttgataaagagcgttttgaggagatccggacgatttcattggaactgatcagtgaaataggaaaagaaactttcgaagaaataaaagcgctcacaacgattggagaaggacatccaacaccaaaagtagatgttcgtgcctatatcaaaaaagatggcaaggtcctactaatcgaagataaacgggcgaaagaatggtcacttcctggtggatttgctgaaataggattgtctcctgaagaaaatgtgcgtaaagaagtctatgaagaaacaggattaacagtagaaactactcagttgcgagcagtttttgatacgaataaacaaaaagatattccacagctttttcagtattataaacttgtttttgcttgtgcgatccacggtgaagaggccaagtttattgagaataatgaaacttccaacatgggattttttagtatagaagagttgccaaagctatcagaaaagcgaacaacgaagaaacagttacttattttagaaaacaaaaaccagatctattgtgattgagctttttcgtaaaagaagaaaagaatatactttactagttattaaaaaagaacttgatttttttattgaaaatagttgcatttgcaacaaaaagaggtaaactagtcttacaaacaaaataaaggtgggatgaaatggctgaaatccttcgagacatcggaatgattgcccgagcgctagattctattagcaatatcgaattcaaagaagtcgatttaacaagaggacagtatctttatttagtacgtatttgcgaaaatcctggaatcatccaagaaaaactagcagaaatgatcaaagtagatcgtacaacgactgcccgagcaatcaagaaattagaatccaatgggatgatcgaacgtttggaagataaagaaaataaaaaaatcaagaaactctatccgactaaaaaaggagcagaaatctatcctttcatcattcgagaaaacaactactccaatgcagtcgcattaaatggtctttctgacgaagaagcaaaacaattggaatatcttttaaataaagtatgcaagaatgttagcgaagattggaattttgtcaaaaaaggcaataaaaggatctattgaaaggaagaagccgtgaataaatacgaaattcgaaaaatgacgccttcagatgtagacttactacaacaaattagtatcgaaacatttacagatacatttggaaaagataattcaccggagcatttagctgattacttgacacaagcttatgcactagaaaaacttacagaagagctaaaagataaagaaaccgattttttcctagtgagtatcgatcaagagcctgcgggttacctgaaactaaatacaggaacgagtcaatctgaggaaatggctgatcattttttagaaatcgagcgaatctatgtacgaaaaaaatttaaacatcaaggtatcggtacatttttactagatacagctattgaaaaagcaaaagaaaagcaaaaaacagccatttggctcggtgtttgggaacacaacgatgttgcgctcgctttttatcgtaaaaaaggatttatcaaatacagcgaacatgttttttatatgggagatgatccccaaacagactatctattcatcaagcaattattctaatcaagaggtgtgaacagatgaaaaaagtaatagtggataccaatttctgggaagtatttcctgaagcaaccatcgaaatcttatccgtaaatggtatcgataaccacgtaacaaaagaaagtgaagaaacgtatcatcaattattgaatgaggcagcaaaagaagcaagaaattaccttacagaagaaacattcagccaaaacgaagtcattgctcagtggcgtcaggcatttaccacattcaagactaaaaaaggtgcacgttcttctattgaagctttactgaaacgtgcaaatcaagaacgggaatttttcccaatcaatccgcttgtagatatctataatagtatttccttgtcttttggcgtaccttgcggcggagaagatatcgaaaagatcgcaggaaatctgcatttaggaaaagcccaaggtggcgaatcattcctgcctttaggtgcagattccgatgctccggcacttccggaagaaatcatctactatgatgaacaaggagcgatctgtcgctgtctcaactggcgtgaagcccaaagaacgatgctgacggaagaaacacaagcagcggtgctggtcattgaatccatcaatgctgaacaagcggcacgtggcgcacaggcaatcgaagcgttgaaggaaaaaatcgatcaaacatttggcgtaactagtgttagacacacactaaccaaagatgaatcagaagcagaattataaaagaatcgaaaaaagaagagcggcattcattgccgttttttttttgtaaaaaaagtttgtggaggaaagcaatcctagtaactattgctttatttttcttgaatagtatcaaacacaaggtgtttgcgctttcgtgatataatggaatcagtttatagacaggaaagaaaatcaaatagaaagaagggtcaaacgatgatacaaaaaacacgtgtgatgctttatgtcaatgacgtagagatgatttgccgattctttgtagaaaaaattggtgcagaaatttctgaaacaatcgaattgccagaagaatttaagagtattgtactcagcatctcaaaagaattagaattaggcgtattcccaaaagtatttgtgcagaagttttcaccagaggtattaggaccaccgccttctttagtattttttacggatgaatttgaaactatctacgagaacatggaagaaccaggagaaatcacagacaacaatggcgtcttgactttcaatttttcggaccctgaaggcaattattttgttataggaaaagctgagtcgtctgattgaataaaaaggaggaaaaacagtggatctaatgggaagattagaaggttatttgaagtatcggcgagcaaaacatagtgagaagcttcgagcaaagaatctcaaatcaggaaaaaagaagacaaaaggctggggaaaaatggtcgatacaggttttggcggactaaataatctgaatcctgtcgatacaaaagaattcatcaaagaagaacagaaacgaaatggtaaaatcaaatcacactattgatttttgagactagaatgaagaaactttattaacacaataaagaaattcttgtaatccaaagtgaatgttcatgaactttgagataaagggatttaatcagatggaacgttcggattttgcttaaaatccgaattttttgtttacttatgttttgttttagtatatgataaaacacgttgttttattaataaatcgaaattttaacggactttatttataatgttcggatttagggggatggaagatgaaggaaaaaatactttcctacttcgaaatagaaaaattgaacaccacggtaaaacgtgaggtactggcaggatttacaacatttatctcgatggcttatatcttatttgtaaatccaactgtattaggtgcttctggaatggatgaaggagcagtgtttactgcgactgcattagccagtgcgatcggctgtattttaatgggggtattagcccgttatccaattggaacggcacctgctcttgggatcaatgctttttttgcttattctgtttgtttaggaatggggattccatgggaaacagcattagccggcgtattcgttgcttctttgatttttattttgatcacaatcttcaagctgcgggaaatgatcattgatgcgatcccagcagatttgaaatatgcgatttctggcggtatcggtctatttattgctttccttggtctgagcgaaggtgggatcatcgtttcgaatgaatctacattagtaggattaggatcactcaacgttggttctacttggttgacgatttttggattagtcgtaactgctatcttgcttgttcggcgtgtaccaggtggcatcttcatcgggatggcagctacaacgattttaggtctggtcacaggtttgattccaatgccttctgaaattgttgccgcagcaccaagtttgaaaccaacatttttagttgcattaaaacatgtaggggacatcaattctcttcaaatgtgggtcgtagtgctgacattcttacttgtgactttctttgatacagcaggaactttagttggattagcaaatcaagcaggtttcatgaaagacaacaagatgcctcgcgtagggaaagctttagcttctgattcaacagctatgcttgcgggttccttattaggtacttctcctgttggtgcatttgtagaatcatcagctggtatcgccgttggaggacgttcaggtatcacagctattactacagggattttcttcttgttaggcttgttcttttctccattactatcagttgttacttcacaagtaactgcaccagcattgattatggtaggagtattgatggcacaatctttgcgacaaatcgaatggggaaaattagagattgcgatcccttcattcttgatcttgatcggcatgcctttgacttatagtatttcagatgggattgcattaggttttatcttctatccaattaccatgttagcagctaaaagaggaaaagaagtatctccaatcatgtatggtctgttctttgtattcgtgggattcatgtggatattgaatgtgaaataaagaggttgtgaaatcagtgttctggcctgagtattagagaaaaaaacgaaaaaatagttccttatattttgccgttttttgagctaataccgagggacagctgagtgaacaccgtttataaagaagttgtgaaatcagcattcttccctgcataaatcaatcctttcaaaaaacagttgagggaatttcctcagctgtttttttgttttattctgttaccgataacaaggtgcaatagctatttgaaagcgttacaatttttagtgagagagactaaaataaatgattaagcaaaaaatagaaacatccatttataggaggaaaattatggaacaaaaatggtggcaccattcagttgtttatcaaatctatccaagaagttttcaagattcaaatcaagatggtattggagatttgcgggggattatttccaggttggattatctggcgtatttaggtattgatgcaatttggctttctccagtatacgagtctccgaatgatgacaatgggtatgatatcagtaattatcaagcaatcatggcagaattcggtacgatggaagaaatggaagaactgattgaagaagcaaagaaaagaaatatccgtatcatcatggatctggtggtgaatcatacttctgatgaacatccgtggttcattgaggcccgtaaaaataaagaaaatccttatcgggactattatatttggcgtgatccggtcaatggaaaagagcctaatagattgcgctcaatattcagtggttctgcttggcagttggatgaaaaaacggggcaatattttctgcacttgtatagcaagcgtcaacctgatttgaattggaaaaataaacaggttcgccaagagatttatcaaatgatgaatttctggatcgataaaggtattggtggctttcgtatggacgtgatcgatatgattggcaaagaaccggataaagaaatcacaagtaatggacctaaactgcatgagtatcttcaggaaatgaatcaagcaacttttggtgacaaaaatctgatgactgttggcgaaacatggggagcaactaccgaaatcgctaaactttattccaatcctaaaagaaatgaattatccatggtcttccaattcgaacacataggattagatcagcaagaaggcaaagacaaatgggatttgaaacccttgagtatctctgaactgaaaaaagtattatccaaatggcaaacatctttaggtgatgaaggatggaatagtttattttggaataatcacgatcttccgcgaattgtttctcgttggggaaatgacgatgtgtatcgaaaagaaagtgccaagatgtttgctatcttgcttcatatgatgaaaggtactccttatatctatcaaggagaagaattaggcatgacgaattgcccaattgatgatatcgcggaagcaaaagatattgagacaatcaatatgtataacgaaaggatttcttctggatttacaaaagaggaaatcttggaatcaatcaatgcgaaaggaagagacaatgctaggacgcctatgcaatggaacgcccgtgaatatgctgggtttactactggaattccatggcttcgagtcaacccaaattataaagaaatcaatgcagaagaagcgttagcagatcaagattctgttttttatatgtacaagaaattgatcgatttgcgtagaaaacatgacatcatcgtctggggagactatgaattagtggaaaagacgcctgagcatgtctttgcctattctcgcatatatgaagaccagcaatggctcgttatttgtaatatgtccagtgaaaagcagacgttcactgttccacatgaagctttaagggttattgtgtcaaattatcctctgaaacagttaccagacggcaaagttgatttacgaccttatgaagcatttgtggtggaagtaaaataaatcgtttgcttagatggttaacgagtgttttctttcggggatcgtcttatgtatttgttatatataaatattaaaaatgaagagtagcattcaatttttttcttctcttctgccgaaatagttagaatatcttgttttgatgaatcgagctatacttcaagtaagaaattgttgatagcgaggagagatagttatggatcaggaaatatttccagaaaattttttatggggcggagcagtagctgctaatcaatgtgaaggtgcatggttggaagacggcaaattacctaatgtgacagatacgcttatcgggatcatgaaccagcatcctagtattcagtggaatgaagaaaaaaagatttgggagattgctttagacgaatcactccattatctttctcatgaagcgattgatttttatcatcgatttgaagaggatattcgtttactgaaggagttaggtttaaaagcttttcgaacaagcatctcatgggcacgaatatttccaagaggagacgaacagaagccaaatgaggctggtctcgtattttatgacagactaatcaatacattaaatcgatatgatatcgagccagtaattactcttagtcattatgaaacccccttagcattggtaggagagtatggggggtggcaaaatcgaaaattaatcgacttttttgaattttatgcgcagaccgtctttgaacgctaccaagggaaagtgaaatattggatgacctttaatgagatcaataatgcttttcgtatgccttatgcagctgctggattggttacattccctgctagagataaacttgaacccattgctacactaacaaaaaaagagatttatcaagcctgtcatcatatgtttctagcgaacgcccgtgctactcaattattaaagaaaatcgatccaaatgctaagatgggtattatgtgtagcttttctgcattagcgacttatgcatatgactgtgatccagagaatgtatttggttcactgcaatttaaacgcaattcatggtttttctccgatgtcatgtgccgagggcattatccagcttatatttacaggacatggaaggaagaagactgtgcaccagtaatgttagatggagacgaacagtgcttgcaagctaacacggcagattatattgcatttagttattatcgtagcgctgtctataaaaaagaagcagaaatgcgcgtagatactggcggagcaaatggtttcgataatccctttttgaaggaaaaatctcccgaaccttggagttggccaattgatcctctagggtttcgttatgtcatgaatgaattgacagaccgttatgaattaccattattcatagttgaaaatggcattggactagatgaagcaccagatgaattgaatcgaatccacgatccaaaacgttgtgagtatctaaaaatacatcttcaggaaattgctgaggcaataaaagatggttgccaaatcattggttacttatggtggggaccaatcgatatcgtatcggcaggaacaggggaaatgaggaagcgatatggctttatttatgtggatagacaaaatgatgggagcggaagctttaggagattgaaaaaagatagttttgaatattataaacaaattatccagtctaatggtaaaaaccttgaatatagatctttcttcaaatgatttttaaacctctgcaagtgactattgtcatttgagaggtttttcctgtatgtttataacaaagaggaggtgtaagcaaatggacttaaataaacgacaactccaaattcttgtagtattaagaaataagaatcattggataacaagcgaagaattagctgaagctttaggtaccaacaagaaaacgatccaaactgaaatcaaaaatatgcttgctatctacgagaagaaaatcattatccagtcaaataaacgttcaggttattttttagaatcaattgaatctgaaactaaacagcaaatcatacaagaggtgacgaaacataaaatctattccagcatggatttccgagcttcaactattgtgacgtacttattgtttcaaaaagggtatgtcagtatgcaaaagatagcagacattttctttctttcaaaaacagccgtatcattacaaataaaaacgattttgcgttggatcgagcgcaatcctaaattagaactggaagtttcgtcgacaaaaggactaaaaatcattgctgaagaaaattcaaaaagaattttcttatctcttgttggaacagaaacggtgatccaacacgcaaggttgcctcaacaaatcagtacaattttttccaatatcatgccgactgtccaaaagacattaaaagaggttcttatatcatataattatattgtttcaggagaggacttcatacgattttctcggtatctcgttttgaccattcttcgaagagaagaacttttagaaaaaacaaacaggtatacattatttattccgatggtagagaccctcacaaaaaagttatcatcagaactaccctattctttttccaatcaagaaaaacaagcaattgaaaatcgactattagagttaaattatttgatgattaatgatgaaaaaaacaaagaaatagagaagaatctaagagcatttgagcaaacgattattcgttttttagatcttcctgtttcgttattgttccatgaaacagaatttttgctaacccatatcaaacaaatgaaaacgaggatggatgccggacataataccatgaatcattttgtacaaaagatcatctcccgttatcctttagaaatttatttaattcggcgtttcttcccaatacattttcaattacgtcccaatttagctgaaagcgcttatttggttttgtatcttgccgaagcgttgaatccttttcgaaaacaaggggagatactgattgttagtaaccagccaattagtattttgaatacactaaaaaaacagattcaacaaagtatgaacatgtggatcaaagaatgccggatagaaccagtgtatcttttcaaaaatcaatcaaacaaaataacggaatatgatgcaattttgactactgagcaagagcttatttttgagtgggatgatttgatttatctacctagtgttctagatgagtttgaatcttcggagatttatcagattttgcgtgaaaagctgaccatagttgaagaaaaaaagaaaacaaaactgcttgatcattactacaaagaagaaaatcaaataaaaatccataaaaagatagattccattcagcaactaatctctcctagttctgacctagttatgcttccgttaaatgccgagactttgttgtgctgtcttatcaaaagccaagtagaaacaaaaatcacagagtatcagcttgagataccacttatacatcagcaaaggaagatcaagcgtgttttttttgtctcctttgactataagagaaacgatatacttgttttctttcaagcagtgagtgatttgctcggctaagtaaaccatacacactattgtacagtttcgttcgctattagaaggggtactaattgaatggagaaaccgttttctaagaactatacttatcttgtaagaaggattgctacggcattaattaacaagggggaaggaaaaatggactattcacaattagcgaaagatattgtccgatttgtcggaggcgaagaaaatgtcagcaatgtttaccattgtgcaacaaggttacgctttaccctaaaagataataagaaggcagataaggagaaggtagagcaactagaaggtgtgatcactgtagtcgaagctggaggaatgtttcgagtcgtagtaggaaatgcagtaaatgaagtgtatgacgtattatccaaacaaatgaaactagaagatgatgcatctagtggaaagagaggaactgagaaaaaaggcattttaaactcttttatagacatgatcgccgctgtttttgccccgactttaggcgtcttggcaggaagtggtttgatcaaaggagtactcgccttatgtacgagtttgaatttattaactactgaatcaggaacttatatcattttgaatgcagcagctgatgcatttttctatttcttgcctatatttttggcatatactgctgcaaaaaagttcaatacagatcgtttcatcgctatggttattgcagcagctctcgtttatcctacgattgtcagtgcatatagtgatagcataaccttgcgatttctagggatgcccgtgattctagcaaggtatacaagtacggttattccagcaattttagctgtatgggttctttcttatattgagcctaagattcgcaaaagcttgcacgaaagtattcgaaatttattgacaccattcatttgtatcatcgtgatggtcccaattactttattagttgtaggtccaattgcagattatgcaagtcagctgattgcagctggatatttagctgtttataactttagccctgttttatctggtgctgttatcggcggattttggcaagtgttagtgatttttgggttacattggggacttgtaccagtaatgaccaacaatctttctttctacggtcgtgatacgctaggtccagcatgtatgactgccgtagctgcgcaagcaggagcagtacttggggtatttttgaaaacgaaaaataagaaagtaaaaagtttatctttatctgcatttatcacagcattatttggaatcactgaacctgctgtttatggtgtgactcttaaatataaacgaccattttacattgcttgtatatgtggagctatatttggtggagtagctggtgccgcaggagccggtgctttggcagttgctacaagaagtattttgtctttcccgatttatattggtgaaggatttgtttggctagttgctagttatttcttagcgatgatcagttcctgtatgctaacttttcttttcggctacaaggatgaaatcgaagaagaatcctcaaaggatatagtgttaagtactcctgcagcaggtgaaataattgatttatctgaagtaaacgatccaacatttgctagtggatctttaggagaagggtttgcgatcattccaacggacggaaaaatctacagtcctgtaaacggggaagtttcaacagtttttccaacgaaacatgcaattggggtagtcagtgaagaaggagcagagatactgatccatatcggtattgatacagtgaatttaaatggcaaatactttcaaagtgcagtatctgatggaaaaaaagtacgtaaaggcgatttattgatggaagtagatttgcaagaattaatcaaagagggatatgatccgaccacaatggttattgttacaaatagtagtagattcaaaaatatcattactagtcataagaaaaataatcaaacaagaaaactagcaagtttagggggatcgatatgaaaaaatttccagaaggatttttatggggcggagcgacagcggccaatcaatgtgaaggtgcatgggatgtagatgaaaaaggattatctgtgtctgatgtgtatacattcgacagcgatttacctaaagaaaaatggacagatcaatggcatatgatgacgcatcagcaagtaaaagcggcgcaggatcccaacagcaagtattattatcctaaaagacacggaaatgatttctatcatcactttaaagaagacatccgtttatttgctgaaatgggttttaaatgctatcggatgtctatcgcatggacaagaatttttcctcatggtgatgaagaaacacccaatgaagcgggattatttttttatgatcaagtgtttgacgaatgtctaaaatatgggattgagccagtcgtttctctttcccattatgaaatgccgttatatttggttacagaatatggtggatggcctaatcgaaagcttattcagttttacgttcgtttcgctgaaacagtattcaaacgctataaaaataaagtaaaatattggatgactttcaatgagatcaactgtgtaaaacatcacccttttgttagcgtaggagtaattgaagaaaaccatccccatttggaacaagcgaaataccaaggtgcacaccatcagtttatagcaagtgctttagctacaaaagcttgtcatgaaattatcaaaggttcacaagtcggttgtatgatcagctatcagcttcttgttccgtattcttgtgatccggatgatattcaaaaaacaattgagcagcaaagaacttctttgttctttagtgatgttcaagcaagaggatattatccagcgtatacgcaacgaatgtttgaagaaaaaggtgtcaacttaaaaatagaagtaggtgatgaagaaatcttagcagcctaccctgttgattttgtttcttttagctactacatgtctagtgcagtcagtgctcatccagaaaatttggaaggggtccaaggaaacttaataactggaggaattaaaaatccgtatcttccatcaagtgaatggggctggcagattgatcctaagggtttgagaattgctttgaatcagttatatgataggtatcaaaaaccactgttcatagctgaaaacggactcggagctatagacaaagtagaagaagatggaaccgttcaagacgattaccgcattgactatttgaagcagcatattgagcagatgaaggaagctatcgaagatggagtagatttatttggttatacgtcgtggggctgcattgatatcgtcagcgcttctacttcacaaatgtcaaaacgttatggatatatctatgttgatcaagatgacgaagggaatggcacaaagaaacggttaaagaaaaaatcatttgattggtacagacaagtcatccaatcaaatggcgaaatcctataataaaaggaaataagggactgtgacaaaagtcttgtcacagccccttctttacgaataaacagtattctcctgccaactcctcgatcacaagtcaccatagtcataaaacatgagaatctgttttttgaaattgctccttgtgactcggagttcaacggcaggctcacgacctctcaataaacggtgtacaatcagctgaccatcggcattagctcaaaaaacgacaaaatatgaggaactatttttgtttggctgttcttattacttgatgcaggacggctttttcacaacctctgatataaacggtgttcaaaagccagtttttcggtattaagccaaatttatgcaaaaatgtggaaagccattttcacaaaatttttcttcatactcaaaactaaacgactttttcacaacctctgattcacggtgttccagaaggagttttgtcgaaaacaagccgaaattctttgaagatggctacttctttttttcaaatctagacagaggaggcggacattattacgagttttttgacaaaaaataaaaatcatactatgatatgtacgccaatggaggggatgaaatggaaaagccaattgaaaaagcgttagatgaatgtcttttctttagcgtgaaaaagctagatcgcatgttgaataaattagctgatgaagcgtttagaaggacaggtctggcaccaacttatggttttattttattgatattaaaagaaaaagacggaataccacaaaaagatattgcacaaatgctctattccgccccatcaacgattgctcgttttgttgaaaaattagaatataaaggatacgtcaaaacagttagcgaaggtcgcttgtcattagtttatcttacagaacaaggacgccaatttgctaaggaagtcgatggtagctgggaagaacttcatcagtcatacaaagcagttttgggaaatgaagcaagtaaagaattagcccagacaatgaatgatgcaacagataagttacaaaaaaaataaaattttttaagcaaattagttgcatgtacaactaatcgagtggtttaatgatagatgattctcgataggttaatcagagcgaattatgggaggaatgacaatgtcacaatttgatcaatcaattactttaccttcaggagttcaattgaagaaccgattgatgctgtcgcctatgacgacacaactcagcttcttcaatggagtgatcaccgaagatgagatcacttattataaacaacgttctaaaggacttggtgctgttattactggtgctgcaaatgtccaagatatcggaaaaggctggccaggtgaactgagcatcgctcacgatgaaatgattcctcggttaagtgaactagctaaagcaatccaaggagaaggtgcaaaagcgattgttcagattttccacggtggacgaatgactagtcgagctactctatccggagaacagcctgtatctgcaagtgcagttgcagcggaacgacctgatgcagaaacaccgcgagcattaagtgaaaatgaaatcaaagaaacaatccaagcatttggcgaagccacacgcagagcgattgaatcaggatttgatggtatcgagttgcatggagcaaatacgtatttgctccaacaatttttctctccgcattcgaatagacgagaggatcaatggggcggtagcttagaaaatcgctatcgttttattgacgaattattaacaacggttttctcaacggttgaaaaatatgcaaaaaaaccattcatcgtagggtatcgtttctcgccagaagaatatgaaacaccaggtatccgttttgaagacacgatctggcttcttgaacgattacgtgagacaaaattagattatctgcatgtttcattaaatgcgtatgatcgaagagcccgttctgataaatacagcgatcagtcgattcttgaagctgtccatgacacgatccaaggaaagatccctttaattggtgtcggaggcatccgtactcgcaaagatgtagagcaggtattgaaatatgcagaacttgcagcaattggacagcaaatgatcgtcgatcctgactgggcagagaaattattggaaaaccgtgaggatgaatttgtaacgaaacccttcgaagaagcatataaagagctttatttgccaagcccattatataatttcttgaaagcacgttatcaataacgcaatttttatagaaagaggatgggaaaatgaaagtattgatcgtattaacaaatgtagaaaagtacgaaaagatcgagcgtcctacaggtttgtggttaagtgaactgactcatttttatgatgtattagtaaaaaatgggatcgatgcagattttgtcagtcctaaaggcggatatgtacctttagaaccgcaaagtgttttgaatatggatgaaatcgattgggcctattataaagatgaagatttcagaaatcgggccttgggaaataccttacgtcctgatgatgtggatgcaaatgattatacagcggtttattatgctggtggccacggaacaatgtgggattttccagaagcaatagatcttgggaaagtcgcttcacaaatctatcgaaatgaagggctggtctcagctgtttgtcacggtgttgtaggattgttgccagttacagatgagtctggaaaatctattttagctggacgtacagtgactgggttcagtaatgaagaagaggaagcaaatggtacaacgaatgaagtaccattcttagcagaagatgctttgaaagaaaaaggagcaaactatcagtctggtggagctttttcagaagtggttcacattgatgggcggcttcttacagggcaaaatcctcaatctgctcatcaattaggcgaagcagttgttgaagcattaaagaattaaaaattgttagcataaaaatgatgtgtctattctaactattacattacacacactaaaactcgtcttttcgttcttttctgtttcctatttggacagaggtacgtaaaaggcgagtttttttcttttataagagtacattttttgaaacatctcttcagaaatgatactcttcaattaggtccactagtatattattgagaagcagacctagaacacggtatgatggagagggttgattctgctgcatcgctatgtatcataaggttgaaagcgagttatgaatactgtgttttctgattgagaagttagcagtagaacaccttataagaaagaggaatgcagatgaacattgtaattgtcggcgggtcgtttgcagggattcatgcggctatttatcttcgccaattgatgccaacaagtgaaatatatttgattgaaaagcaatcgaagttaggatggattcccagcgggttcaatttgatattaaaaggaaaggttaccagtgaaaaacaactttcttggatcacgaaagaagaactgactgaccgctatcgaatccatgtttacacagaaaagacagtaataggattgaaagaaaaaaaagtcgttttagcaggaggaaaaaaattggattttgatcgtttgattctagcgactggttcaaatcaaaagtttcgaaatatttctgcagaatcaacgcttattcacccagttaaaaagatacaaaacgtaacggctcttcagcaaaagatcatgaatgcaaagaaaattgcaattattggtgcaggacaagcaggaatcgaaatagctgaaggtttggcatcaagaaaaaaacaaatccatctttacgaaagccgaaagtcaattctttttcgttatctagatcctgaaatgacagaaccgttagtaaaggaaatgaaaaatcaagggctttcactttttttagaagaacaagttgtgtctttgactgaaaatgaaaccgctattttagagacggaaaaaagaaaggagaactatgatcttgttttgctggctaatcattctcgccccgacaatcagatgtgggaagaacaattaacattgaatgatgatggaacgatctgggtagatgactacttgcaaacgtctcaaaaagacgtctatgcgattggcgatgcgatccaagtaacttttcgtccaacaaatgaaaaaatgtatgtttctctagtaaataacgctgtccgtacagcacgaaatgtcagcaagacaattagtggctcacagacaaaggatcagggaacctatcgtccagtcggcaatcagtggtttggctatttcttaggaagcgtaggtttgacagaagaagagagcattttttatccccaaaaaattgaaacaggatacgtagaatacaagcttacagcaataaatcaaagcaaagttaaactcaaatttctatttgattctgaaaaaaagattcttggagcacagctccaaagcaaaaaagagatgttccaccttcttgaccaactgacaattgcagtagaagaaggatggacgtttgaacagttagaagaacatgagctatttttccagccagaataccgtgtgccagatatggtgtggtcaaaggtggcgaatactgcctatgaagattgaagcattattagaaagaaaagagcagttacagatcctgattttgcgaaaccttgttctgcaagggggaacagcctctatcaatggtttgagagagcatgtccaactgtcaaaagcctcgtttgatcaatatttggaagatattgaattgattggccgaatgatggaaaaaaaagtagaagtacatcgaaatgagtatcaggcgctgcttgtgttggacgaagatgtaagtttggaaaaaattctattgtttttattgcaagaaagcttgaagtttaagatgctcgtctatttattagaacatcagcaagtatccatcgttcgattagcgacagcgtttaatatcagtgagtcttctgtttttcgaaagatcaaagaattgaaccagctcttagaggaatttggattacaaatcaaaaacggtcaattatacggagaagagctacagatacgatatttttattatgaactattccaatatatcccggaagatcagcgaccgctttttttgcaaaatacaccagaaaaaagaccgttcattctaggattggaccgtgtattagaaacaacgtttacggcatcagcagaagcacagattgcttgctggctcgggattacgaaaaaaagactattgaatgaaaaaagtacgtacgcaactttgaaagaaaaaaattactctatcagtcggaccggctttatcaagcaatcgatccaatcatcgtgatgcatcttagtcgaacagcagcagaactgaatgtatacgaaacaatgatgttttacagcttttttgtttctttttcgatagtagacgaagaaatattttatcagtatgatttgacacggagcaaaaagttaccaaccgctgttttagatacttacattcgggaaacgatgttatggcattatcgtcctcgtcgtttgaaaatcaaagaagaaaaggcagtaggctaccaaatttcccagatcaacaatgaatggtttttctttgttggaaagatcgaagtctatgagcgtgatcggcttttggaacagcagcagaaaatgctcgggcattccttaacacagttactggcgaaattacaggaaacagcggtgcagcaattgccgaggaaaagagctgaagacagtgagcttagttacctgatgatccagtatgccaatgttcttttgatgatcgatttttatattgcaaaaccagtagtgattggaatcgatttagaaagtctgccgatttatcgtattgcttttcaacaatatctgatcagagaactgaggggaatcggcggtattgagattggaagttatgaagaaggtaaagaatatgatttggtgatcacattttgccagagaaacaaaaaacagtgtgaatattatctgtcagaatttgcgtcaccttacgacattattcgattgaaaagaagaatagagacgctgaaaaaagaaaagaattgattaaaaaatagcttcataataaaaaactgtcaaaaaaagaaaaaaagaataaaattttgacagtttctttttttaaaacagtagtatgataagagtagttaaagaaagcgtttgcttataatggagggaatcacaatgacagaaccaacgtatatcatggcgattgaccaaggtacaactagctcacgagcaattatctttgacaagaaaggaagacatatcggcagttctcaaaaagagttcacgcaatatttcccgcaagaaagctgggttgaacatgatgcaaatgaaatctggaattctgtacagtcagttattgccggagcgttcatcgaatcagggatcaaaccaaaccaaattgctgggattggcataacgaaccagcgtgaaacaacagtaatctgggaaaaagatacaggacgtccaatctatcatgcagttgtttggcaatccagacaatcagctggaattgcagataacttaaaaaatgaaggctatcaagaatttttccacgaaaaaacagggctagtgatcgatgcctatttctcagcaacgaagattcgctggattcttgatcatgtagaaggtgcgcaagaacgcgctgaaaaaggcgagttaatgtttggaacgattgattcgtggttagtatggaaactaactgatgggcaagcgcacgttactgattactcgaatgccagccggacgatgttgttcaatatccatcagctagattgggatcaggagattttagatttactaaatattcctcgagtgatgttaccaaaagttacttctaactcagaagtttatggttatacgcaaggttatcatttttatggaagcgaagcaccaatttcagggatggcaggagaccagcaagccgcattattcggacaaatggcattcgaaccaggcatggtcaagaatacttatggtacaggttcatttattgtcatgaataccggtgaaaaaccgcaattatccaaaaataatttattgacgacaattggttacggcataaatggaaaggtttactatgctttagaaggaagtatttttgtggctggttcttcgattcaatggctgagagatggacttcaaatgttgcaaaaagctagcgattcagaagacgcagcgaaacgctctacaagcgaagatgaggtctatgttgttcctgcatttgttggactgggtgctccttattgggatcaggcagcacgaggggctatgtttggtttgacacgtggaacgacaaaagaagatatcattaaagctactttgcagtcgattgcctatcaagtgagagatatcatcgatacgatgcaagatgacactggaatcaagattcctgtattgaaagtagatggcggtgcagcaaacaatgaatatctgatgcaattccaaacagatatcttgaatgtaccgatccaacgagcagaaaacttggaaacaacggcgctaggggcagcatttttagcaggattagctgtcggttattggaaagatacagacgagatccgcgaattttatgaagctggcaagctatttgaagttcaaatggaggaagagcgccgagaaaaactttacaacggttggaaaaaagcagtaaaagctacccaagcatttgaataaggaggaaatccatatgttttcaaacaagacaagacaagatagcattcaaaaaatgcagcaagaagaattggatctgttgatcatcggtggcggaatcactggtgccggtgtggcagtccagtcagcagcatcaggaatcaaaacaggattgatcgaaatgcaggattttgcagaagggacttcctctcgctcgaccaaacttgttcatggcggtattcgttatctgaagacatttgatgtggaagtagtagctgacacagttggtgaacgtgcagtcgtacaaagtattgccccgcacatcccaaaaccagatccaatgcttttgccaatctatgagggcgaaggagcaacaaccttcaatatgttctcggtcaaagtagcaatggacctttatgacaaactggcaaatgtgacaggaaccaaatatgagaattatacgctgacaccagaagaagtattggaaagagaaccgtttttgaaaaaagaagggctaaaaggcgcgggtgtctatctagatttccgcaacaatgatgcccgtttagtgattgataatatcaaaaaggctgccgaagatggggcttatctagtaagtaaaatgaaagcggttggctttttatatgatggcgatcaaatcgttggcgtcaaagctcgtgacctgctgacagatgaagtgatcgaaatcaaagcaaaattagtgatcaatacgagtggtccttgggtagataaagtacgaaacttgaattttacgcgtccagtctctcctaaaatgcgtccaactaaagggatccatttagttgtagatgcgaaaaaactgcctgtaccgcaacccacatacttcgatacaggaaagcaagatgggcggatggtttttgctattccaagagaaaacaagacttactttggtacgacagatacggattaccaaggagattttacggatccgaaagtcacacaagaagatgtagattatctattggatgtgatcaatcatcgctatccagaagcaaatatcacattgaaagatatcgaagcaagctgggcaggacttcgtccactgttgattggtaattctggttctgattacaatggtggagataatggatcgatttcagacaagagcttcaataaagttgtcgatacagtaagtgaatataaggaaaacaaagtttctcgtgctgaagtagaagacgtgttgaaccatttggaaaacagccgtgatgaaaaagcaccttctacgatttccagaggtagttctttagaaagagaaccagatggtttgctgactttatctggtgggaaaatcaccgattaccgtaagatggcagaaggagctttgcgattgatacgccaattattaaaagaagaatacggaatagagacgaaagaaatcgactctaaaaaatatcagatttcaggtggaaacttcgatccaactaaattagaagaaacagtgacagaattagcaaaagaaggagtagcagccggtttagaggaagaagatgctacttatatcgctgatttttacgggactaatgcccgacgtatctttgaattagcaaaagaaatggcaccttatcctggtttgagtctcgctgagtcagctcggttacgttatggtttagaagaagaaatggttttggccccaggcgattatctcattcgtcgtacaaatcatctgttgtttgaacgagatcagcttgatgagatcaagcaacctgtgatcgatgcaattgctggatattttgaatggacagaagaggagaaggcgcaacagactaaacgtttagaagcattgattgcagaatcagatctgcgggaactaaagggggagaaataaatgaacagtgatatgactcaaatcatgggggagtttattgggacactgatcctagttttgcttggagatggtgtgtgtgcggctgtgaatttaaacaaaagtaaagcacaggcttctggctggattgttatcgcatttggatggggactcgctgtaacaatggctgtctatatttctgggttcatgggcccagctcatttgaatcctgcagtctctctagctatggcaatgacaggggcaattagttggaatctcgtcgttcctttcatcattgcacaagttttaggagcttttgcaggggctattcttgtttggctttcttatttgccgcattggaatgcaacgaaagatgaaagcgcgattttaggaacgtttgcaacaggtcctgctatacggaattatctagcaaatgtgatcacagaattaattggtacatttgtattagttcttgggttgctagcttttggacaaaacgaatttgcgcctggaacgaacgtattcgctgtaggtggattaatcttggcaatcggtctttcattaggaggaccaacaggatatgcaatcaaccctgctcgggactttggtcctcgattagcacatgcggtattgccaatagctaataaaggaacttcagattgggcatattcatgggtaccaatcgcaggtccaatgatcggagcaattatcgcggtaggtgtctattcattaatggtgtaaatctataaaacatactaaagtttgacaaccaaaatgtgtcttgctatagttaagtggaaaataaataagacctagaagaatggggtatgttttgtgagtgtagctggtatctaatcagtaagtcgaatagacaataaacaaagtttatttggtgtgcttatgaaacggtacctgtcaggaaaacaatatctttgtattctaataaggataggacatgacttttttaagctgtgttctatccttttatttatctctaggcccttatttattttgtgataggtatctcttcaagaaaaggagagagtatgaacaacgaaatgattagtcaattacaatttgatcggatcaaaaaggaaattcaagcaagagcgattggaaactatagcaaaaaacgaatcagcgatatgacggtctcgacaaacctacaaactgtcttggatcgtcaagaagaaacaagagaagcacgcttgatcttagaaagcagtcagcatgttccatttatggggttgccgaggatcgatgcactgacagaacaagtcaaaaaagggttgattctgcagccaaccgatttgatcgaatatgcggattttcttagaagcagtcggatgatcacaaagttttttgataagaatcaataccagacacccttgttgtttgcttatagcaaacatcttcctgatttgataaatgtagaagagttgattgaccagaaaataaaaaataataaagtcagtgacgacgcgtcacgtaatttgcgtaaagtacgcaaacaattacaactaatcgaaaaagaaatccagtcaaaattactgaaattcttgcgtcatccgaaaaacaaagaaatgatccaagaagcaatgattgttcaaaaaggcgaatactatacgattcctatcaaagccagctataaaaataaaatagatggaacgattatcgatgaatcaaataaaagaacgacggtttttattgaaccaactgtgatttctaaattgaatgaacactatcagttgttaaaagctgaagaaatcagtgaagaatatcaagtcctggcggcattgactggtgctatcgcagaaaacggagaagtgatcgatttattgatcgaaacgatcacggtgttagatatcatctttgctcgggcaaaatttagccgagaaatcaatggaatcacacctagaatcaataaatcggaacatatcattatcaagcaaggcagacatccatttttacctgagcatgcggtaccattggatgttgaaatcggtaaagactatcgaggcttgattatcaccggagcaaatgccggaggcaaaacagtcgtgttgaagacagtcggtttattgactttgatggcgatgttcggtatgcaagttccggcaaaagaagggacagagcttgctgtctttgatgagattttcgtcgatgtcggtgaccaccaaaatttagaaaatgctttgagtacattttctggtcatatgcaaaacatcgctgctattttgaaaaagataaaaaggaatacgttggtacttttagatgagattggcagtggaacagagccaaatgaaggggctgcactagcgatcgcaatcatggaatctatgtatgagcaaggggcattgatcattgccacgacccattatggagaaatcaagaaattcgccggagatcatgaagattttgtgccggctgctatggctttcgatcgtgaagcacttcgtcctaaatatcagttgcgggttggagaaacaggagaaagccaagctttgtggattgctcataaaatggatatgtcgatgaaattgatccatcaagcagagcgttacttggcggaaaaagcctatcggacacagaaaaaagaatttcttcctaagacagcagttacaaataggaaggagaataaaaaagaacgccagctctttgcaaaaggtgatcggatatttgtcaatgaataccaaaaagaagcgttagtttatgaagatataggtgaagatacgattgatgtatatttagacaaaaaaataatccacgtgcctcgtcagcgtgttcgtctggtgtgttcagcagaagatctgtacccgacaggttacgatttagacagtctgtttatcgattataaaacacgtaaacggcagcgtgacctagagcgaggatcaaaaaaagctcataaagtactagtaaaagaaatgcgcaaacgacaggaagaaagaagagtaaacgatgaaaacagcaagtgattatctcaaattagctcataatatcagtggctgtaaagaaaaataaaaacagtgaaatcattggttttattccccgtgtaagctaaaataaaaagaaaagagtgctgaggaggtggggcgataaaatgaaattaagcacagactggcgtaaagaaatacaaacgattccgaatcttttatcgatattccgtatttttttgctgccgatttatctttattttgtgctgagacagtcattttatatagcaggagcggtcattgttgtctcaggtttgtcggattatctagatggggtcattgctcggagatataatcaggtaacagacttagggaaggtgcttgatccgtttgcagataaattgacacaactttttctgattttgtctatggcatggtatcgaccgtggctttggctgttgtttggtctattcttgataaaagaaggctttatgtttgtagctggattaatcgggctatctaaaaatatcaaattaagtggagcgaagtggtatggcaaagtagcgactgctgtcatctatgttggcatgatccttttgctgcttttcccagaattaccaacgctgtgggtgagagtcatttttgccgtcatcacttacggtcttttacaatcttttgtcttgtatgctgtcgagtaccgaaagatgtttcaaagaaaataaaaaaggggtgtgacctatgtcgcactccttttttgataaatagactcccagtagctacttctcgataataagccaaccaaaccaaaaacaggaaaagttgtttttgaaattattttttgtgattcggagttaaatggtaggctcacaacctcttggtaaacggtgttcaatcagctgaccttcggtattagctcaaaaaacggcaaaatatgagcagctatttttccgtttgtttctctaatactcaggtcaaaccgctgattttacaacctcttccttaaacggtgttcaaaagccagtttctcggtattaagccaaatttatgcaaaaatgtagaaagccattttcacaaaatttttcttaatactcgaaactaagcgactttttcacaatctcttccttaaacggtgttcaaaagcttgcatctgcggtaataagcccaaccaaacgaaaaatatgagaagctatttttgtttggctgttcttattacttgatgcaggatagcgttttcacgacctttgattcacggttttccagaagtagcttcttcgaaaaataagccgaaatttcttgaagctgatcacttctgtcgcaacctctactgactaaggcttgatataagcataaccttgggattgcagttcaactaaatcaaggacacctgctggtacaacgattacttgttcaggtaaagaactttctgaaatatgattagcacgcatagcattggcgcaagcgtgaaaaacgactccttgcaaatctaagaattctgcattggcagagtctagataaccggtaatcgcgatgccatttacagatacgacaatcgtcgtttctggagaagcttttatcaggttttttacgtttttccctgtttctgaccatttttctaattcatcaatatggaaaacgactttcattgaaatcattcctttactttttaataatcatcttgatcgcttgttctagtttagccgcttgttcttctggattactatcaggtttctcaaagcaatttttcagattatctgcaacgatcatgcccattacgcgatcaatactagaacgaacagcgcttaattgagtgatgacatccatacattctttttcgtcttcgatcattttttggataccacgaatttgtccctctgtacgtttcaaacggttcaggatatttttattatcaatctccataacacattctcctctatttttataattagataataccccttatcggtattttatgcaaatataaaaagtagtgaaaaaaataaagagtcattctggttgacatattaataaagctcctgtttaatataccccatgaggtatttataaaaatgtaaatgaggtgcagaaaatgaatttgctatttcaatcaataaaatcgataacagtcccagaattaaaggaaaagcttttggaaaatccagcgttacttgatgttagaacacctgcagaataccggggcgggcatataaaaggagctaaaaatgttccattacaaagtataaacagatatgatggagacaaagaaaagaccgtctatgtgatttgtcaatcagggatgaggagtaaacaagcagctaaagaattaaagaaatctggttatgatgtagtgaatgtacgtggtggcatgaatcaatggtttgatcgaacagtaggagggaaataagatgaaaatcgttattgtcggaggtgtagcaggtggaatgtctgctgctacacggcttcgccgattaatggaagatgcagaaatcgttgtttttgaaaaaggaccgtatgtttcttttgcaaattgcggcttgccttattatctttcgggagaaatcagtgaacgggaaaatcttcttgtccaaacgccagaatcattatccgctcgtttttgtttagatgtgcgtccaaatcatgaagtgacagccatctttcccgaaaacaaaacggtagaagtcgtacatgagggtcaaaaacacattgaacagtacgatgcattggttttatctcctggtgcaaaaccagttgttccatcgattccagggataacagaagccgacaatgttttttctattagaaatgtaccagatatcgataaagtgatgcatgcattagaaaaacagccaaagcgtgccgtgatcgttggtgcaggattcatcggattggaaatggcagaaaacctaaaaagaagaggtttagaagtcatggtgatcgaacaagcaccacatattcttccaacactggatgaagaaatggcagcttttatagaaaaagaattgtctcatcaaggagtagaagtgattacttctcatgctgtcgctggatttgaagaccacgggaaacgattgcgactggatgatgggcgtaccatccctgctgatttagttattttatccattggtgttcgtcctgataaccagctagcagtgaccgctggaatcgaattaggcatacgcgggggtatcctagtagacgaacgttatcaaacgaatattcctgatatttatgcggtgggggatgctatcgttgtaaaacagcaaatcactggaaaagatgcacttatttctcttgcttcaccagccaatcgtcaaggtagacaagttgcggacacgatttccggaatttctcgaagaaatcaaggcggtattggaacagcaattatacgaacgtttggaatgactgccgcatccaccggtttaagtgaaagaacagccaaagaaaacgaactgtcttttgaagtcattcatgtatcaggaaaagatcatgcaagctattatccagaagcaacagatattttactgaagttgatcttccatccagagactggcgagatttatggtgcacaaggtgttggggcaaaaggtgtggataaacggatcgatattttagcaacagcaatcaaagggcatttgacgatcttcgatttaccggaattagaattgacgtatgcaccgccatttggctcagccaaagatccagtaaacatgctaggatatgcagcaatgaacattgcagaagggcttagtgaaaccgtacaatggcatgaattgccgacagaactagcaaaaggaaaaattttattagatgtgcgaacagcagaagaattggaaaagggcaaattcaaggaagccaaacatatccctttgaatgaacttcgggaccgattaaatgaattagacagccaacaagaatatatcgtcagctgtcatagcggattacgtagctatctagcggaaagaatcttgaagcagtctggctaccacgtaaaaaaccttgatggtgcattttctttatatcaaactgtccgacctgaagaactgatatatcctaacaaatgatactcgttaaaaagcttgcattcgactcttaaaagaggtaaactaatcggttccaccactttgaaaaaagaggagaatgtgtatggtcaacacacaaaaacagttagaagaagcatatctgaagaacgtgtatcaaaagctaattgataaaaaaaacgaactgcgggaatcgatggatacggcaaaaatagaaggaaaccagtcgttgaaagaaatggctggcgagcttcgattgaattttgacagttacttagataacctggatactttttcgatgattgaaatgaaaaatagagaaatcgatcagatgaatatcaaacagaaaaacgcagaaaatcagctagcaaagatcgaacgtttattgaaaagtccctactttggaaaagtcgttgtagactttctggataatgagccaaaagaatccttttatatcggtacagcaaatttcacagatgatgcagatgaaaatcttgtttatgattggcgttcaccaattgccgaacttttttacaataacatgattggtccatcttcttatacggttcgtcaaaataaaatcgatacggttattaaagaaagacgacaatttcttttggaaagagatcgtttggtcaagttttttgatacgtctgtagctattcaagatgacgtattattagaagtcttaggccaagatgagaccaatgaaatgaaggctatcactgctacgatccaatcggaacaaaacacaatcattcgggatgtgaaaagtcaaaatatcttggtaaatggcgtagcaggaagtggtaaaacctctgctatcatgcagcgtattgcgtatctgctctatttatatcgagatacgatgacatccgatgacttgctgattctatcacctaatcatcggtttatcgactatatttcgaatgtcctaccatcattaggtgaaagaaatccactgaatctaaccatcatacagctggtttcacagctttcagcagaggaaatagaaggtgaagaggcttatttcaaacgtatcacgggagaaaatgtatcggagcagacagaacgtttgcgtagcaaaaagtttatcgataatctaaaacaatcagatcctttgtttttagatcatccgaattttatccgtggacttactaaaaatggaaaaacagtcctttctaaaaaaacgatcgaaaaaatatatgagaaagttcctgctcatcctaaattgatcgataggcttcaagcaacgaaaaaggcactgatgagcgaatggaagaatcatcttttgaaacaagcaaaaagtcctgctgtgcagaatcaggtactctcgttgacagaagataggcagttggaattattcggtaaattgatttctgatgattcggaacaaagtattgtagcttatgcaaggaaacttttacaaaaaaaatatcgaaaaataaccagacaaatcgaagaaatggcatgggtggatgagcatcagttgtttgaaagaatttatgaaaaacgatatggctcagcttatgtttggcaacccacacgtactgttgatgaagcagtcattatattagctattcgtcatttacttgttgaaaaggtaaatgtaccagcatttcgctatctattgattgatgaagtacaagattataccctggcacaattaggtctattgatcgaattatttccaaaaactcactttactttagtaggtgacgagaatcaggcaatctttaattcttccactacttttgctgatattatgcgttgtttcgacgactaccatctgccgatccatcggtatgatcttagaaatagttaccgttctagcggagcaatcacagagcttttcaaaacctatgctgtggatcaagagaagatcgacatcgtatcgatccgaccgcaaggaaaagaacccgaataccgctcttttcgatcctctgaagaattgttgaaaatactagctgagattttggtttctctaaaaggagaaaaagcggcagttatcacccaaacagaagaggaaacccaaacgctacaagaatcgattaaaaaaaattcatatggattagaaaactgccaaatcattcctttgagtctagcaaaaggactggaatttgatcatgtaatcttatatccatttgaaaacgatggagatgagcaaagaagacgcagacaaatgtacacggcgatatctagaggaatgaaaagcattgtcgtattagaaagagcaacataattaagagataaaaaataaaaagaacaactgataaaaagaacaaaatatttttcatttgctgatgagaaatgttttgttctttttcttaggaaaaatttaggaacactttatgtgaaaagaaatgaaatgtatggtaaactcctacgtcgtaacaaaaaaacgtgaggtgaggatatgaaaaaagtaacaagagaagaagttgcatcaattttggtgaaagataagtatttttcaaaaggtaattactggttaaagatttggcaaacgttagtggctcttttaggatggatgatcgttgttcttccttttatatgggtctttttcccattaacgagaccagaaagagccaaggatttttccttgtacgcttttttatcagaaaagaaaatgctgtatttcttaatcggcttttttgtattgatttttttcagtttcctgattaccttatgcccatatttctcccgaagtgaaaaaaagatcaatgaatcaactagaaaactatatagaagagcaaataaaaaagcactcaaattgagtgcttttttaagctcactatcactaaaactatcactaattttatttataagcgaacatgtttctatcactgattttttaaatctagcgaaaaacccttatcttaaaggcgttcgttcaattctttggcaaggtcttcaaagcctggcttgcctagaagtgcgaacatggttttcttatagctcatgtagaaaaattttcttgatgatgattttatccatcaattgagattgactgttttgctctcctatgatttcagctatgattgtccgattttgcggttttcttcttaactggtagttgattttcccagtttccatcaactcgctaagcatatccacgactccgccaaatccggtctttttcgtaataaaacctagtgctaccattcgttcatctagattttttgctgtaatcgtcacaccagtaatgagcgagtgctgtaatgtttgggccagctcttccatcccttcagcattggatacgacggaagctgttttgttaataggttcttcgtttatttcttttggttctttcctctccactttcactgtttgacgaaggacatctagttcttgcaagagcgtttcgtattgttcttgggtcagcatcacgccagctactttttcacgattaaatatatatacgccagttcccgcgtctcgcgcttgagcaaatacatccatcggcgatcgtttcacttctgtgatcgaagatgtgggaacttctaatttctttaattccaatggatttcctcctttactaatcgctttttattatagcacagactgacttgttttgatcttttttccaaaggttttatcggtttttgcctaaccagtaattgatatcggtaagaagtctttcgataccaaatgaaggatggtacagatacgttttttgatcttcgttatggtctagtggaaaaaaatgatcggtgatcactagatctgcataccgaggcggcttatttcgagtacatacatgtatagagatccgttttcgatgtcttagcgttttgttcagtaccccagcaagtcttcttgcttcttggtgttcatagcgaaaaaaaaagacgattttcacttcaggaggatggacatctaaataccctcgttcctggagtgttttcagtaaaagcatcccccactctactgcggggtgtgcaagtgcttgttggatcgctagccgaaattgatatagtttatctttggaattgggaaatttttctaatgtttcctgataataacgaacttcttctatcagccggtcatggataccaattacgtaacgaagccattcttggtaaagtacttttgtcagctttgatttgctttcgctctcaaattcgctattcagccaaaacagcgaatcaagcttttcagtcacaatcgtcaatttccgatagtcttgtgtctcttctatccgtttccaccgcttttcagtaatctggttacagctcaagcgcaaaattgctagataatttttttcttttattggcaaaatctgctcctctctaaatagcaattcaggaaacaattcaaagaatagtgttcgactgtctcctaaaatctcgatttctgccggatcctttctttgcttcaataattggatgaacatctcagaaaaggactgctctccatcatctgcaaaaaaatgcggaaaatctttcaaaaagcaaaacagcagatatcttacttttctttctgaaccaaagatctgttcttttttataagaaaaagaaaggtggtactcgccaaaccactttctcaatcgctcttgcgtagaacgatcgtacttctgctcgtaaggttcattcaatagcagatttttcagtaaacaaaacgggggtgattggatcagaaaaacaaacaagagataaggttcgctatattcttgatcataaactaactgaacggttttcttatgaagaatcagctgaatgggacagtcgctttccgccaaacgtttcagatgccgatccactgttttaacatcgattttcagttcttcagctaaatcagcttttcgccagatcaaatctttcattagattgattagtgaaaataaattctgtgcattttttgataatagtttttgccatctcatcgatcatttctcacctgatttctaaacatattgtttgatcaaaatgggttcactcctaaaaagataaaaaactccctttctatttatttaaatacgcaaatcttcctcattattttttattttactcaatttaatcgtattctcatttcaaaacgaatgtactttaaaaaaacataataagatcactttgcttgtaggatgtattcccttccattacaatgaaataaatagtgattttatgagaaggtgatgtgaaaatggaagaaaaaatagaagaatccaaacaaaaaatcgatcagttgatataagaattagaaaaagcggtcatcggcaaacgttcaactatccaattgatgatcgtggccctattagcaggtggtcatgtcttattcgaagatattcccggtgtaggtaaaacgttactggtcaaagcactagcaaaagctgtacagggaaccttcagcagagtccaatgtactcctgatctgctgcctagtgatattcttggtttttccgtatacaattcacaatcaaaagagtttgaatttcgtccgggaccgatctttaccacgatcttgttggcagatgagatcaatcgtacgactcctcgtactcagtcagcacttttagaagcaatggccgagaatcatgcaacgatcgacaacaatacataccctctagacaatcatttttttgtcttagctacgcaaaatccaatcgagtacgaaggaacatatcctttgccggaagcacagctcgatcgttttttattccgactacaaatcggttatccttcttttgatgacgaacttttgctacttttggataaattcgaaaaagtgttggataacttaaatgaagtattgaacagttatgaaatagaagaaataaaaacaaatgtggcgaatgtctttgtcagtcccgaagtggcatcttatgccttgcagttagtgtcagcaacaagaagtcatgctgccatccagcttggcatcagtccacgaggaagcctttcctttattcaggcagcaaaagcttatgctttaatccatgggagaaattacgtcacgcccaaagatttgcaggatttagttccttacgtgttttcccatcgcctgattttttacgatcgttcattgaaggaagacgaaaagaaacaaatcattcatactcttgttgcacaaattcctattcctgtgaggtagattgaggtagacaatggaaaaaatcaaagattatttcattaattttgtgttatttctggtatatttcatcattgtgctttttgctcttgtattcaacaattctttaggctggttcttgttggccttttttactctttatgtatcatggagcttgatttcattaagcagctttctaaagaaactttcggttacttgtacattgcagccactcgtttatcgcaaaaaaagtatgcaggttattttttccatagcaaaaaagagaactttttctttacctctccctcgtttacaaatcggcttcccagcaatctttgcagaaaaaaacaagagattttgattcttataaataaaccgcaagaagtccaattgctttggcagccaaaagaaagaggatgccatgaaacattaactgtcatttttacagcctatgatagtctaggacttttcagaaaaagtgcaaaaagagagatctcttttcctgtgactgttctgcctgctttttgtaagattcaagcagaaaaattacagagagttctggaaaaaaaacagcagctgaacgcgtaccaaagaggtcttgattttcgggaacatcgcgcttatcgtccaggtgattctttcaaccgaatcgattggaaattgtctgctcatactcaagagtggttataccgtgaatacgattatcaagaagaagaatgttctcctcttttttgcttttggggttcgcccagtccaaaatttgaacctctgctagacttgtatttttctttatggcatttgagaaaagaaaagcagccggaacttctgatattaggcaaccgcgcctttcatggcaaagaccccggtcatacctattttgcttctttggaagctggcgatgagaaagcttttttcgcacacttgaaaaaatatgcaaaaaaacaaatcgtcctctttgttcctgagaattctcctgaagtctcagaagctattgaaacattgtcaaaagatcgaacggtttatcttgtttatttcgtagaaaaacaactcatggtccaagaaaaagacaagatatgttcattgccaggaggtgaatggattgacgattaaacgggaaaaatggctgcgtggcgtttactcctttgtgatactaagtgtaggtgctccgatatttgtagtagctaatcaattgcaaaacagctaccttcttatcctaactattggtgtcctatgccttattgtctgctgtattcctaaaaaatgggtacgtttgctgctttctttgccagtaatgataggttgtttgtttttatattttccttcgaagacattttccatattatggatcttacagtttttttcgtcagtcacagaggaattcttccatctatcccaaggtaaactttattatttgccagaaaagacagctttttttctcataatgttgctgatctatttatttattacattgaccgtggattacgactattggtacgcaccctttctttctttgatggcttacttcatgatgcttaccgtttttcggaaaaaagatttactgtacgaaatgattgcggtagtaactgttttgttcgtgtatctggcagcaaggcaatttttctccatccggttgttgtcgggaaacactcgattccagtcattgactacagttctgcttatttgtttcttaacttttagcgctatcttgcctttatatcttccgaaagtacaccaatctctcgaggaaacgagtgaaccgatccgagaatatcttaatgatgaagggctttatgatacactccatgagtatcaattaaccggaagtgcaagaacaggcttcagtgagaatgatgaacagcttggtggacctttatatgataatggcgaagttgtttttacagcgaaccaaaaaggaaatggctattggaagatcgaaaataaaaatcattacaccggttctggatggatagaagatcaggacgcacccatccaaccaatccaagaattccctgttgacatcacgagctaccaaaccgttatagaagacaaagaaaacattacattgaccctaaaaaaacaagctttcttaccttatccttatggaaatactaccttgactgatttttcattagctagtggacaaacgctttactatttgcctgaaagccagagattcattcctgtcccgaatgaatcgacacgttctgcaactttacaaacagaaaggttagtttttacgagagaagaattaaaaagcagtcagttaaaagctgatgatttagaaaatcagcagacaaatcttcaattgccaaaaagtttgcctaaacgtattgaggacttggcggtcgaattgaccaaaaatgaagcaactttaattcgtaaagtcgaagctgtctaacagtatttaaaaacaagcggaaatttccgctattccaaaacggataccgggcatactccaaaagaacacgattatgtggattatttcctctttgattcaaaagtcggctattgtgacaacttttcaacttctatggtcgtccttcttcgaacacttggtatcccagctcgctggacaaaaggttttacaaatgggctcagaacaggcacagataatcaagggaatgaggaatacagcattctcaatagtcatgctcattcttggccagaggtatactttcctggatttggctggcttccatttgaaccaaccccttcatttgccaatccaatgggttcacaaccagttgctgaaacaaccgaaaccgtccagcctgctatcgaacaaccaaatgaaagcgaaaatatggcagaaactatttccagtgagagatctgaggtcattccatcagaagaaacaacactcacaccagcttataaaatcgtcttattcagccttggagtgtgtttatccgtcttgttgttctttctattgttattcagaaaatctctgcgctggacaagttatcttatctatcttcattttttttgcttctactaatacgattgcatatcaaaaacttcttaaccctttggaaacattggtaccgcgcaaacccgcagaatctttgcaggaatatagcctgcgaatagaacaagaattcaagctagatctgcgtttcattcgattaactactcaatatgaagcagaaatatatggacgacaagcagatccggtaaaattcgataaaaaaacctatttagaaataacgcatataataagaaaaacggtatacaaaaaaattctgacaaaagggagccgcttcaaaaaataagataaaatttctggagaatctacttctcgaatgccgagaaccagctgattgagtatcgattactcgaaaaaaaggttgtgacacgttttttgtcacaaccttttttcattattatttgattttcaatgtcaaagcatttagagctacaactaccgtacttaacgacatcaagacagcaccaactgctggacttaatatgataccaattggcgcaagaattccggctgctagcggaattgcaagaatattgtaacctgccccccaccagaggttctggatcattttctttcgcgtttgcttggctagatcaagaaaatgcaaaatatcttttggatcgctgtttgtcaatacgacatccgcagaatcgattgcgatatctgtccctgcaccgattgccatcccgattgaagcacgggctaaacttggcgcatcattgatcccatcacccaccatgattacttttttcccttggtcaaggtatttctggacaacagcttctttatcatctggtaataaaccgccataatattcttcgatccctaaataatctgctactgcttgggcagcgtttttattgtcaccagtaagcatgacaggagtgatttttctttctttcaatgttcggataaattcttttgcttctgtttttactacgtcacctaaagcaacgattgcagctagatgattttctaaaatcaggaagctgatggtatttccttgttcttggtaaggtttcaataatgcttgttctacgtttaatccgagacgctcaacttctttttcattaactattttcacttgttgttttttgactgttgcctctagcccgactcctgaaagattttttagattttcagcttgataaggcttgatttcatgttctttcaaataattcataatgccaacagccaatggatgattggcattcgcttccaaggctcctagatattgaaggatttcatttttattgaacgcatcatcaagtacttcgacacccgttacagtaaattttccttctgttagtgttcctgttttgtccagcatgatcacatctagatcattggcttgctccagtgcattgcggtttttcaaaagtaatccgtttttagctgctattgatgtggagcgagcaacaactaatgggatagctaaacctagagcatgaggacaggcgatgataaagactgttaccatacgttctaatgcattaggaagatctgtcaagaacaaccaggcgatgaatgccaggatacccacaattaatgcgacataaaacagccattttgccactttgtcagataatgactctagcttggatttttctccttgtgcttttcgcaccatttccataaccttcgctagataaccattttcaccagttccagttacttcgatttcgatcgttccatccccattgatagaaccgccaatcactttgtcattggcttgttttttgattcctcttgattcgccagtcacagctgattcgtcaacaattgtttcacctttcaagattacaccatctgttggcattttatcaccagaccggacgatcaaacgatcaccttcgtttacttctttcaatgaaactgtctcttcttttccatctttcgtcaagcgtttcactgattctggcagtaattctgctagtttttgtaaagcattgctggcattcgacacagcattcatttcaatccagtgacctagtagcataataacgatcaaagtagccaattcccagaagaaatccatgacgtgtgtatgtggattgagcagatttgcgataaacgaatagacactataaatatatgcaactgtaatccccatcgcgatcagtgtcatcatagcaggacttttttgtttcaattccatcttagctccacttaaaaatggctgaccgccatagataaatagtatagttgctaagatcaatacgagccaatcagaaccaggaaacgttacttgaaatggaaattccattcccatcattggtgaaaaaagaatgattgggatagctaggataagcgatagccaaaatttttgtttgaaattccccatgtgcatggaatgatccatgccgccgtgttcgtgatccatgtgcatcgaatggtccatttgtttgctgtttgctatatctccatggttatgtcccatgtgcatggaatgatccatctgactatggtcatgtttcatctccatctgtttttcatgagattctgtactttctttgtttactacttcttttttatgctcatgttttttctccatatcgttcccattcatttttactccatcccttctcttactttttcatgtgtcgatttaagctcagggagttcaacaatacactgacggaactaaacgccatcgctcctcctgcaatgattggattcaaaaagcctagtgcggcaaaaggaataccaatcgtattatagacaaaagcccagaaaagattttgtttgatttttctcaatgtcaacctagacaactcgattgtttgtgcaatggatgccaaactgctattcatcagcgtcacatcggctgtttccatcgcaatgtccgttccacttcccattgccataccgacatcagctaatgctaaggccggtgcatcattgattccatcgcctgccataccgacttttttgccatctttctgaagtttttctacgtaggctgctttatcctctggaagtacttcagcaaagatatgctttggatcaataccaacttgtttaccaatcgtttcggctgccagtttgttgtctcctgtcagcataaaaacatctaatcctttattctggagctgcttgattgcttgtttggcttctagtttgatttgatcagccacggcaatcaacccgatcacttgcttttcatcagctaaaaacatgactgtttttccctgctgttctaattctaacgcgtgttcttggtattcatcaaatgataggttcaattcaattaatcgtttacgtgtacccgcaaaatagcgtactccattaatcgtaccgctgatcccagcacctgggtgggctgtaaaatcaatcatatcgtatgttgctgcttcttgcagttttccgtattccacgattgctttacctagtggatgttcagaagcttgttctaaagtataaaaaatagataggacttctttagaaccgactagatctgtaactttgggctttccttctgtaatcgttccagttttatccaaaacaatgctgtctaagtgagcagctgcttctaatgcttctccgcctttaattaaaattccatttcgtgcaccaacacccgttcctaccataatagctgttggagtcgctaaacctaatgcacatggacacgcaatgactaatacagagacactatggatcaatgcgagttgccaatcaccagtgatcaaacctgtagctatgagcgtgataaacgcgatgactaatacgatcggaacaaaaatccctgagatccgatctgcgattttttggattggtgctttgctcccttgagcatcttccaccatttgaatgatttgcgctaatactgtctgcttgccgacttgtgtgacttccatgtgtagcagaccattcgtattgattgtcccgccaaaaagcgcgtcatccggattcttttctacaggaagattttcaccagtaagcatactttcatctatcgcactgcttcctgaaataattcgaccatctgctggaatctgctcaccaggacggatgactagttgatcaccaacgactacttcttcaatcgctaacgtttcttctttcccgtttcttatcacttgggcggtttttgtttgaagagacatcaattgtttgattgcattacctgttttcgtttttgctgtatgttccaaatatttgccgagcaaaatcagcgtgatgatcatactgctgctttcaaaataaagatcttgggggtgtccacggaaaaatccgttgtaaatgctcaatgcaaaggcagccgatgttccaattgctaccaatacatccatatttggtgctttcgtcttgattgcatggtacgcacctttataaaaacgagcaccgacataaaattggacaggagcagacagcactaactggacgattggaaaatgaaaaaagtgaacaatcgccgcatggcttcctaacatcatagcaatcattgacaacatcaacggcaaagtcaaaaccgtactcaatataagatcgaatagcatttttttcaaatacgcttgcttttcttctgcaattttttgtttgtgggcttcatcgtacaaaattgcaccatagccgatgttttctacgctttggattaatttttcagtggtcgtcccttcatatttgacacttgctttttcagtggccaagttgactgtggcattgaccacaccaggttgtccgttcagctctttttcgattctagcagaacaatttgcacaagtcatacctgtaatgacgaacgtatccattttggtttctgctgttgccatcaaatcacctctgctttataacccaatccattgattgcttgacaaatcttttcggattgaacttttgtttcatcaaacttgaccgtaccgtttgcttttttcaaatttactttcactttttgcacgccgtcaagtgcgcttactgtttcttctactcttgctgcacaatgattgcagctcataccttcgattgaaaattgttgtttcattttttcttcctcctattgatgttgtttacattcacattgacctgggatacagttacattcgatcgtatctactggttgcttttgttccagttgtttcaaaatctcattgatatcttcttgagtcaaagtggcttcttctactagatccgcaatcgtctctccaatcctttttgcacagatatgggaaaaaagattttccgtcgcactgcgaactgtttccatctccgagacagctggatgataaatgaatttttttccttcttgttctgtccagatcacttctttttttaccaaacgtcccagcaaagttttgatcgttgctggtttccaatccatcgaatcagctaagatctgcgtgatttcttgggctgtcgtctgtccaagtgtccaaataacacgcatgatctcccactctgaatcactgatctttactggcgttttgactttttccatttatttcacacctttcatttacaaatgtaatcaataacttatggatacagattacacttgtaaacaaaaactgtcaattatttttgctctctattttcaatttagttaaaaattcttgtttttcccctcttgttttaaggataatcagtttgttttgtgcatggttttcttggatcagctgctgtatttcgggttcatgggtttcttcaaaatgccagatgaaagacagaaattccagatattccttatcgaatctttctgaaaatgtctcaggcatatctggtcgggtcttcttgtttatctttcttttgagggaacgtaaaatcactcgataaatcgcccggcaacgcggaacttgtagccaaatgatcttatctgcttctttaatcctctttcctagtgtagaagtatagtttccttcaatgatccatgaatgattagtctccataaatgattgctgttgttgtatgaaccacttttttgcttggatgctgtaatctgtcgtatgccataaaaggtctagcggcagtagcggaaagccggtgatttctttgatcttccttgcgagggtcgattttcccgacccactttgtccaatcacgatgatcttcattcttctccctcacttctcttatcattttgatttgatcataccacttataacgccgcaaaaaaacaagggactgtgacaaaagtcgtgtcaaagtcccttgtttcgaataaatggtgttcaatcagctgaccttcagcattagctcaaaaagcggcaaaatatgaggagctatttttccgtttgtttctctaatactcaggtcaaatcgctgattttacaacctcttccttaaacggtgttcaaaagcttgcatctgcggtaataagcccagccaaacgaaaaatatgaggggctatttttgtttggctgttcttattacttgatgcaggacagctttttcacaacctcttgtaacaagtatttctattttaaggctgaaccactgtttctggttcagtgatttctttgtttttgtctcgacgagcaattgctggcaagatcatacctaataagatcaagacgattggtgtgatgatattcgtgaataattggaaccaccatgctttaggatcagcagtataatctacttttggcaccattcctaggatacatgcaaacgcagtgaaggcaaagcaccaagcaccaaagataaaaccgatttttggatttttaacaaatttatattcagaattgaatttcttataagctttattcaacatcatatatgccaagaacacccataggtaacgcattggcatgacaactgagttcaagttcgtcaaccattttactaattcattcatatctttgataccaaagatcggcaacaaaataatgattcctactagtatacctgtcagaagataaccattcaccaatgtacctttacgattacgtttacgtagccagtttggtacaaattctggatccgcatctgctaacaagatttttagtggtgcatcaattgaaaaggctaatgcggagatttgtccaatcatgtttgtcaatgcgtaaatgatcatcaatgagttaccgataccatagtaattacctaaaatttgaaaagcactgtatgccccatttgccatcaagtctttaggaatattatcgctagcaaacagcatacccattgcgactgagcctaatacagcacaaatccctaccattgctgctaagaagatcatccctttaggaaattcctttgcaggatttcttgtagagttgacataaggggatattttttccgctcctccaactgcaaatactagcatcgaaacggttgtgaaataactgaaatcaaatgttggaatatatgttttcacttgattcatatgtggtgtggcaaattccatcgttggattgatgaacggtgccgttacagctaaaagaataaataagatcgacatgacgaacatcgctgttccggccagtccaccaatcactttcaaagtagaaagtccttttgttgataaatataaaaaggcaagaaatataataagtgaaataactgctaccatttgtactgacatcgtatttacgatatttccatttccttggactgcccaaccgccagcaatcaggattgcttgaggcttttgtgccaaataaggaatatggacgacccagtaagtccaagcggcatagtatgccagtcgtttattagatgtcgtattttcgacccatgaactgacgcctcctttactatccttgaaggctgatcctaattgtccaacgatcaatgcgtatggaataaaataaatggccaaaatcaatagccaagaggtgacaactgatactccttgctgagcatagttattaactacattccccatgccccaaaccatgttaaatgcaattaacgcaacagtaaaccagcgtaattgtttgttgttcattcgttctctcctttatgataaaaatttgttatccagatgtaatcatattcaatttttaacaaacttacaagacagtgttattttatgtgtgtattcttttatttaatacacatcgttttttcatattttttccatcaaaaaaataagttattttcttttatttcattgaccttattgaatttcaagctattttgaattttctgcaaaattaaaaacattagttattttataatcttatctattttctttacatttttcattaagaaaaggatataaaaaaaagaggacgttcattcgtcctcttcattgatcaacgtttattttttacatgcaagcttcgcatggcattcaaaacagctaatactgtcaccccaacatctgcaaatactgcatctcccattgatgcaaaaccaaaagcacctaaggcaagtaccaaaatttttatcccaatagcaaagacaatgttctgtttgacgattttcaatgttttctttgctaaatggattgcttctgcaatcttcgatggttgatcattcatgatgactacatctgctgcttcaattgcagcatcgcttcccaatccacccattgcgattcctacatctgctcttgctagcaccggtgcatcgttgattccatctccgacaaatgcggtctttttattgtttctttgtaagatttcctctaaccgctgcactttatcttctggaagcaattcgctatatatcttgtccacgcctacttgcttcccgatatgatcagcaatttttttcgagtcgcccgtcaacatgactgtgttcttcacaccagcctgttttaattgaaccaatgcgtctacggcatcttctttcaaggtatctgcaataacaagataaccactgtaactttgatcgatcgctagataaagcaatgtaccgatttcttgacttgaaggaaaagagatttcaaatctttccatcaatttgtgattacctactaatacttgtttgccatcaacttcagctaagatcccttcacctgcaaattcttggatattagttgttggtaaaagcggacctgcgtagccttctaaaacagattgagcaatcggatgtgtagaaaactgttctgcactcgcaacatattgcatgaatatctttggatcgatttttgtatcgatcgtctggatcgaaaagtcacctttcgttaatgtgccggttttatcgaataccactgtctcagtttgtgcaagcaactccaagtaatttgaaccttttactaatacaccgattttacttgctcctccgataccgccaaagaaactaagtggcacggaaatcactaatgcacatggacatgagatcactaaaaatgtcaatgctcgatagatccattcagaaaacgccgctccagaaacaacaagtggaggtaaaacagctaataaaacggccaatcctacaacgactggtgtgtaatagcgcgcgaatttagtaatgaaattttcagctggtgcttttttactgctggcattttctactaattctaataatttgctgatagtagaattttcataagatttttctacttgaactaaaaatggtttatttttattgataaatccgcttaatactgtttcaccaacatatacagatttagggactgattctcctgtaagtgctgacgtatcgactaatgattctccttcgatgatcgttccatctaacggtacacgttcaccaggcttcacaagtacaaactgaccgatctgcacgtcttcagggttcacggtcatcaatccttccgccgtctgcacgtgagctgtttctggacggatcgccatcaattcgcgaatcgattttcttgaatgactgactgccaatccttggaaatactcgccgatttgataaaatagcatcactgctacggcttctggatattcaccgatcaacatagcgccaatcgtagcaacagacataagaaaattctcatcaaagatttttcctttgacgatattcatcactgccttcttcactacatcatatcctatcagcagataaatcaataaataccctatcaagcgaattggttcattaaaatcaaataatagcaataaagcgatacctgcaagggaaaataaaatccggaacagcgtatttctctctttttcatttccatgttcagatactttttccttatctatttctgttactttgacatctggttctaattccttcactactttttttgtttcttgttcaatcgtagccaaatgatcttcctctgcgtcaatcgttagttttccagaagtgaagtttaccgttgcttccttgactccattgattttctgaactcctttttcgattttcattgcacagttcgcacaatctaaaccttctaatctgtaacttttcattttaatgacctcctcgcctcaacatatgaatatctcttcataactaattataaatgaatggttattcatatgtcaaggtatccgaaagaaaaaatgaaaaacatctgcatcggaaaatttcttccatacagatgttttggcttattctttctttttcttttcgatcattgccactgctcttatccaacccgcacttgccttcttgatcttgacaggatagcaactaagtttgaagcctgttgctggcaatttgtctaaattcattaatttttcgataggacaatatcttttttcaatccctgcaaaatgtccttcccagatattcgaagctccactacgctttcaaaaatatagaaagagttctttaatgaaaattatttcaactttccataaacagtaatcccatataaataaaagacgtaaaagtcacatggaagaacttatacaggaaaacgcatagagtcaggtgaaatacatgtatcccacctgactctatgcgttatctaacctttattattctcttttatacaatttctgcaccgaatggcatcaacgccaatcgagcaagtttgaaagattgcttggcaaaaggtatccctatgatcgtgatacatagaaggatgccgctgacgacatgtgcgagagcaattggtaggcctgaaacgatcagccagatgatattaacgatcaatgacatgccagactggtgataaattacttctttgccaaaaggcgcaaaagaaagggaggcgatcttaaaacattgcataccgattgggatacctatgatcgtgatacaccaaagtatccccgctgctaaccagctaagaccaccgattagtccgccgaatataaaccagatgacatttcctaaacaactcattgtatttctccttctattactgtttttgattaaaactgggcaaaaattgattttattcttctttttttagcttccagcatcaagtattctgcaaattttttttggatttctttcgtattttcttttgttactaatgtgtgttggattagttttcctgatggtcgctgatccaatcgttcttctgactgttgcacgtccgcttgcgcaaatccgataatctgtttttcttttgttacagcaatgagcaatagtttattcttatcatttaggtcagctgccgtttttgcttttacgaatgattctggatgatcagtaatcagctgattgatttgaggtaaatcttcttttactgcccaccttatttccatcatttttcacttttctttcgctcatttttatctccactaaaaaaatcgactgcggcaattgcatctatccagctttgtgcaatgatctcatgtccgccaatcgttgggtggaccccatcttctcttgtatatttcgaaaaaccataagcaatccctaaagcattgaatataccatctaaaggaaccagcaatgcgccatattccttagcaagtttacgaacaatttggattttagggtctaagtctttacgccagccatgacggtcgtcggttataggaagtacaaacggctccatcaagatgatgttgcagattcccgctttttgaagttcatttagtaattttcgataaacggattcaaattgctgagcagatttctcagttccgaatatagcctgatcgctagtattatgccaggtatcattgattccgatcaaaatcgatacatagtcaggttgtaaagctaaacaatcttcttgccagcgtacttgcagatctgcaattttgtctcctcctatcccacggttcacgcattcaaattccatcgttggatattgggagattagttttccggcaatcaaaagtggataacctttacctagatcagttgcttctgctcggtctcttcctgcgtctgtaatgctatcaccgataaataatatacgttttttcatttgtcaaaaactcctttttgaataaaacgatgattttcttccttatattatcccataagccctatcaagatgaaagagaaaatatatgtataaaaaatgacaccagcctagtcccttcaaacaattgaatgaacgctcatcaagtgtctagttttttatgctatttttttcttaacgtgccggattccccttgattccttcgttgtttggtccagagagatcgatcatacccaagcttccgtcaatcagaccactgatgacgccatcaaaacatatatttataggctcatctaagacttctagtaaatgtccctttactactatctcttctagattgcttgggatagattggtcataactttatctggtccgatgatttcaagggtgaattgaacttacatatggattattgcatgctgaaaatacggacctactccatcttcgaatgttactattagtttgttttcaggtgctagatgctgctttatttcaacagcagaagcatcatcaaatcagatttccatttgaattaccttctttgtaaatgtttgattgattgcgatttcgttatagaaccttgtgaatcaaatagcaatttcttttgctttcttctcttgtctgctggaaacttcctttatcccgtatttaaaaaaaagaactgcgagagttcgcagttcttttttttaaataaacgttgctctccggccaactcctcggtcacaagtcacaatagtcatcaaacatgaaaaactgttttttgaaattactccttgtgactcggagctgaacggcaggcgcacaacctcttgatataaacggtattcaaaagcttacatctgcggtaataagttccgccaattcaaaaacatgaacagctgtttttgcttggctgttctaattacttgatgcagaacagctttttcatcacctcttatggataaattcggttcaacaaacgtgggaatggaatagcttcacgcacatggtcgataccagcaatccaagtgactgttcgttcaaggcctagaccaaaaccagagtgcggaacagaaccgtatttacgtagatcaagataccatgaatattctttttcatccaaaccgtgattacggatttgttctagcaagaaatcatagtccgttgcccgttcgcttccgccaataatttcaccgtaaccttctggtgcgatcatatctgcacaaattaccacgtcttctcttgttggatgtggtttcatgtagaatggcttgatagcttttggatagtttaggataaagacaggctgttcgaatgaattcgcaatgaacgtttcatgaggtgaaccaaagtcttcgccccattcgatgtcatcaaatccatttttcttcagtaattcgatcgcatcatcataagtaatacgagggaatggcaattttgtataagtttttaagacttctttgtctcgtcctagtacatctaatgcgtattcgcaatgatctaaaacattttgtactaagaatgctacatattgttcctgtacttctaaactttcttcttgatgagtgaaagccatttctggttcgatcatccagaattcaatcaaatgacgtcgtgtttttgatttttcagcacggaaagtcggaccgaatgaaaagacttttccgaaagccatagcagcagcttccatgtataattggccactttgagataaataagctttttgatcaaagtaatttgtttcgaatagatccgtagtgccttctggtgcggaaccagtcaagatcggcggatcgattttgacaaaatgatgttgattaaagaattcatacgttgcacgaatgatttcatttctgatctgcataatcgcatgttgtcttgaagaacgtagccataaatgacgatgatccatcaagaagtctgttccgtgttcttttggtgtgatcggataatcgtggctctcgcttaccacttccacatttgtaattccgatttcataaccaaattttgaacggctgtcttcacggatttctccagttactaacacggatgtttcttggtgcagatttttagctgtttggaaaacttcttccggcacttcgctttttacaactacaccttggaaaaaggctgttccgtctcttaattgtaaaaatgcgatttttccgcttgatcgcttatttgcgacccaagcgccgattgttactgtttctcccacatggtttttcgaatcgatgatttgaatttgttccacgtatgactctccttttatattccttgaatttcttcaggattaattttgacttttactctcaataaattgcttgattctgcgtaccgcttcttctaacgtagcgcgatcagtggcataactcatgcggacattttctggtgccccaaagccttcgccagtcacaagcgctacccctgtttcttctaaaagatcttctacccattgtgtgacattttcatatttacacatgcgtagcgtttcttttacattaggaaaaagataaaaagctccttgtggcttttcaagagaaacacccggcagttctgccacaagcggatataacgtattcaggcgttcttcaaaggcgttccgcatttcttccactgtatcttgctcgcctttcaatgcttcaacagctgcatattgactgactgctgtcggattgctagttgattgggaagcaacagcgatcattccattgatgatcacaggatttcccaccgcataaccaatgcgccagcctgtcatcgcatatgttttagacacgccgttgatgatgatggtctgatttttgattgcttctgaaatcgttgcaattggagtaaactcattgccattataaactaaacggccataaatatcatcagcaactatcaaaatatcattttttactgcccattcaccgattgcctgcagttcattcttgctataaatcattccagtcggattcgatggagaattgatgattacggcttttgttttttctgaacgtgcttgttctagctgctcaacagtaactttccagctattggattcttcccctttcaaaaagacaggaagtccttctgccagttttacttgctcaccgtaactgacccagtaaggcacaggaatgatgacttcatcttgcgggtcaaggatcgtttggaaaagggtatacaaagcaaatttcgctccgtctgttacgactgtttgtgaaggttcatagacaagtccatagtttttcttcagataatcaacgattgcctgtcgaagctctgggattcctgctgttggtgtataatagctagctttcccattgcggattgcttcgattgctgcttcttggatgttttctggtgtcgcaaaatccggttctcccacagtcaaactcagcacatctctgcctttggcttttaatgccttggcctttgccgcagctgccaaagtgacagacggttctaatcgttttgttctttttgataactccatcccattcattcctttaccttttaaattcccttgattgtcttgacttcatctccagattcaaagccaatcaggtaataattcagtttcccatttgtttcttttcctactacttcccacacaggctgatcatcatacatccctaaagcagctttttcgatttggatttcaggatgggccgcagcaattgtctgttttgcttcattttcagtcagtccctttgtttgatccaatacttttactttttcaccagatttaggaatgataacggcgatttcttttcctttatcatttgtacctgtcagtgaaaagtatgtcttctttcgagtaaaccaataaaaatgatcggcttcctcaagatttgcatatttctttgcgatttctactgcttctttcttcgcctgcaccgccggacgactggaacgcaagtaaaaaatcgagctgatcacgatgaccgctaataaaaatacgatcaagccaagtaacacgcgattaatcgttttttcctttgtctgttttttcttcaagggtcgtcgctcctttatcttcattccttttcattatagcagattttaattatgaaaaaagacagctcctctaacttccttcttcatttttctttaagaattcatggatatcctgatagatttcctccatagctagctctttgatcggtacttttttcggtaatgcatggatgatccgtgcaccatattttgcagtgactagtcttcgatccaaaataagcaatacgccacgatctgtctccgtccttatcaagcgacctaatgcttggcgtaacttcaaagctgctttaggtacggattcctggtaaaaaggattgatcccctctgattctaaataagcgttcctagctttgaccatcgggcgaagcggattatcgaagggtaaacgtgtgactacaacgatctgcaaagcatctccaggcaaatctacaccttcccaaaagctgtcagcgccaaacaatacgcttttttctgacaaaatgaagcgtttcaaaagcttctcccggcttccgccaaacccttgagctagtatttctcgtcctttttctagcatagacagatgcattttctgatagaccttctgcaaaacatcatgagaagtgaataacacaagtattggccgatcttcttgttcgatcagacctgtaagtgctgtctctaaataatcgatatatgcttgattgctgacttgatggacggcaggtgcctcttttggcacatagatccttgcctgtttctcataatcataaggagaggcaatcactttaagaggtgctgcttcaatgccaagccgcttagagagatagtgtcgattagggccgatcttcagcgttcctccaatataaagaatacgatcatatcgaggataccaaacagtcgacggcaacatagccgcttgaaaatcatggagatgaaaaatcatctgctgcgctgttttcccaggaacgaaccaatggatcaaatgatctcgccagtcttccagccatttatccatcagcaagtactgcttatctaattgatcaaataagctatataaacttgctaaatcgatccgcatctggtttgtccagctttcttggataatctcaaaagtcagacgcatttgtgactgtagctgctggatctcctgataaaaaagctgcaggtgatcaatggctgtcccagattccagtggcagctgatccaacatctcttttgtcatcatgacttcttctggatactgtccgttaggttgcttgccgctcactaaactcattaatccttctgccatacaaatctgtgcttcgcatagcgcagaaagttcttctcgataaatcgataaccagcgtaaggcttcatgttctttcggtaaatagctttgtattcggtcaaacagctgatttggttcttctaattgctggatttgtttatggaaatagttaatacttaatcgtttgtcatttactttttcagcgatttccggcaaatgatgtacttcatcgatcaacaaaaatgaactagctggaagcaatggttcttttcgctgtgtttcttgtattaaaaacgcatgattgacaatcaaaaaattactttgcctgattttcttttgcaagaaacgaacaaagtcttgttcgtaaaatgactgatttcttgctaaaaatccaatacctctgtgcgcgatatctgcaaagaatgaatggttcaaatttgttaaatgtaattcatccaaatcaccggtcttcgtttgcgtcagccaaactaagaccgccatttgatacaaagcatattgtttttgttctggcggttccacaagtgtgcctttaaaacgctgtaaatcaatatagtggcgatagcttttgataattacaggttgtatgggttgatctagcaattgattcagcaatggaatgtctttttctatgatctgctgctgcaaaactagcgaaacggtactgatgacagcgggtttttcaggtgtagccaaataactcaatggcaacagataaccgattgttttacccattcctgtagctgcttcgatcatcaaatcttttgattcatcttttgtgaaatggtcgtagaccgcattcatcagtctgttctgttcttttcgatacatcagtgttttaccaaacattttttcttttgcttgtttttttcttggatatgtccgctcgccataatggacggatgtgaatagttccacttcttttttctgcaaagctagcccatcgacgatttctaatgagggatcaagtggctctggtttttctttcatttcttcaatcacgtgataaatgaaacgactcgtatccatacctgtgtgtctacttaatcgcgcaatttgctctaacgtgatgattggcaattttctcatccgttcttcgatcagcaaaagaagttgacctgtcacttcggcatcactatctgcctgatgaggattctcatgaataaatccaaggctttctgacaaatcagctaagcgaaagcttggttccgtcggcaagaaaatttgtgcaagttctactgtatcgatgcctggtatcttcaaactaggaagtccgcatcgcatgagttcatggttcaaaaaattataatcaaaataaatattatgcgcgacaaatatggtgtctgccaaaagattgtaaatcgtttgggcgacatcttcgaaataaggcgctttttggacgcgttgattcgtgatccctgttaaatgctggatttgttttgaaatcttccgccctggatgaatatcgatcgaaaaacgtgaagtgatccgacctgattcaatcatgacgcagccaaattggatgatccgatcttcttttggattcgtcccagtcgtttcgatatcaacgactgcataagttcttggtttcaaaatatcttcctcttctcctgcctctaatgttcttttgaaattatactacaaagtgcagaaaaatactctcatcgctttttaaagaaaatagacaaaaacgcccagacacgcaaatgtctgggcgtttattttttagtataggttaattaagctttagtaacgtttgttgcttgaggtccgcgttggccttcttcaacatcgaaagttactgcttggccttcttctaaagttttgaatccgtcgccttggatagctgagaaatgaacgaatacatcgtttccgttttctgcagtgatgaatccaaatcctttttctgagttaaaccattttactgtacctgtttccataataaaaatcctccttgtgtatcaacacatattttgcaattacttgaatggtgtatatctggaagatgtttatttgaaacaagctaccacagattaccgaacaaaaactactcctatagtatatcataccgtttacaaaaaagctagagtttttcgactttttttattaaaaaaagttttctcagcgattacataaagtgaaaaaccgaactttttttaaaataaacgacatattgttcagttggtgtttttttgctctgatgttcttttttaaactaaaaaaattattctttctgactacttatcggttctgtttcaacggtcgaggctggggaagattctttagtaggtctgatgttctcatggtatttctgatagcctatgacagttaccagaagaacaaggcaaaccaatacgatcaacgagattagtttttcttttttgctcatatctatacctcataagtaacaggatgatgtccatcatatttctgagtatgagtaaaagcaaaagctgcagctgtagaatgtaagaaatgccagcaactttcataatcacaggtcggacagtaccaaaagtaaccaaatcttggctgcaaagaccgttcttctgtttcaggaatcgcagaatcaagatctggtgtctgtacataaacatttttgtacagacgtgtgcctgtaataggagaccgctgtgtttcttcagcaaaaactggctgacttgttaaacttagggatagaaacagcaaacaccataacagtctttttttcataaagacctccttatcgataagtttttcccaattaaaatcatatctcaagaacgcccgttattcacattttgttcataaatgatgttttttgtatcataatcgtcaaaaagaggtcgtgaccacatcacaacctcttttttaaacggtgttccagaagtagcttcttcggaaataagccgaaatttcacaaaaatttgagaaataatttttgtcaatctcttcttatttcttgaagctgaccacttctgtcacaacctcttccttaaacggtgtttaatcagctgaccttcggtattagctcaaaaaacggaaaaatatgtgaaactatttttccgtttgtttctctaatactcaggtcaaaacactgatttcacaacctcttttaataacgaagaatcgctgtcagactcttttcatctggcgcatctttttgatccaaaataaacactttcccgccattaatgatcacatcatctgctaatgcattcaacacttgacgccgatcatattctgtttcaggatcttcaccgaaaccatcagctaagtttgacgtagcgataaataaatgtgacacttttccttctttcgcagctggaacgatatcaactaactgatcgatgaatttcttatctaaaagtttattgtactcttttgattcttgagctgcgagttcacttgacagcttcttcgccccttcttcgatatctctaaaggatagctgcgcaggagaagcagaaatcgcaacgtctgcacaatagtaaggatttttggcgatttttttgaacatcgtctgattttctggtagagcaaataaataaatcggccattgttcaggattttcgaaagaatccttcaagtacgtatcaactgcttggtaatagttgacccaatcgatctctacttcttcatcttttggatttacgccatggaaagttactccatctcgggctccgcctcctccattagaagagaagttcaaaccgccacctgtcagttcagatcccaatgcagtaacgacatcaaccggtgccccttctggtagagatacttcttttacttgtttgttgctgacttcatacaatttcatggagtcgcggttcaatcccaataaataataagaatagttgaactgcccatttttgataatagccagtaaataaggaagatcacttacatagtattgatcgtctaccgggatactcaaacgatggatataggtttggtcagcagttataatgaccgctacactcgtagttgcactacgccaaaacgaaggatctcctaacaaattttcaattttttcttggaacggggaccagtcatgttcggaatattttttctcaaaacgtttctttgcttctttcgcaaaatttttgaatttgatttgatctttttccacatcttgatgggcgacatgcgtattcagcatgatcgtgacgaatggtcctttagcgccttctgaagtcaattgtgacaataattctttatccttttttgccataaacgtacccctcctaaaaaaatcattcctttgtttctatctaaagtctaccacaacactatttttccatacaataaaacgtatctaaaaaaataaaacggtttctacggttttaaatttagctatttttttaagttatcttcataatttcctcaattatttagccccagtcttcaactattcttcatgaaatgctgataaactaagaaaaagaataaaagaggtggatcttatgcatttgattatgattttcagtttattaagtattatcagtttatttgctttcagcgcttcccgcttattagatgcggaaacacagcctattcctgtaaaagtacgtaaaaacgaccgctaaacttccataacgcgcgttcttatcctaaagttttttcagaaacattgaaactctctcccctctctgataaaattttaatttgtagcgaaacaaattaattacaaggagatcggatatgtccatgaaaaaaacacgtctagtcctattattggctagtctcattctttgccttgcttcttttctaccagctgttgctgtgcaagctgaagatacgttcaaagtaaatgcaaaagcagcttttgctgtagatgcgcaaagcggtaagattctttatgatcaagatggagaaaaaaccatggggatcgcttcaatcacaaaaatcatcggtctttacatcgtccttgatcaagtaaaagaaggaaaactatcatgggatgataaagtttcgatttcagattatgcagaaaatttgagtatcaccccagatttatcgaatgttcctttgcataaagaaaacacccacactgtcaaagaattattcgactctgcaatcatccagtcagccaatgcttcaatggtggccttggcagaaaaaatctctggcagcgaagctaaattcactgaacgaatgaaagaacaattgaaagattggggaatcaaagatgcaacgatcgttaatgcatcaggattgaacaactcttatcttggcgaaaaccgaccagaaggcactggagaaaacgacgaaaatcaaatgtctgctcaagatgtggccatcgttgcccgccatttgatcttggatttcccagaaatactggatgtatcaagtactacgacccaaatgtttggcgaaaatacgcaatcaccagtggaaatggtcaactggaactggatgctcccaggattcgttaattacaaggaaggcgtggacggattaaaaactggtacgactgagcttgcaggtgcttgtttcgttggtacgatcactaaaaacgatcaacggatcatcactgtcgtattgaatgcggacggccatgcggaaaacccgagtgcccgcttcaatgaaacagaccgtttgatggactactgctatgacaattggtcagaaaaagagctcggaaaagctaacgcaagtattcctagcctaaaaaccattgatgtaaaagacggaaaagaatcaacagttcctgttgtgcttaaaagccctgtaaaagtatgggtacgaaacgatatggatactggcaaattaacgatcacgccaacacttgacaagaagcaagtcactgacaacgagatccaagcacctatggataaaggtacaaaaatcggtaccgctacgatcaccttggcagacgataaattaggctatttagaagacaacaatgcgccatcaacagagatcattacggataaaacagtggaaaaagcgaatatgttcgtgattggctggcgacgcgtcgcagaatttttcggcaacttgttttaattgaacaataagaaaaacatctttccatcggaaagatgtttttttgctttttctagtttaaataacagcttttttcatctattttcgttatactgtataagaaaaaggagttgaatttatgaatctaaccagagatctgatctttttagttctctatcttattggggtattctctatcgtttattggcgaaaacagaagaaggatccttccttgttcttttacggcagtacatggacatttacggtaatcttaacttattttgtcgtgttggaaattttttattcgaccttttattttttgattccattgttgttctttagtatctttgctttttcttatttcacagaaaaacgaaggctgctgaatggtcttttattcaatgttttcctcatcagtttcggcatctacttgtttgtcttgctgtatgaaacgcaaaatattttccttggcggactgatcgccttgatcacgattccattgctacttgtccttttatttggtatttatggattgattgtttttcttttttggaacggggtcacagttttacgtagagaatcgcattcattagctaatcttttaacgttgatactagccatttttcttacactgtttcttgtttttgactttttcttgttaaaatatttgccgcaatggataaatgctttgtttttctgcgttcccctgatcttgatctatctatttatcgtattctacaactttttgactgtctcattcttgtatcagttcaaccggcctcgatacaatcaagacttcatcgttgtgttaggcgctgggttgatcaatggagaaacagtttctcctcttctagccaagcgaatcaataaggcaattgctttttatcgggctcaaagccgtgctacattaaatccgcccatcttattgatgtctggcgggcaaggagcagacgaaaaagtaccagaggccattgcgatgaaacaatatgccatggaacaaggaatccctgaaagagacattcttgtcgaaaccaattcgacaaccactttggagaacatgctctattcaaaggaaatcatggatcagcaaatgaaagggccataccgcgcgatctttagttccaacaattaccacatttttagagccggtctttatgcgcgacaagccaaattgaaagcaaatggtattggtgcaaaaacagctttctactacttgcctaatgcgtttttaagagaatacatcgccatcttgatgatgaacaaaaaaagacatatgatcatttgcggattgcttttcgcaggctccgcattcttatcgctgattactttacttttctaaaaaaacaaggtgtgacaaaacatatgtcacaccttgtttttttctttcattctcttaactattggcaaaaagagtatcccttttttgaccgctacttgctgagcagaataaataccgctgttgcctgaacacataaagctgatcaagcagatcataaagaagtatactgcagcttgtgaaccgaacaattcgatccccatcacaaagcaagcaatcggtgtatttgtcgcaccagaaaatactccgataaagcccaatcctgcaagaaaaggaacagaaacatggagcaaaggcgctagtgctgcaccaagcgttgcaccaatttcaaacaatggtgtcacttctcccccttgatatcccgcgcctaaagacaaaactgtgaagaataacttcccaataaaatcatagacatgtgcctgtccattaaatgattcttgaagtaacggaagactcaatccgagataacgttgtgtttgcaaaatcaatgctgctgccacaactacagctccacctatcgtatttcgccaaacaggatgaggaatccattgtgcatatcgcgcttttaaaaagacgatcgaacggctgaatacccaaccaatcaaaccaaaagcaatcccagcaacaaaaactttgaagaacagcaacatactccattcaggaatcacacccatttggtaatgtagatgagaaacaccatagctttctgtcatgaaatttgcaaacagtgcagcaaagaagctagggaagatcgcttctgttcggacttttccgattgccaacacttctaatccaaataatgttccagctaaaggtgtgccaaatacagaactaaaacccgcactgattccactgataatcaagatttcccgttctgatttatccaatcggaacaaacgtgctgtattatctgctaacgctccccccatttggactgctgttccttcacggccaacagatcccccaaataaatgggtagttatggttccaaacagtgtaagtggaataagtcgcaacgggattttttcttctccaccatttccttgatcgatcactaagttgtttccacgactagaaagaccgccgtgatacgcatagagataagcaaaaagcgcaccactaactggtagtagataaaggagccaaggatgtgatagtcggatatctgtcacaactgtcaagctatttaaaaaaaaagcagataagctccccatgaatataccgagaatcgctgtgatcaccagccacttcagcatatacactaaaatgcgcattggactcggtaattgtttttccataaaaaattcctcctcaataaaaaaacgcctactaaagaaaggggctgtccccagactttagtaggcgtcattagctatctttcgttagcatttaaaggcgaacaccatcacctattcacttccattaaaagatagcatatttttctgtaaaaaacaataaaattatcgttctttctttacacgttcagcaaattcatagaaaggagccaatttcgttaactgttgattacattggtcactatcatgacaaatataattcccctttttcgtatacgtgccatcagaacctgctttcgttgtagaaagaaaaagcgaaacattcgatgttttctgacagattgcacagattcccttatttatcgttggtgataaagtaccgctaatcccttttaatttttcatcttcgtaatagaccatgaattttttctgcgtacctggatcattccagccgatgtacgtatgttcttgcaagtcgatttcattccaagctggttgtttgagttttttcacttttcggaataatttctcgatttgtggtttgctcggctgcataaacggttggacgatttgcttcagctcctccaatgctcgttctgcttgcgtttttgtcagttttacatctaaaactgtcgttaaaaacgtatcgatttctggtggttcgtaacctaatacatcgcgaatcttttcagctgctagagcctgaaccgtttgtaccgtttttgagtcattgacagatgagtacgcatttaataactgatctacttctctttttataaaaaaatattgatatggtttcattgtttgttccatgattttaaagtcctttcttctaaccaaagtgcatactttgtagaaaaaagtgatcttctgcaaagtatgtgttacctgaagatcccggactcttttaaataagatacgttttgcatcttatcatcaccccctttaatgttcattcttctatgtacatgattcattcgataaacaaaagtaaaccgtatcttgagcagatagtcaactgcaaacagaaaaaggactgtgacaaaagtcgtgtcaaagtccctttctacaaacaaacggtgttccagaagtagcttcttcgaaaaataagccggaatttcacaaaaatttgagaagcaattttcgtaaattccttcttatttcttgaagctgaccacttctgtcacaacctcaatatggtctattattggttttacctgttaaatcgaggattcttttccgaagtaacgttgccatctcttacgcatacttgctgacataggctgagcggcttctttgactgcgcagtatttgtccacaaatgtcacgatatatccttctttatacttaggcggtgcaatcgttgcgccccacatgtgcttcaaaatgatatctcgctcaagatccgacaattcggtgatcttttctgcattctttacagcgattcttggatggatatacgcatgtgtgccttcatcaaatttcgtcgtacgccaatcatagtagaacagatcatgcaaaagtccagcacgcgctgttgctttagcattgccaccccatttttttgcgagcagataactatagtaagaaacactgatggaatgctccaaacgagtggaatgaacatgctgtgtgtaattcgctaattttttcactgcttctgtttctaaaagatcttctacataagacatatattcttcgtcttcacgccatttttctgtcataattatcgatctgccacctttttgaatttcattttcttctgaaattgatctaagtataccaccagtgttcggattattctagtcgccttggataaaatagccaaagcttaatagttccttaatcataaagaaaaatgataaagaacaatccctgacgcaaccccaacattcaacgattccgcatttcctttcatcgggatatatacgttctgatcagtcaaagacaagatttcctgacttaccccctgaccttcgttccccatgattattgcgaagttatctgatttttctactttgtctaatgcgtgtgcttcttcatttaattctgtgccatacactgtaaaccctttgtctttcattaaaggaatcacttctgtcaaatctttttgcaacacaggcaaatgataattgcttccctgcatgctgcgcagcacctttgtactataaatatctgccgttcctttgcctaataaaacaccagccatatcaaatgcatctgccgtacggatcatcgtccctacatttccaggatcttgtacattatctaacaacagccatcctcctgaaaaatctggcgtgccttcagccgttaacgccatcactgctaagattccttgtggtgtaggtagatccgatacagcatccatgacctcatccgaaactagaaaagtagaaatctctttgtttgcggccagccagtctccccattctttcatgcctcgctgtgtcacaaaaagttcttttatttctgcatcagacgacgcagcttcttcaatcagatggaacccttccaaaagatattcttccttttcttcccgatatttctttttatgtagtttttttaattctttgattcttggattttttgctgattggatctctttcacattcctcacctccccatgattatatcatggaataggtgcttgagcttgtttcatcctaaaaaaatcggtatcattaatttataaaataggaaagaaaggtgacgaacatgcgcaaagttaaaatgaacgtccaaggacgcgtccaaggcgtaggatttcgctacatgaccaagatggtcgctgatcaactaggcgtgactggaacggtaaaaaacgaagatgacggctcagtcacgatcgaagcaatcggcaatgacgacatcatccagaaatttattgaagaagtcaagaaatctccgagcccaagtggacgagtgcagtatgtggatgtccaagaagacccgatgattgaggaacgaaagaaatttgatgtggtgggataaggttgtgaaaaagctggtctgcatcaagcattaaggacaggttgtgaaaaatagctctccatatttttcaacaggctggacttaatgccgtagatgcaagcttttgaacaccgccgataaggttattcttgagacgctttgcctcaaaaattaaggacagcagtgaaaaagctgatctatcacttgcagtgagttcatttgactccgctttttcgggcagaaaaaaagtttttagtttattaaagtaagaaagaaacacttggatcattctactttttcctagtatttctttcttgattttttgtctttttttcaaaatttttcgctacgtaaaagaacgaatatttatatgaaatttctatgaagttgattgaattccatgcgcttttttagtatagttaagtttgtgtaaaaattatagaagaggaagtattctatgaataaatggaaaaactggttattgggatccggacttgtcagtatcctgctctttttatctggctgtgtgcggatggattcaaacggaaaccctgacacttcgggaatcgtttatcgagtactcgtccatcctatgggccaagcgattacatatctagttgagaatttcaattggtcttatggctgggcagttatcgcaatgactgtgatcgtccgtatcatcatcttgccactaggtattagtcaatcgaaaaaaacaatgatccaatctgaaaaaatgcaagcgttaaaaccacaagttgaagcagcccaacaaaaattgaaagctgcaacaacacgtgaagaacaaatggcagcacaagcagaaatgcagcaagtataccgcgaaaacggattgagtatgaccggcggaatcggctgtctgcctctattgatccaaatgccgattttctctgccttgtactttacggcacgttatacagaagggatccgggaatcatctttctacggcatcgatttaggctcaccaagtatggtacttgttgtcattgcaggggtcgcttatctgcttcaaggatacatctcaacgatcggtattcctgaagaacagaaaaagacgatgcgtacgatgctaatcgtctctcctgctatgatcgtcttcatgtcgatcagtgcgccagccggtgttacactttactgggtagtcggtggtgtgttcagctgtctgcaaacattcatcacaaacgttatgatgaaaccacgtttgaaagtacaagtggcagaagagttgaaacaaaacccgccaaaacaagtcgtcactccaagaaaagacgtgacagaatcagcaaagccagctgacaacaaacaagcaacaaaacaaatcaaacaaccaaaaaacagtacaaacaacaaaggccgcaacgcaggaaagcagcagaagcggaagtagatagtaaaagaccacctgttcattaggaatgaggtggtctttttaattaatatagaattttagcatattccttacaattaaaaattttctatttcaataatcgctgaattttgtataatactctgtatgcattatcgtataatgacatttttttcatgaaatagtctaaattgtttctttttactgcctcatcataatgaataggtgcttttaaacagatattttctcttacatcttgaattctttttctaataaaagaaatgggttctcgtatatccacgcgtttttttggtatccattcatttcttttttcttttttacgaagacgatatgggagttcttcttgtgtatgacgatagtgtgctgcttgcgattcaattattttacttacactaatttcatctaattttattcttccctctgttaaagctttttcaactattctttttataattggattcctaataattacaatattattgccttctgaatccattgtatattctggaagccacgcatcacctaaagtaatatccgcagtttcattcatgacgtcatctgtaaaatcggaagcacgaattttaaataatccttttccccaatcgcctccgtataactctttcatttctttaacaattcttacttcttctccatctattgttcctgtcacttctattccatacgagcttgatggctgattttctattttttttctaaaatctattgattttaattctcctggcttaataccacattgccaagctaagatatcagcgaatttagaagacttctgatgcccacacactaatcctatcataaaagtaattctttcctttattgtttcatcaatctctgataataaccttaattccattataaagctaggtaatccaataattgcatatttaccgggaacttctttgacaatttttaacacttcggataattcaacaggataatattttgttttagatcctttaatgatttcctctacgctttttgatatactataagaaaatagtttttctgggtgctgtgttgccttaacgtttattacataatctacatatttttgctctagcaattcttttagtatccaagtagcaaatccgccagagctaccgttttttctataatgcccttctataacatagccagcatatagagcgttataaaaacctatacgttcatcaaactttatatcgttttgactgctaaataaagacttagcaacatcgtattcatttctagggcttaaagaagaacaagtatatgctaatttttcaattttttctgaatcgaatgtgctaaatggttctaaaaatgtgggaacatactctccatgttcatttagaatcatcttaatattatctgttacaacagtacttataccagtaccaaagtcatatttttctcttacaatttcatcataattttttttgttagtatacatggctaattcctctttatattatcgttttactatgcttaatagttggctcttttcaaaattgttagcactaaatcttataaatatgaatacgtacataaaaacgtacaccattgcaaataggaaaaaactaaataaattatttattggtatatacagtctaattaacattaggaccccagtagtaagaataaaaggtactgatacttttgcagtattgaaccaaaattcttttatgtgtaaacccatttttttttgataataccaattcattagcactccatttgcaaatacaatactcagaacatatcctaatgatgctccaaatagtccaagatattttgttcctaaaaaagtaataataatatttaatatggcaaataaactataagtaatagacctaaatatatgtttattcatggcacgctgaatctctatcccaatattttgagataaaggtataattgatgggactaccataaaaattatcaaccagtatgcatccaaattttctggaccagcccataaacttataaatttttttcctaaaactataaaaccacccaatataaaaaataatatggccatttgtagtcgtccaacttttatcattaaagcggtaagtactgtcttgtcattatttttatttacaatttcattaactttcggaacaaaaactgaggataaagatgttgatagcataaaaaacatgttttttacttgtaaagctaccgcaaaagttgctacgtcctttgcacctcttaccatacctaaaacaaaatttggtccattattatttattaaatctactagttgatttaacaagataaaaaatgaaaacattgctaattgtttaaataaattaaaaggaagatttttaaaagcaaattccatattgagttttttcaaacagtagtcaagatttaaaattaaaaaaatgagagttacaataagttgagtaaaccctatagctaaaactccaaaaccattaagtattaggatcactgatattacaggtactaatagactttgaatgatctgtctagtttgttgaaaaataaactgttcattaactataatgttagcatcgaatacagtaaaggtattctttgagaaatacatatcaggactatcccttacagtggctggcgaacaggcaggtattgaaaagacacattctgtgatggggcgcattttgaaaaacgtcaactaccttggaaatgatacgtatccagcaattattgataaagagatatttgataaagctgaagaagttagagataaacgtgcaaaggatttaggacgagtggtagagcttgccgctttcacctctccccctcccaaagaacgattcaaaatgaaaaaggcagataataagatgccagtggatccttttgaacgagcagaatacttatacagtctgatagaaagcgaggaataaagtgacagagaaaaatataatggttattcctgctcgtaaaagagtaggaagtacagccgcaaaagaaaagataaagaaacttcgtgttgctgcctattgccgtgtttctacagaaacagaagaacaaaattctagctatgaggttcaggtctcacactatacagagtttataaagaaaaataatgaatgggagtttgctggcatctttgcagatgatggtatctctggtacgaacactaaaaagcgtgacgaatttaatcgcatgattgcagagtgtatggacggtaacatcgacatggttattacaaaatccatcagccgatttgcgcgtaacaccctagactgccttcaatacattagacagctcaaggataagaacatatcagtttattttgagaaagagaacatcaacaccacggatgccaaaggtgaggttttgctgactattatggcatctttggcacagcaggaaagccagagcctttcacaaaacgttaagcttgggctacagtaccgataccaacaaggaaaggtgcaggtcaaccataagcgatttatgggctacacgaaagatgaagatggaaatttaactattgtccccgaagaagctgagattatcaaacgcatctaccgagaataccttgagggtcagagtctagtgggcattggtcgagcccttgaaaaggatggtattttaacagcagcgggaaaaccaagatggcgaccagaatcagttaagaagatacttcaaaacgaaaaatacatcggagatgcccttctgcaaaagactgtcacagtagattttctgaccaagaaacgagtgaaaaatgaagggcatgttccccaatattatgttgaaaatagccatgaagcgattattcctaaagagttatttttgcaggcgcaagaagaaattcatcggagaagcaatatctacacaggagaaggcaagaacaaaagaatttacagtagcaagtacgctttaagtgccatcaccttctgtggagattgtggcgatatttatagacgggtctattggaatatccacggaagaaaagaatttgtctggcgatgcgtgactagaatcgagcaaggtcctgaagtttgtaagaaccgaaccgtaaaagaagatgaactttatggtgcagtaatgactgcgattaataagctacttgcaggtgggaacaatatgataaagacactggaagagaatattcatgctgtgattggcgaaaccacagaataccaaatttcagagattaacaactcactagaggaaaaacaaaaagaactaatcaagctggcgaacaagggtcaagactatgaccacttagcagatgagattgatgagctgagagacaagcgacagatccttttagtagaagatgcctccctcagtggcgagaacgagcgaatcaatgagctgattgaatttatccgcaagaacaaattccgcaccttagaatatgatgataagcttgtaaggaagataatccagagcgttacagtctatgaaggccacttcgtcatagccttcaaatctggcatcgaaatggaaatatgaaaaccagaagtaaatagcccatgactctacagtagagttgtgggttttcttttgcttgctgattataataatattttaataactattgtgtttatcaaccaaatggtttataatattcttagcgtaaacttggaggtgctgtatgactacggcagaaatgattaaagaactgtgtgagcaaatgaatataagtgtttccgaacttgctagacgtattggccagactccacagaatttcaataaaaaattacaacgagaaacagtaaccttggatgagttgaaggccattgctgatgtgctaggtgtcaagtttgtgcaggcatttattttaccagatggagaagaaataaaaatatctaacgaataaaggaggatgtttatatggtaggtaatgttattcaaatagtaacagagaaattatcatctttgccttttatagaaggcatcgtattagggggctcacgtgcaagaggcacccatacagaaaattctgatatagatatcggaatctattacaattcagactcatttgacctgacagcgattaatcaaattgctacagaattggatgataaaaatagaaacaaccttgttgtgcctcccggagcgtggggtgattggattaatggcggcggatggttatttataaatgggtatcatgttgacttgattttacgtgatataaaacgggtagaacaaataatcaaagatacggagcaaggaattgttactgccaattatcagaccgggcatccccatggttatataagtgcaatgtatcgtggagaattagcgattagtaaaatactatatgctaagaacgaaagcttatgcgaattaaaaaagcaggcagaaatttaccctactgctctaaagaaaagcttgatgaacttttttatatttgaagctgaattctctttaatgtttgtaaaagcaaatgcgggggtagaggataaatattatattgcaggccatgtttttcgtattatttcatgcttaaatcaagtactatttgcatgtaataatgcttattgcattaacgaaaagaaagctataaaactgcttgaaacttttgaatataaacctgaaaaatatgccgaaagagttaatcatatttttgaagtactcggtctttctctttttgaatgctacgatatgaccgagaaactttataaagaagtgaatgaaattgtatcggagataaataactttttaaacgaggagagttcagatgaaagaaaacaaatatgatgataatatattttttcaaaaatacagtcaaatgagtcgctcgcagaaaggactggctggtgcgggagaatgggagactttgaaaaagatgctacctgattttaagggtaagcgtgtgcttgatttaggatgcggctatggatggcactgtatatatgcgatggaaaacggtgcttcctctgtagtaggtgttgatatttctcataaaatgctcgaagtagcaaaaggaaaaacccattttccacagattgaatatgaatgctgtgccatagaagatgtggatttcccagaggagagctttgatgtaatactaagttcgcttgcgtttcattatgtagcagactatgagaatttaataaaaaagatatataggatgctgaaggctggtggcaatttagtttttacagttgaacatcctgtttttactgctcatggaacacaagactggtattataacgaaaaaggagaaatactgcatttcccggtggacaattattattatgagggcaaacggacagctatgtttttggaagaaaaggttacaaaatatcatagaacactgaccacatatctaaatacactgctttcaaatagttttataataaatcagattgtggagccacagccgccagagaacatgatggatattccggggatggcggatgaaatgcgacgcccaatgatgctgattgtatcggcaaaaaagaagatgtaataatatagaaaaaataaacgaggagtatgtaaatgagatcagaaaaagaaatgatggatttagtactttctttagcagaacaggatgaacgtattcgaattgtgacccttgaggggtcacgcgcaaatattaatatacctaaagatgaatttcaggattatgatattacatattttgtaagtgatatagaaccgtttatatctaatgatgactggcttaatcaatttgggaatataataatgatgcaaaagccggaggatatggaattattcccacctgaagaaaagggattttcctatcttatgctatttgatgattacaataaaattgatcttaccttattgcccttggaagagttagataattacctaaagggcgataaattaataaaggttctaattgataaagattgtagaattaaaagggacatagttccgactgatatagattatcatgtaagaaagccaagcgcaagggagtatgatgattgctgcaatgaattttggaatgtaacaccttatgttattaaaggattgtgccgcaaagagatactgtttgcaatcgatcatctgaaccagattctacggtttgaactacttaggatgatgtcgtggaaggttgggataaagacagaattttcattaagtgttgggaaaaattataagtatattaacaaatacattgatgaagatctatggaatagattattatctacatatcgcatggattcctatgaaaatatttggaagtcattatttatatgccaccaattgttcagggaagtgtccaaagaggtagcagaactactggggtttgattatccagagtatggtaagaacataacaagatataccgaggacatgtataaaaaatatgttgaaaatgactatttttaaagattagcaaagattattaaccataagcaaggggtgtaaatgtatggaaagtactgatgttataaatgaaattagaggtatattacctcgtaactcaattggaaaatatgatttactaactatttttacacataaaaccgtttttgataaaattgtaaaagtactatcattggattttcaaaataaagtagattatgtggctgccccagaagcaattggatggatactaggcactgccatagccaaagaacttggagtggggtttattggagtaagaaaaggtgataagctgccatacgcaaaagaagagattatttcgacacattttaccgactattcaggtcaagataaaagctttgaaatatctaagagttctattgtgaggaacaaaagagttttgattgtagatgattggatagagacaggttctcaaatgaaggctttaatagctttgttagagaaattggattgcagcattattgggttggctactattgggattgatataaatgaggttactcaaaaatggatagacagcagttttgtagcttatattggctcaaacatataataaaccgaaagaaaatcttgaatcaaaattttggatggcgttaatttacaatacaacgaaagatgtttactctttttttataaattttaagaggcgttaaaaaacagttttcagacgaaaggagatcgaagttgagtatagatttaagtaacaaaaaaattccgaaagaagcaattcaagcattaaaaactatagcggaactacttgataatatgttaattggggtgtatttgtatggttcggcagtaatgggtggtttacgtatgaatagcgatgtagatattttggtaataacaaatcaaagtttatctgaaaaaactcgaaggaatcttacaaataggttaatgcttatatctgggaaaataggaaacataaaagatatgaggcctcttgaagttacggtcataaatcaaaaggatattgtcccttggcatttcccccccaaatatgaatttatgtatggcgagtggctaagagagcagtttgaaaagggagaaattcctgagtcgacttatgatccggatttagcaatacttttagcacaactaagaaaaaatagtattaaccttttgggaccaaaggcaacagaagtaattgagcctgtgccaatgacagatattcgaaaagcaattaaagaatcgttgcccgggttgatagctagcattaacggtgacgaacgcaatgtgattttaactttagccagaatgtggctgacagcatctactggtgaaattcgctcaaaagatctggcagctgaatgggcgatacctcaattacccgatgagcatgctactttactcaacaaagcgagagaggcttatttaggagagtgtgttgacaagtgggaaggaatggaatctgaggtggctgaactcgttaatcatatgaaaaagtctatagagtcttcccttaatatccaattaccttttcgaatagtttaaatataacaaagactagttgttaatgtgcattattgattgcttcgatatgttcccccatatatcagtttcttaaaaaataatcaaaataccgttgatacgttcccgcgaacgaaagggttaaaaatcagcttaagacatcaatgccatcaactcgagccacgttgagacgtgtgttttattgtcccacaaaagtgcagacgattttatcagtgtaaaaatggagtacgcagacgaccgaaaaatccagccagatcgtatcacctacaggcttattcaggagtatatcgaagaaaagtacggcttcaaagttcacactgcaaacattgcagaggtcaaaagaaacttaggcctgccgatgtacgacgcaccaaacgcagttgaagaactaaaacgcccatataaaccagcaccagaatataaagtagaagctattaaagacgcattaaggcacttcaaggtcatagattaaagtaaagtaccctttcagcagatcattactgttgagagggtcttactttttcagaagccggccaatgtaaggatagccctacaagattgcgggtctttctcttcgagccatgtttccagattgcttatagcgatatccttttgaatatggatgctctcttcaaatcgatattcgattgcacatgtaaggatatcaacaggttcatcaagaaccttaccgccaagaactgggtattcgtcaattacaatccagtcaggtgggagaccatcaaagagagcctgcggatacaattccctaaagtgaatctcaatttccatagcttcgatctcaccttgttctttatctgggtaacaagtggcataagatacatcgaagcctctagtgagcagcatctgaacgacattgatgagttcaatatcaacaggaatggtcttatcggcgcatttacaacaaggcttcgaccaaatttcactgtatagctctaaacatcgtggacacatcgtcatcatacaatcacttccttcaccagtttatagaaagtagttcttttaagattaagtgcctgcatagttgcagttgcagtttgctcgccagtgcggtgatatttaccgccgggtacactggaataaccgaggttacaagtctattgtttggagatgcgtcagccgtttggaggaaaaaggatctgaatgtactgcccctaccataaacgaggaaacattgcagacagcagtggttaaggctattaacgaacttttggctaacaaagaacccttcctccaggcgttgcagaaaaacatagctactatacttaatgaagaaaatgataatgccaccaatgatattgatagcaaattggaagaattacaacaacagcttcttatccaagcaaaatccaagaatgactatgaagatgtggctgatgaaatctaccaccttcgagaattgaagcaaaatgcacttgttgaaaatgcagagcgtgaaggaaaaaggcaacgaatcgctgaaatgactgatttctttaatgaacaatcctgtgagttagaggaatatgatgagcagttagtaaggaggcttatagaaaaagttacggtatttcatgataagttcgccgttgaattcaaatcaggagtcgagattgatgtagaagggtaatctttagaaagagaacagaagaattatattggatttttaaagataatatgatataataaaacgacttggaggtggaagaatgtataacttttcttgctaattatatgatgcataataagatatttaaagaaacggctatagaaccgtttgttttgttatgcaaattgcaagaaagttaagtattctacactcaataatacattacagtaaccttatgttatgtataacaaaaggtaataatagtatttgtttttgagccgtaagaatttactttcttgcggcttttaatatttgtaaaagaaaggaagataaacgtgatagacaatgatactatgtcattcatgacaaaatccttgcagagttggataacattatagagtaattaatgccgaaaaccgactttgcttataaaatttttataatgtaaaggaggaagaaatatatgtccttaataaatgtttcaaatctaactttttcatatgaaggaagttatgacaatatttttgaaaatgtaagttttcagatagatacagattggaaactcggttttattggaagaaacggacgcggtaaaactactttcttaaatttactgcttggcaaatatgcgtattccggcaatataagttctacagttaagtttgagtattttccttatgatgtggaagataagagtctatatacaattgaagtaatgaagagtatttgtacggaatgtatggattgggagatttttcgtgaaatatcattgcttgatgttcaagaagatgctttatatcgtccgtttaatacattgtcaaatggtgagcaaacaaaggtccttcttgcagctttattccttacagcgagttgtttcctgcttattgatgaacctacaaaccatcttgacatcgatgcacgtaatgtagtgcaaaactatttgaaacgcaagaaggggtttattttggtatctcatgatagaagcttacttgatcaatgtgttgaccatatactatctatcaataaaacgaatatcgaaatccaaaagggaaattttacttcttggtgggagaacaaaacgttacaagataattttgaactggcagaaaacaagaaactccttaaagaaataggaaggttgtcttatgcagcaaaacgtagttcaaactggtcaaataaagtagaaaaaagtaaatatggaacaacaaattctggttcaaaactggataagggttatgttggacataaggctgcaaaagcgatgaaacgtgccaaaaatattgagtcaagacatcaggaagccgttttacaaaaatcagaactgctccacaacattgaacaatatgatgacttaaaaatttcaccacttgaatttcacaaagagtgcttaatagaagcgaatgatttatcattgtcttatggagataaagaagtatgcagtaatcttaatttcagagtcaatattggtgatagagttgccattatcggaaaaaatgggagtggtaagtctagtatcctaaaattgattaatggagatgatattaaatttaccggaaattttatgctagcaagtggactaaaaatttcttatatttcgcaagatacttcatatttaaaaggtaatctatctgaatttgcctataataataagatcgatgaaactctatttaaaacgattcttcgtaaactggattttaatagagagcagtttgataagaacatggtggattttagtgctggtcagaaaaagaaagtactaattgctaaaagcctttgtgaaagtgcacatttgtatatatgggatgagccattgaactatattgatattttttcacgtatccaaattgaaaaaatgattttggaatattgtcctacactattgtttgtggagcatgatgatgctttttgcaataacatttgtacgaaaaatattaatttaggtttgtagagattttgagttgccacaataactaaaagatatttacatgaaagggtgaagaaatgttaaaacaaaaagaattaattgcaaacgttaagaatcttactgagtcagatgaacgaattacagcttgtatgatgtatggatcgtttaccaaaggagaaggtgaccaatactctgatatagagttctatatatttttgaaagatagtataacctcgaactttgattcatccaactggttgtttgacgtagctccgtacttgatgctttataaaaatgagtacggaacagaggtagttatttttgataatcttatacgtggggaatttcatttcctttctgaaaaagatatgaacataatcccctcgtttaaagattcaggttatattcctgatacgaaggctatgcttatttacgatgaaacagggcaattagaaaattatttatcagagataagtggtgcaagaccaaatagacttactgaagaaaatgctaattttttgttgtgtaatttctctaatctatggttgatgggaatcaacgttctaaaaagaggagaatatgctcgttcattagaactcttatcacaacttcaaaaaaatacactacaacttatacgtatggcagaaaaaaatgctgataattggctaaacatgagtaaaaaccttgaaaaagaaattagccttgaaaattataaaaaatttgcaaagaccactgctcgattagataaggtagaattatttgaagcctataaaaattctttgctattagttatggatttgcaaagtcaccttattgaacaatacaacttaaaagttacacatgacattttagaaagattgttgaattacattagtgaataggagagtaacgttattcacagtattgggtactgaaaattaacagcatacctcagtttttcaaaaaacagcgaagcctatggatatgttcccgtctaccgatagtgcaaaaagtgtcgtggatatgtttccgagaacggacatacacaaatgacattcattctgtcctctcaatccatattgaatgtgtgactgttttaagtaagtaaggaaaacataaaaaaacgggctctttgtcaaatcggactgatgagacaaatattgaagatgatgaatttgagaattttctcaaattcatcatctttttttagttattcaattgtgacaaggtcgtttatcataaaaattcttatcttcatattactaaaagatttgaagccataagatactctttttaatatcttaatatgagtatttttagcttctatttttccgttagaatacttatacgttaagcattacgaatcccttcttcataattaatcagattttcaatcttctgtttaaatagtggatctaaggtagtcggtaagttctttaataaatcaaaaaatgagtctggatctttatttctaaagtgataggttaataattgaaacacgccataggcttcttttaagtctgtagaaaatgataaaagacgatcaatcatcattgattctgttagagggggaaacttaggtgaaggaaagcttctccaatttttatattctgaactagaaacagtcatttgattctttaataggtatttccaatttacttttagcttattggcttcagaacgctggtgattctttattaatgctttcatttccctgactctaaagtcattaaaagcttggtttaagtgtttaacgatatgaaacctatcaatgactaaagctgcacaaggaaagatttttttagttaactgaaaataagccgcattcatatctgtcactagaaattttacctgttctcgtttctccttgggagaacgattgaagtaattcattagtttatcaagtctacgactaggaagaacatcaaccagttcaccggtttcaccattggcacaaataaaactcattttatcttcataggtggcatgagatctgaattcatcaaccattagaacttttggaaaagagcgtggtttaagcgtttcaggtaaatgtttttcaacagatttaaggacccttataacggttgtgagtgatacatgacatatcttagcgataacggtcattgatattttttgagttaataattctagtattctaaatgtcatgaatcgactaataaaacaattttcttcaacgatagaacattgagttgtccaatgttgatggcagtttttacaaaaatatcgttgtttttttagctttaaaatagttggaatattttgatatgattccaaacgaattgtcacttcttttttcccattttttacaatggttttcttttcatctgcatcgttcgcatgagactgacaatacttacaggccgtaagcttaggtgagtaggtaccagtgataattaatgtgttcacacctttgtattttccttcttcaacacaagttaaatttaaatcttcatctttaattcgcaacattttttgatatgattagtcatgacatgtcgtcctttctatttaagattttggttggtactttaattttactagatagacgacatgtttttctgcttaaataaactaaaatagggctgatgaatcaaaaaatgattcatcagtcctataaattatagagcctgaatttatccgcaaaaacaaattccgcaccttagaatatgatgataagcttgtaaggaagataatccagagcgttacagtctatgaagaccactttgtaatttgctttaaatctggcattgaaatggaaatatgaaaaccagaaataaatagcccatgactctgcggtagagttgtgggttttcttttgcttgctgattataataatattttaataactattgtatttatcaaccaaatggtttataatattcttagcgtaaacttggaggtgctgtatgactacggcagaaatgattaaagaactgtgtgagcaaatgaatataagtgtttccgaacttgctagacgtattggccagactccacagaatttcaataaaaaattacaacgagaaacagtaaccttggatgagttgaaggccattgctgatgtgctaggtgtcaagtttgtgcaggcatttattttaccagatggagaagaaataaaaatatctaacgaataaaggaggatgtttatatggtaggtaatgttattcaaatagtaacagagaaattatcatctttgccttttatagaaggcatcgtattagggggctcacgtgcaagaggcacccatacagaaaattctgatatagatatcggaatctattacaattcagactcatttgacctgacagcgattaatcaaattgctacagaattggatgataaaaatagaaacaaccttgttgtgcctcccggagcgtggggtgattggattaatggcggcggatggttatttataaatgggtatcatgttgacttgattttacgtgatataaaacgggtagaacaaataatcaaagatacggagcaaggaattgttactgccaattatcagaccgggcatccccatggttatataagtgcaatgtatcgtggagaattagcgattagtaaaatactatatgctaagaacgaaagcttatgcgaattaaaaaagcaggcagaaatttaccctactgctctaaagaaaagcttgatgaacttttttatatttgaagctgaattctctttaatgtttgtaaaagcaaatgcgggggtagaggataaatattatattgcaggccatgtttttcgtattatttcatgcttaaatcaagtactatttgcatgtaataatgcttattgcattaacgaaaagaaagctataaaactgcttgaaacttttgaatataaacctgaaaaatatgccgaaagagttaatcatatttttgaagtactcggtctttctctttttgaatgctacgatatgaccgagaaactttataaagaagtgaatgaaattgtatcggagataaataactttttaaacgaggagagttcagatgaaagaaaacaaatatgatgataatatattttttcaaaaatacagtcaaatgagtcgctcgcagaaaggactggctggtgcgggagaatgggagactttgaaaaagatgctacctgattttaagggtaagcgtgtgcttgatttaggatgcggctatggatggcactgtatatatgcgatggaaaacggtgcttcctctgtagtaggtgttgatatttctcataaaatgctcgaagtagcaaaaggaaaaacccattttccacagattgaatatgaatgctgtgccatagaagatgtggatttcccagaggagagctttgatgtaatactaagttcgcttgcgtttcattatgtagcagactatgagaatttaataaaaaagatatataggatgctgaaggctggtggcaatttagtttttacagttgaacatcctgtttttactgctcatggaacacaagactggtattataacgaaaaaggagaaatactgcatttcccggtggacaattattattatgagggcaaacggacagctatgtttttggaagaaaaggttacaaaatatcatagaacactgaccacatatctaaatacactgctttcaaatagttttataataaatcagattgtggagccacagccgccagagaacatgatggatattccggggatggcggatgaaatgcgacgcccaatgatgctgattgtatcggcaaaaaagaagatgtaataatatagaaaaaataaacgaggagtatgtaaatgagatcagaaaaagaaatgatggatttagtactttctttagcagaacaggatgaacgtattcgaattgtgacccttgaggggtcacgcgcaaatattaatatacctaaagatgaatttcaggattatgatattacatattttgtaagtgatatagaaccgtttatatctaatgatgactggcttaatcaatttgggaatataataatgatgcaaaagccggaggatatggaattattcccacctgaagaaaagggattttcctatcttatgctatttgatgattacaataaaattgatcttaccttattgcccttggaagagttagataattacctaaagggcgataaattaataaaggttctaattgataaagattgtagaattaaaagggacatagttccgactgatatagattatcatgtaagaaagccaagcgcaagggagtatgatgattgctgcaatgaattttggaatgtaacaccttatgttattaaaggattgtgccgcaaagagatactgtttgcaatcgatcatctgaaccagattctacggtttgaactacttaggatgatgtcgtggaaggttgggataaagacagaattttcattaagtgttgggaaaaattataagtatattaacaaatacattgatgaagatctatggaatagattattatctacatatcgcatggattcctatgaaaatatttggaagtcattatttatatgccaccaattgttcagggaagtgtccaaagaggtagcagaactactggggtttgattatccagagtatggtaagaacataacaagatataccgaggacatgtataaaaaatatgttgaaaatgactatttttaaagattagcaaagattattaaccataagcaaggggtgtaaatgtatggaaagtactgatgttataaatgaaattagaggtatattacctcgtaactcaattggaaaatatgatttactaactatttttacacataaaaccgtttttgataaaattgtaaaagtactatcattggattttcaaaataaagtagattatgtggctgccccagaagcaattggatggatactaggcactgccatagccaaagaacttggagtggggtttattggagtaagaaaaggtgataagctgccatacgcaaaagaagagattatttcgacacattttaccgactattcaggtcaagataaaagctttgaaatatctaagagttctattgtgaggaacaaaagagttttgattgtagatgattggatagagacaggttctcaaatgaaggctttaatagctttgttagagaaattggattgcagcattattgggttggctactattgggattgatataaatgaggttactcaaaaatggatagacagcagttttgtagcttatattggctcaaacatataataaaccgaaagaaaatcttgaatcaaaattttggatggcgttaatttacaatacaacgaaagatgtttaccctgaataattcatactttttaattgaaaccgtctgaaactgcctaacggcagtctgataattacttttttagtttcaccccttaagtgatgaaaaaagaaccccattctgctatggtaaaggtgacgaaaccaaccataagaaaggagttcttctcatgactagcttacacaaaaatcaagttaaattcaattcaaatatcactatttcacataccggtggtcgtctatcaagtgattcggggttagtcctggttaaagaattaatgaataccttcggcttttcgcacttagctaaacaatggctccatattacagatcatcgggcttattttacccatgataacttagcgatattggaacagcttattatgcaattaattgctggttactcggcagactcatcagctaatctattaagacgggatcctgtctttcaagctgtactcggtaaaaaacagttggcatcacaatcctcaatctcacggtttctggatcgtttcaccgaggagaacatcgatcaactccaagcattaaatcagtcattgattgataaagcacgtttaattcgcaatgacaccgagttaatcattgatgtcgattccacacattcggatacctttggacgccaagaacaaacagattataatgcccattatcaaacctacggctatcacccattagttgcctttgatggactgaccggagatttcttaaaagctgaactgcgttcaggcaatcagtacacatctaaaggggtaaaagcctttatcaacccgcttttacaccactacaagagcacgttacctcataccgagatattggttcggggtgacagcggcttcgccacaccagaggtgtatgagtcttgtgaagcaactgaaagccagtacgttatccgattaaagagcaatcggaggttaagtcagttagctgaacattctgttctttacggggacaatcaagaatgggaagagcgagaagtgcagtatttttcactaccttatcaagcacaatcctggtcgaaacctcgtcgtgtctgtatacgctccgtccgtgaaggaggagaattgctatttcatcatgcgtttattgtgactaatctatccgacaatgtctcgcctgaagtcatattttctctttacggcaagcgaggaacaatggaaaatttcatcaaagaagcgaaaggtggcttttacttcgataaaacagatagcccgcgtttcttagaaaatcatgtcagaatgatgatcagtgtccttgcatacaacctcgttaattttttaaaaagcattggttttgataaagtgaaccagggcatgacgattcattccatccggctgatattgcttaaagtagccggtaaacttgttcagactgggagacaggtctatctcaaactgtcaagttatcatgtgtatcaaactgaattttataaggtttttgaacgcctgcggcgatccaaacaatggatttagactagttatcacacaaattttttaaccgattctttttcaagggattcgtctgcccttaaatagacaaataatttttattatgatcttcttccgtaggcatcctgttcgaaaacacattattttggaagaaagtatctgcctaatttaaaaattggcaatttgttcaaaaaaacaggttaaatttagagctatgaattattcaggttttttcgaggtggaagctagtataaaagtaaaccaagggtcgtttaagggcgttctaagccccacacagcgttttaagagccaagaggaacttttatcctttgtttcttctaaacaagctaaaataggcaatcaagaggggataattgctgatgttcaaaccaaagagaagaaaacgaatagtccgagtttgttttctttaagtagtttacaatcaaaagtcaatcagctttataaagcgacagcaagccaaactttaaaagctatgcaaggactgtatgaagcaaaattattgagttatccaagaacagatacaccatttattacagagaacgaatttgcttatttaaaagcaaattttggcaaatatagcggttttttaggacttgatctcgaaatggttcaaacagagcctagaaagcgttatgtggacggtagtaaggtacaggaacaccacgccattatcccaacaaaacaagtacctaccgaatctgcattagcaaaaatggacgatttacaacgaaaaatatatgctttagtcgttaaaacgaccgttgccatgtttttacctgattacttgtatgaagaaaccaagatacaaacgaaagtagctgatttgctgtttcaatcgatcggaaagacaccaaaacaagaaggttggaaaattcttttcaaacaacaaaccaaagaagaaaaagaggacgttcaaacgttacccttggttatcattggagaacatgccgaggttgacgttaagagtgccgaaaaagaaacacaaccaccgaaagcttttacagagggtacattattaactgctatgaaaaccgctaataaaacggttgatgatgaagaagcaatcaagattttacaagaagtcgaggggatcggaacagaagcgacaagagcaagtattattgaagcgttaaaacaaaaagaatatatccaagtgattaagaatgcatgtgctgattataagaattatctttattatttattgtcacttccgttgcacgcataaaaccaacaagatttttattaatttttttatattgcatcattcggcgaaatccttgagccatatctgacaaactcttatttaattcttcgccatcataaacatttttaactgttaatgtgagaaacaaccaacgaactgttggcttttgtttaataacttcagcaacaaccttttgtgactgaatgccatgtttcattgctctcctccagttgcacattggacaaagcctggatttacaaaaccacactcgatacaactttctttcgcctgtttcacgattttgtttatactctaatatttcagcacaatcttttactctttcagcctttttaaattcaagaatatgcagaagttcaaagtaatcaacattagcgattttcttttctctccatggtctcacttttccactttttgtcttgtccactaaaacccttgatttttcatctgaataaatgctactattaggacacataatattaaaagaaacccccatctatttagttatttgtttggtcacttataactttaacagatggggtttttctgtgcaaccaattttaagggttttcaatactttaaaacacatacataccaacacttcaacgcacctttcagcaactaaaataaaaatgacgttatttctatatgtatcaagataagaaagaacaagttcaaaaccatcaaaaaaagacaccttttcaggtgctttttttattttataaactcattccctgatctcgacttcgttctttttttacctctcggttatgagttagttcaaattcgttctttttaggttctaaatcgtgtttttcttggaattgtgctgttttatcctttaccttgtctacaaaccccttaaaaacgtttttaaaggcttttaagccgtctgtacgttccttaaggaattccttagtgctttcatagattaaactcacatcacgctttaaatcgcttattttagactttaaagacttgttttcttcaagcaactcattataatcatttacattttcattaaatcgctctacaagaccactatatttttctttaacttgcccatgttctttacttaattttttatattctctcgccatatcagtactcatgagatttctaacatgctgttttaacctatcgttatctctcgcagcagtcactaagtttttataatcacgctccgatataacaacatttttggttggtttcttttctgttttcattatttcttttcccaaaccaaacatggacttttcacccgttggcacttcaacacttttcatgtgtcgtttcgctggtacttctaaatctgatttaactttatcgctataagcagtccattcatcttttttaactgctaaatttttttctagaaaatcaatctctttttccaaagtttgttttttaaatttagctgtctcaatatgtttacggtcagagccacgttcaccacgcttcaactcaaaaccctgttttttcatatgctcggggaatttatcttgtagccataacagttcttgacgattaaacacattttttccttgcagttttccatcacgcataggcacaacacctaaatgcatgtgaggggtttgctcatcattatgaactgttgcataagcaatattttgcttgccatatcgttcggaaaataatttataactttcctcaaaaaatcgtttttgttctcctggatccagttgctcaaaaaaatctcggtcagatgttactagcaactcatttacaagaacagcatctttcctcgtttttcttgtacctgttttttgtgattcaataatttctttgacacgttcgttgtaatcaatatttttatcatttttcaaatcataattttcacgtgttcgctcatggtcaatatcatcattcgttctactttttcgctctctttgattatgaaattgcatgccttttagtccagctgatttcactttttgcattctacaaactgcataactcatatgtaaatcgctcctttttaggtggcacaaatgtgaggcattttcgctctttccggcaaccacttccaagtaaagtataacacactatactttatattcataaagtgtgtgctctgcgaggctgtcggcagtgccgaccaaaaccataaaacctttaagacctttcttttttttacgagaaaaaagaaacaaaaaaacctgccctctgccacctcagcaaaggggggttttgctctcgtgctcgtttaaaaatcagcaagggacaggtagtattttttgagaagatcactcaaaaaatctccacctttaaacccttgccaatttttattttgtccgttttgtctagcttaccgaaagccagactcagcaagaataaaatttttattgtctttcggttttctagtgtaacggacaaaaccactcaaaataaaaaagatacaagagaggtctctcgtatcttttattcagcaatcgcgccctttaatggaacaaaaagatttgaattcctgttataaaaaaaggatcaattttgaactctctcccaaagttgatcccttaacgatttagaaatccctttgagaatgtttatatacattcaaggtaaccagccaactaatgacaatgattcctgaaaaaagtaataacaaattactatacagataagttgactgatcaacttccataggtaacaacctttgatcaagtaagggtatggataataaaccacctacaattgcaatacctgttccctctgataaaaagctggtaaagttaagcaaactcattccagcaccagcttcctgctgtttcaagctacttgaaacaattgttgatataactgttttggtgaacgaaagcccacctaaaacaaatacgattataattgtcatgaaccatgatgttgtttctaaaagaaaggaagcagttaaaaagctaacagaaagaaatgtaactccgatgtttaacacgtataaaggacctcttctatcaacaagtatcccaccaatgtagccgaaaataatgacactcattgttccagggaaaataattacacttccgatttcggcagtacttagctggtgaacatctttcatcatataaggaaccatagagacaaaccctgctactgttccaaatataattcccccacaaagaactccaatcataaaaggtatatttttccctaatccgggatcaacaaaaggatctgttactttcctgatatgttttacaaatatcaggaatgacagcacgctaacgataagaaaagaaatgctatatgatgttgtaaacaacataaaaaatacaatgcctacagacattagtataattcctttgatatcaaaatgaccttttatccttacttctttctttaataatttcataagaaacggaacagtgataattgttatcataggaatgagtagaagataggaccaatgaatataatgggctatcattccaccaatcgctggaccgactccttctcccatggctactatcgatccaataagaccaaatgctttacccctattttcctttggaatatagcgcgcaactacaaccattacgagtgctggaaatgcagctgcaccagccccttgaataaaacgagccataataagtaaggaaaagaaagaatggccaacaaacccaattaccgacccgaaacaatttattataattccaaataggagtaaccttttgatgcctaattgatcagatagctttccatatacagctgttccaatggaaaaggttaacataaaggctgtgttcacccagtttgtactcgcaggtggtttattaaaatcatttgcaatatcaggtaatgagacgttcaaaaccatttcatttaatacgctaaaaaaagataaaatgcaaagccaaattaaaatttggttgtgtcgtaaattcgattgtgaataggatgtattcacatttcaccctccaataatgagggcagacgtagtttatagggttaatgatacgcttccctcttttaattgaaccctgttacattcatttcacttcataattaattcctcctttacactttaattcaaatctttattaaaaaatatttcatcttatttaacaagaaaccatatttatataacaacataaaatacactaagttattttattgaacatatatcgtactttatctatccgactatttggacgacggggctggcaaacaggttcaccggtagtaacatggtacccttttaactctgttaaacaaacactacgtccatttgtaaagaaagttaaatcactacgatattcttgaatacaccgagcagggatttctccactaagaatgacctcattatttttcaattgagtgtctacgatgttcgcacaatatttaggagcatcgttgtatgctcgtgaaagatattcctgtggcgcataaattttaaaactaagatatggctctaacaattctgttccagctttttttaagacttgttccaatacaataggagcaagcatccgaaaatctgctggggtactaacagggctatagtataagccatacttaaaacagattttacaatccgtcacattccaaccatataatccttgttcgcaaccatagcgtatcccttccataactgcattttgaaatgattgatttaagtatccaagagaaaccgagctctcatactgcattccacttcccaacggaagcggtgatacagataaaccaatggaagcccagaaaggatttggcggcacttcgatgtgaatggtatattctgcattttttaacggtctctccatataaatgactgtaggctcttttagttctatctccacatgatacttttcttgcaacagtgcactaatcacttccatttgtactttccctaagaaagaaagtataatttcatgtgtcgtagaatccacataatattgtagaagcgggtcactgtcggagatttctaaaagtgcatcaagtaacatttccctttgttgaggtttgctcggttcaacagttgtttgcagcagagggagcggattttcaattctctctctctgtggcaatagctttgtatctccaagaacactatttagcttcaaaaactcattttgcaaaataacaatttccccggaataagccttatcaattttacataattcaccatttattgaagtatacatttctgtaatttttattttttccttttccgatattctaaccgaatcccgcaaatgcaggattccgccataaaggcgtacatatgcaagacgttgtctttcttccgaatattcaattttgaagacatttccgcaaagttcagacttctttctgtatgttgatgaataaaatttattcgttatcacttctataagctgctcaatccctatgttgctttttgcgcttccatgataaacagggtacaaggagcaattctgaaatcttctgatttcctcttgttcgagttctaatgcttctaatgatttaccggacatatatttctctaaaaggtcatcatttccttctattaccacatcccattgctcaggttccgtacagctcatcacacacatattagggtgcagctctactttctgtttgattataatttccatagaaagtttctctttaatatcctgataaaccgttgataaatcaattccattttggtcaatcttattgataaaaaagattgtgggaatccccattttcctaagtgcatgaaataatatacgagtttgtgcttgtacgccatcttttgcagaaatcagtagaattgccccatctaaaactgataatgaacgatatacttctgctaagaaatccatatgtcctggcgtgtctatgatgttcaccttcgtattttcccactgaaaagaggttattcctgtctgaattgtaattcctctctgacgttctaaaagcgtattatccgtcctcgttgtacctttgtccacgcttcctaattctgtaatcgctccactgttatataataagctttctgttaaggtagtttttcctgcatcaacatgagctaaaactccaatattaataattttcatgtgattttcctccattcaaaaacccaaaagggcataaaaatcccagtgataaatacttttatcactgggatttttatgcataaccataggtatacaaagcatacagatattctctggatactttagaatcacatgataaaggtattcttaaactgggtacaaaaaactaagccctcctaaaaaaggacatctaattatttgttcctgctatcaaattgacagtttatttaagaataccttgccgcatatttattaactccttttaaatagtcacttaaataatagcacgtaagagcatatttgtaaaggaatctccaattttttatcaaaaagagtacatgattacaaagtatctgtaatcatgtaccaatatttgttattttacaatcttccaattactcccgttcttttcaagtaccaaatcaaattgagatacctgcgttgctttggtctgctggtcgatatactccactgtcagcgataccgtgacttgattatccttacgattgtgaataggatttaccagttcttgaaagatgtactcttttccgattggttttaatatcccgtcattcacatagtaggaaagttcactggctgtcgctgtaggatagagcttgaagaacgtcgttaaaaactcattgatttcattggttgtaatggaatcaaccgtcccctcactttcaatggcttttggtttataacttgatttcttaggtatgttggtaatggtcggattcttaaccagtaccatatttccagaaccatctacatagacactcactatataagcagagtggacggtctttgtattttctccctctgtaatgagctggtctacactgtaggttacattaaactcattgtcgccagttggctctaccgtccatatctgaaatcctcttacagaagacgatacaggaatatctttgcgtactgtatcaacattgagagcttgaagttcatctgtcagatagccttttagactttccattcgattatcaatggacttatcggattgctcccatgaatagtagactttcgcaaagttctctacaaaattttctacatgatgagtatcaacgtattccttttctatgatagttgtttcgtgaatagtatgagtatctatagctgtaaagtgcttgaatatcgcaaagctgaaactaagccctaaaagtacccacaaggcaatcacaacctttttatgaggattgaccttatagacacgaggtttcttttcctttggtatctgtttttctttattctgattttttctaaatttcatcattaaatcttcctttctcattgtttgattcgtcctgctcccactaaatgctgttgccagtaggggcttgttaagtcggcataaccgattgggtcgcctgcatgaaacatacggttattgccaaggtatatcccaacatgagtaatataagagccagcgttataggtagaatgaaagaaaaccaaatcgccagcttgtgcttccgatagtgggatatgctgggtcacatcatattgctgttgtgcggttcgtggtaagttaattccagcttttccatacgtccattgtgtcagtccgctacaatcaaaagaagtagtcggggaagctccaccgtaaacgtatcgccagccctcatatttcagtgcttcgtccatgatggcttgtaccgtatcatcatcaaactctgttgtgacaagatactgcgttaccagttgcacataaaacatattgccatagttgtatcgccagcccccattgataggtatggctatgggattggggtaagacactttttcgccacctgaatactcttttgagaaactttgagccagttcaaaggtatatttatttccacgattagccacataccctaagaaaccaccaccataattgtaggactggataaccgattctaaatctacactgagcctttcgctactggctaataattcactgaaatacttcacaccttgcttaatggattcttctgtactcaatgaattaggtggaagaccgagggattccgaggactgcataacatcttccgcagtaccgcccgattccacctgtataatcgcaagaagtatgttgacatattcttcaacgccatattctttggcatatttttctaccataggcttatgagccagcacttctgcggaaacattcacacctccataatgaatattggaaattccgctgtcctgttcatctgaaaataaaatggcaacaaacagaagcagtgagaagaccatcaagaatagcccagaaccaccaatcactaaagctttcagtttcatggtttcttactgcctttcttgatagtggcggattttattggtggtctatttctaaggttttggctttgaactctttgaacagtagacggacgctcttttgtgactggacgttgtgaagctctgtctgctggtgtagttgaagttgctggcttttgaactgttctttcttgtgtagtacggttttgtcgttccgcttttaaacttaaagaatcggacttaactgctggacgctcctgtttggcttgttgagattccatgcgtgaagtctgaatagaagattgttttgcggtctgtccatcatgagattgttcttgcttagtagctggtctttcatgaacggaagaagctggctgttttttctgtttgacctgttccatttcagagcgacgctctgcaatggttttgcgtctttgttcctgctgttccttgcgtccgctggctctgtctgctctggtttgagaaatactggaagttaggtcacgaacattttcttttgctttggattttccttgatacactgcatatcttgcattggtcggaatatccttaacctgttctttgagattaccagcagaatcaacgattttatctttggtatcagcaactgctccgattgtttgtccgatacgttttccaagtgttgatttttcctgtccgtctggacgggtgtgatctgcttgtgtcctaccagaactacccgactgtccttgttttcctgtagcactggcaatggcagagccagcacctaaagctgtcatggagcgtccaagtttacgctgtaggcggtgcatatgagcgtgcataagcatacgaggttttctcatcacacgacttcccacactttgagaatcgttgctttgaagcgaaaacatactcattaaatcgctcagtttgaagtagattcctgcaaaggtcacaatctgtaaaaaggcaatcaaaaagaacggataaccagccgataaggtatagagcatggttgaaatactaaaggctgtcgtaataatcagcgtgattccagctcgtgtcaaaatggtattaaagagtttgataatggctcgttttgacataccatcaaaggacggaatcatgcttaaaataaagctcacaggcagaaacatggcatagatgataaaaagtacctgcgagaaaatcatgattcctgttagtaggaatacgaatatagaaatcccgatattgaatacaaagagaaagaagactgtacccaaacggttaatagtttttgtaatcgtcatgttcacattgtttctgtcttcgatttcttctgctacaattttttctctgtcttctccattattactgtctggactggttgaaagtagactttccacacggtcagcaccaatactttcaatgtctgaactgttgtattgaagcagtagccacggttgctgaacctgtatggaaaacaggctatctctgattaagtccacgctgtccttgccttgactatcggaatggggcatgacaatcttcgtgccaagtgataaactggcattactgatgtctgatgaaaagtcattgatttttttaatgtagtcgggagcgtaggcaataaaggaagccgataggataaacaccagcacaaaattcataatggcatgaattgcctttgtggtttctctctttatcagtcccgtataggcaacataaaccccaagaaccaaaatcaagagtaagaggaatccaacatagaaaccctctgttgaaaatccgtttgcactcacaccagctaaggtctgcatattcttaccaatggaatctgctgtagcggaaatgaagtctaaggaataggcttcctgtactaagtaacctgtcgcattggaaacatacaaactgattgtccaaataaaattggtaatggcatatagtccatacatgacctgttttccaatcccgtccgaccagttccacggaagccagccccagctattatccacataaaaatccagttgatagttttcaagtgggtatcggctgtattcatttgccacattgaccgtatcatctaccaagcccgcagcttgaaccaccgttcccagcatggctaaaagaaaaatggcaatcacaagtgtgaaagccactgtcattgccactttacctagacgtttcagcgtccagtttgattttattctgtttactattgatggtttcacatttacacctcttttcgcacaggtggtctggtatcaaaggcatggagcagttcttcaaatacagggtggaactgtatcacaccgacacgaccatataaatcactgataaggcattgcccgttttccaaatcacgcaatcgcttctgattgttttcgtcctctgggtctacaccaaaaaaggctaaggtctttttaatctcgttaaggtcagtggaacgaaatgcaaattttaagccgaggttatttttcagtttttcatctaagaggtcgtctgtattttgggtcacgaaatataccccagcgttcatagcacgaccagcccgaaccagcttcatagatagtgtttttccttgtgctacctgtaaaaagctccatgcttcgtctaaatctacaatcttgaaaatgcttcggtctgtatggataaagtctaaagcaaaggtactaatgacaatcagcatagcaacggataaaagctccatagtggtatattcctcaaaggaagtttccttgtcgggaagtaccaagtccgcaacctgtataatgttcagttgtttttctaagctgatagactgctccacataaccattactgaataataaatgtgcaaagtcatagtctgtaaaactttcgatatggtcggctatactggtacttagtggcgtattctcaacccgtaattcctcaatcactttcatcaaccctcgtacttcactattggttactgcacgaatggcttttctaaggattgggaagcgttccccatcacgagaggaaatccccgtaaggaatgtcagaatatcaatagccagtgattcagaatctttgggatttttcataatcacataagggtcaagtaagcctttgtttttctcatcagaagtcagagtgacgatattgatttcatgggaaatctctggcaaggtttctttccatctgccacgttctgcttttgggtctacaatcactgcttgtgccccataaagcaccgcataatagacgataaggttattcgcaaaggatttaccaccacccagcgaaccaacaaaagccgacgctaacgcattggttactgaacccttaaccccttgactggcaagagcaggtttcagatagacattgcgtccagtatctaagctgtagccaacataaatcccctcattttcccccagcatttgagtagcaccaaaacctaaaccagcgaggaaatcagaggtcacgtattgaatataatcattcatataacgcttgctggcaggtaaaaattcttcatgtaagccgagcatatccccaaatggtcgtaccagttttacgcttaaatcgtcataaaaatctttcacttcattacaacgacgtttgagttcgtcaagatcatttgctgatacccttaccacataagacagcttgtacatagattccttgctttggtctaaattggtttccagctcattcacactttccagagcttccgccacattggagctggtttcattatcactttgccaagcgtggttatccaagtctttcagttctttctttttattgcggacagtagatagggctttacgattcgctacaatttccacattcattgacgtatcaatcgggaatgtaaattgctgttgctggtagtagaagatttcagaggacgggaagtccagttctccgacaatgctgttaatggtaaagtaagctacatagacggtttcatcttcctgctggattttcaaatatcgctgtttttcttccaccaaacagcgagtaggcttaatcaagtcatagtatttaatcagcgtttcattatccagctttttctttgatagatggtactcatactcttcataggcagtgcctgtctgtccgtaaaggtgttcaatcagatagccgaagtcgtccttatctaacctgcggattttgaaacgacgagagattttattttctaagagcttttccatcttctgaaaacgcaggatttcatcattactcatactaacaaaatcgcccatcagcttatggttcacatcatagacaaaatcagacaaagcattttttgcttcaacggtaagacttttcatagaaaactcctgatcgttgagaagcaacttaaagccgataaagaaacggtagttcacttgattttcgccaatcatggatattaaagcgtctgtctgttggtcgattttgtcataggcaaccgctttgagcttgccagtgacttcatttttggaacgctcttgtgcagaacgtatgctggattctgtactgatttgtaaagcatgaattttgccatcacgattttgtgcgataagctgtctgaaagaatcatgcacttgtattttctgttctggacttagaaatgagtaattgtaaggaacaagctcatagtaagcataacattccccgtctttattccagacgagattgttttcaatgtatttaattggatatgccataaaattcactcctaactgctgtaatggcttcttgtggctggtttctgccaagcgttactttttttcctgcataggtcagctttggtcgcagtgcataagcaatgacagacttcaaaaatccataaggctttttaccatcaaaagtttttgtagacataaaccatgtgaaagccacaggaatcccaaagtatttgagaaatgctccctctatcatggaaagagggggcaagttgccaagtatcatcactgcaaagagtgacacgacaaaccatgtcatttgcgtaaaggttatgggaaacggaagtctaaaatcattgatagaatacagtaccttttccacagaccagatactggtatagcttcgtattttcttcatgtaatcaatcctttcataaaaaataggggtagctgattgagccaccccgtaaaatagaaaatctgccagtagtaatgtaccgacagatttaatagacgatttcaaaaatcccatgattggttgagataaacgttcctgaaaggtctaaatcccgaccataggcttgataatcaatatagttttgaagactagctggtacttcgcctaaagcacccgtttcttcaatgtagtagcgtgccacgtcatacatatcatcacaatcggaatgaatgataatatcctcttgatgttcgcttagttcttcaatgcttgaaaaatgagtgagcagagcagatagctccgattgtaattcttcgggtaattccgataccatttcccatagtcgattgagttcgccaatggaagtgtattcgtcaaccgtaaagggtaactcgtagtcatgaatggcgtattcctcatattcatcattcaagccgattttctctttgacttcctcaaagtcaatgggaaaggtaaaccacgcaccgaccaattcgccctcattgtatttgcctaaattcgcaatatagacttgcatatcgtccatatattcacgtcctttctttgtagagattcaaaaatccctaccgcacttcgtttggtgtaccattcctttgcggaacataagaaaaccacttatattccacaaaagaacggttttatttaagcaccaataatgcgattgaatagctctagtaaaatgtcttttactccagcagcgttgaagactaagccaaccgcaataatcgcaataattaaaaagccaatcagtttgctaaactcacgcttgaagccaagatacaagccaatcacaacgattgctaaaagcaccagtgattgagcgtttgatagaaaccagttataaaggttttgtccaaaattcataaaaatgttctcctctctatattcaatgaatttgtatttgagttatttttttgttgttatcacgtcctgttcttttactgactgttgcttcaaaatctgcttgtgtcggtctgtcagtttcgcatggtcgagaatgtcttttacaacctgcgtctggttgatttcatcaagtttaatcgcaacctttaaggtcggggcaacttgatgagatagccagttcagcgtcctttggaaggagtaaggctctggttttgtggttagttttaatcgttcacgattgttcccaataaaccaagcccattcttcattcagtttccaatcagaacgaggtttggaatcgtctttatctacaaaacggatataccgattgataattttaaaggcggtatgctctggattgtcatagacgagtaaatcacggactgcataataggcacgctcatttttcaatcgaatctcaaaacggttttttacttctgcgtcttcaatgggaatatcatttttcttgtactgctcgtagtccttttcatagatacagaaataaacttcactttgtaatgaaccgatatagagggtgtttcccatacattccttttcctctttgcgtaccagttcgccactgcgatagcttttaaaactgcggaagacggagatacattcttcctgttggcacttttcagtgagtacagggatattcaaaatccctgtcttatcgttaatggcaaggtcaaggcgtttcatcacaccgccagccaccaaaacgtccataaagaactcataccagcttctttgttgtgccagaagatagctttcaaattgtctgcacccacgacctttcaattccaccagaactcctttgtccagttcatgggagcaaaggacgaatatgtcgcctaaagcataatgctctgaataagaatagaaaccatagtcctcatgaagaaaataggacagtttcagttgtaagatgttttcgaccacctgctgtacgtctgttgtcggaaagcgaatccttacataatcaaacagcatttcaaggggagcgtcgggattgaagcgttccagagcttcccaaagggactgctgtaaatcctctgatggcttgacttttcctgtttcaatatcgcttagatactgccttgtaataccagtcgcaacagctaaacggttttgagatagtccataagccaagcgtttttcttttaaatgctgtaaccaagtttgttcattcagtaaaaatccctccaatcaaaaaggcgtatgtcaacttttaaagcccatttgacatacgctgaaattttgtaaatcccttgtaaccaaaggattttctaatgtttttttgactgtttcctgtcgatttgtacccccctgttagatacggggggttaagtgctggcgtggctattgccacaccagccagcaagatcagtccacacctgcgacttccgcttcgcacgtcgcctgcgtggactgtctgctgttggataactttttaatttcctccaagaaatcatatccttttggtacaaggggagtataaaactctgatatgacacttgttcctacatcaacatagccacgacctttgattcgctttaagaagaaatccttttgtacgtcactgccaaacatcatgccatagcccatttcagacatacgacctaaagccactctgaaattaaactgatcacggattccgtcgcctaaatattttgcgtctggacgttgacaagccagtattagaaagaagccagcttgacgacctaacatgacaatctgtttcagcttattcataactgcggtgttttcttttgttcccagcatttccatgaaagcgacgtattcatcaaagattaagaagtgtgccgggagacctaagtaagcataatttttgccagtcttatagttcttcatctgcttcatttcctcactacgtttcatcatttcttcatagaatgtttcaatgcaagaaagcaagtcttcttttctatagtagacatttgccatcacagaacctaagtccgcaaggtcagcatttttcgggtcaagaatatacagttttgaatctgtatgaagcaaggcttcaatcagtgtcagtataaagtaagttttaccgccacctgtaccaccagcaatcaacatatgagggagcttatcatattcccaccatacgtttttcattaagcgaagtttaccatctttagcttctacttcatcaatagaaatacgactggctatggtgtcatagagcaaagtatattccacataggaatcctttaactctttatccgtcagctcacagtacaagccactctctaatttcttttccaagtgtaagagttggtcttgatattttcccagcgtgatttccacccgtatctgtatcaagccatttttaagtcgataatacattttagggaagtaggttatcttttcctttgtacgaccagcactatctttaaagaaaccctctgttttgacctgttcagattcataccacttgttttcaagtatcatctttgccagtttttgacggtggtaaagttgtttaaccgtatcatagcgaacccgtttgaatacaaacgctaccagcaagcagataagaattgcgacactgaaactgataattaaatagggaatgtcaatcttatctgcttgtgataggttaaaatcctgccagttgatctgctggattgtcttcacatgaaacagtccgacaaccagcaggaaaacaggcaggagtgacgctatcgtaaaatgaaagactaaatctttaccagatgggcgaatccttttaccacgctgtttcatgcgaaaaagtctcctttctacctagcgactatttgtcttgtgtcggttctttctttgcttgtggttgagctttgaatgaactagaatcctttgtcagcacaatatcgtctgccttgatataccagtcaacatctgctccttgataggtggcagtagcaacggtgtccgcaatgggattgataagttccacccgtgcgttataatcaaactctttcaaaggcacgctggcaggaatacttacttgaatcatgcgtccttgtcctttggattttaagtcataggtacgttccttgatttcatctgaaaccgacccgtcttcattttggattctcacttcacgacgtagagcagagaatttcaattctccaaaagtcgtgtctttatctaatacaatgccatttgctaatctcatcatttttcctctctttctttattcttttatcatgtcgtcagcatgtaaaaggtaatttgtaaaaccacgagtgccgattttgtagccctctgcggtaatacgtggattgactaacttcacacgttcctcaaagccgaaatgtttttcgccagcttcagcaggaagcaccaccacaatatcatctgctctttgaacatcagaatagagattatagcttcttgataagacagttagccgtccgttgattcttcgctgaacgactttatcctcgccagcaaattctaaattgccgaatgttttttccatgttgggaatcacaaatttaagttccatatttttacctatcctttcttttttattggctgaatgaatgtttgatggtcttaaagagtggggaacgaccttttgattcttgattttttgttttcataagttcacttcctttcaaaatcgggtaaaaaaatagacacctcattttttgaagtgtctacctattaaatattcaaattttattggaagtatctttatatcttcacttttcaaggataaatcgtcgtatcaaagctcattcataagtagtaaattagtagtaaattgagtggttttgaccttgataaagtgtgataagtccagtttttatgcggataactagatttttatgctatttttgataaaacaaatagcttatatatttcatgcatgataaacaatgatagatacataggtatagccaaaactaagacttgcagtatagttactccataatctatagacaaaatactgattgctagaagtccatagcctaccagagaagtaatgatcgttatgttggtagccttatgggagcgtcaataattttgtgtaaataaattgtcctcctgcaaaataattagttactcagtaaacattgaaactaatgtatcggttacctgttgaaaacctttatggcttctgtttagaaatttttgattgtatgtatcaaaaatgctgactagaaagcgttctagtgattcttcattttgaaactgctcttttctacggctgtatcttttaatttgcttattgaaagactcgattagattggttgagtaaatggttctacgaatgctaggtggaaaatcataaaaagttaataagtcttggttttctatgagtgactgcgtcactttaggatagtttttcttccatttctcaatcatgccggataagaaggtattcgcttcttcttttgagttagcttgataaacagccttaaagtcatcacagatttcttttcggaaagaaaggagtttacgttatgttgtttcaatcgattgccttaggtctggtcggaatcgtgtgcgtcttggactctagactactagggaggatgaattttgaacggcctttaatcgtgagtacgttagttgggttagtattaggtgacttggaaaaaggtttgttggttggtgcttctctggaattgatgtcgcttggtctggtaaatatcggagcagcagctccaccggatatgaatatggcgtccattattgctacagcttttgctattctatctggctccaatgctgaaactgctctgactattgccattccaatctctgtgttaggacaaatgcttggaatattgatgcggacggtactctcaaatctgacacattgggcagataatttaatcaatgaaggaaagttcagcagagcacgacggatccacataatctatggtacggtcttatattcactgatgtattttatccctatctttttagctgtttactttggaacagatttagtgaaaaatatcgtgagcagtatcccagtatggttgacaaatggtctgactttagcaagcaaaattttaccagcatatggttttgctttgttgttacaaacgatgttgacgaaaaaaatgatcccgtttttattacttggttttctaatcacagcttactccggattaagcatcacaggtatcgcagcttttgcttgcattgtggcctttgtgatggcacaagtcaaattcaatggtaaagataataggacagctgtaagcgaacctgatcctttagatgatttatagaaaggagtttttttatgactaagaaagatcaaaatagttggaagtatcggcaatttttctggcgttcatgggcaatacaagcttcgtggaactacgaacgacaaatgaatatggggtttatgtatgggatcgcaccaatcatcgataaaatctatgacaagccagaagacaaacaaaagaaaatcgatgcttatgagcggcacatggcttactacaattgtacgccgcaaacaagttcattcgttttagggctagcagcatctatggaagaacaatatgccgaagatcaagagaatttcaatccggaaaccatcagtgctttgaagacttcgcttatgggccctttgtcaggaatcggagactctttcttccaaggaaccatacgtgttttggcctttggctttggaatcaatctcgctcagcaaggtagtatcttaggccctatcttggccattatcatctccttcattccgtcctttttcgttacatattatggcggaaaaattggttataatactgggaataaatatttagcgaaactgtatcaagaaggtctgatggataaagtgatgtatgtttgtacgattatcggtttgatggtcattggagccatgattgctagtatgattgggatcaccacgccgctaagattcggcaaggcgtttgttttacaggatgttttagataatatcatgccccagttgattcctttagggctgacattttttatgtattggttgttgcaaaagaaagttcggaccggtttgatgctcactatttgtatcgctggtggtgttttactaagtttatgcgggatttttaattaagggaccaacctaatttaggttaaaaataaatagtatgaggaggaattcaaacatgaattcaacattaagtccaaaagatatcgtcaaagaaatcatcgcgaacaaagaggtggagtccatcgtatttgtcggctgtggtgcatcgaaagcagatctatatccagcatttatgatttgtcgcaagaaagtgcaaagggagcacgtctacaagcaaaaaaattcgccgaacgtttcaaaaacgaaaaggtgatatatgttatgagttcaggagccactcatgaagttgcgtattccacttctatttgtttaatgatggagatgcaatggattcactctggtactttccattctggtgaatttttccatggaccatttgaaatcacggacaaagacgtaccatttatcttattgatgaatgatggtcgtacgcgccaaatggatgcccgagcattgacatttttgaatcgtttcgatgcaaaaatagaaatcgtagatgcactagattggggactgtctgcccacattgcgaaagaggttcttgattacttcaatccattcgtcatcacagcagtattccgcgtctatgcagaagaattagctgaagtacgccagcatccgctgacaaagcgtcgttatatgtggaaattagagtattaaactagagctgaggccaagtgcctcggcttttcttcccttacgttgaaaagggtttcttattctcgtacaattgattgagcaagagtaaattgggtggtgttgatcatgaacaaaaaagtagaaaaatatttaaaagagctgacaaaaaattacagtgagcatcatgcagaagagttttcagctttatcaattagcgaaaatgtcggtttgaatcgcagtacaacaagcttctacttaaatcaaggaatgaaagaaggagtattggtcaaggtcaagagttaccccgtctcttttttacatgttgcaactttagctgaacttggcattttcaacagagaatctgaatatgaaatttgggaagacttattttcagcagaaaaagccaatgcattagaaacggtgattggagcaaatggcagcttaagagaagcagttgatcaaataaagacagcagtactttatcctgggaatgggttacctattcttttatcgggcaatagcggttcaggaaaaacatttttagcagaaaaaatctatgaatatgctgtagcagaaaaggtcatcccaaaagatgctccgtttatctcttataattgtgcccaatatttcaacaatcctgaactcttgtcttttgctttgtttggccatgtcaaaggagcatttaccggagcagaaaaagaacatattggattgatagaaaaagctgataatggggtattatttttggatgaggtacaccgcttaagtgatgaaggacaagaaaagctttttacatttatggatacaggagaaatttcaccgatgggggacaatgcaattagacataaagtaaacgtccgtatgatatttgcaacaactgagaatgtctatcaaacatttttgccgacctttattcgccgttcgccagtgattgtcatgttgccgaattatgaacgtcgtccgcaatcagagcgtatgcaactgatagacacattttttatcaatgaagcgaatattttgtcaaaacgcatcgatgtaagttatcaactagtggactttttgcttaatagtgacctagaaggcaatgtagggaagataaaaaacatcgtgaaatatgtctgcggtagtgcgtacgccaaaaaccaaaatagtctgtctattcgagttcgtttgaaggatcttccaactgaaaataccatgcagctaaaagagcagctgaaaaaaacaatcaaagctttaccagaccgccaatatttgccgcatacagctaaccaagtctttttagaatcttcagaagtcaggcaaatcaggcagttatttgaaaaaatagtgcaaatgtatcaaaaagttgaaaagcaagaattaatgatcaaagattttattgatcatacggtaaatcgaatcaatcatttgatggacgagtttatttttaaagatagttactcgaaagaagaatcattttattctgtactaacctatcagatacgagaaacttttgaatggatgcatgaaaactacggattggaccaagatggtaatcgtgtgattgccctagcccagtatctctaccataaaaacaacacagatatgattgcagaaaaccatgaatggcaaagtgtcaaagacaagttgttagaattggtttcgagttccatagatacttcttattggtatgctaaaaaagtactaggacatatttctcgacaattagatcaagattttaaagaggaagatttgatttttatttccttttattttcatgggttgcagatcacgctaggagaaaagaaaatcaagagtatcattttagctcatggttattctactgctagcagtatggcgaacgtaggcaatcggatactgaagcagaatatctttcaagcttatgatatgccaatcaatatcacgttagctaaagtagaaaaacaagtcattcgctttatcaatgatcatcaaacggacgccgggttgattttattagtagatatggggtcgttgaacgaaatcggaaaaaagctagcagataaaatacgtggaccactgctggttatcgattatgtctctacgcctcttgtattggagattgggcagttgattcaaagacaaatgtctatcgcagaaatcagccaaaaaatcgatatagaaaacaaagttaaaaaacagctaattctaccaaaaaaagaaaaaacacaggcaatcttaacttgctgttacactggaataggttcagctactcaaatacaagagattttggaatcttgtttagaaaatcattgcaaagaattgacgattattccgtatgattacaaaaaattgcaaaaaaataaaatgtatgaggatcctttccagatatatgaagtattgatgattgtaggaacagaagatcccaaaatcgaacaggttccttatattggtcttgatcatttaattaacggtgaagatgttgagaagtttatttcaattctacaagattattttgacatacgtgataaagatttaaaagaacagctgatgttcagcttttcaattaataaaatcatcgagaatttaacgattttggacgcaactaaactattgcgtttagtgcaaagtgctgtatccgtagctgaggaaaccttagagattactctatctaatagtaagttgtttttactatacctacattgttgctgtatgattgaacgaattttaaggaaagaaagtgtggatgaacaagaagatatagaggaatatacgactcaagcaggtgcagaaatggaacagattcatcgtgcctttttcgaaatagagagtgagtatactatcaagatttccacattggaattacgattgattcatgaaattatttatggataggaggaaggtttgtgaatttaggcatgatttttgatatggatggtgtcttaattgactcagaaaacttttattttgatcgacgtatgcaatttttcaaagaaaaaaacatcctaccaggttcgacgaataagttggatttcgttggactgacagaaaatgggatttgggaagtattggtctcagaaaaagaccaacgagctgatcttagaaaagaataccttgcgtaccgggaaaaacatcctattgactttaaaatagcactgcgaaagggtgcggaagacatcttggattatttaaaaaagaaaagtatcaaaattgctcttgcttcttctccgcaaagagaaatcgacaaaatgctgacacagaatgctttagcaccatacttcgattttgtcatttcaggggaaaagctatctaaaagcaaaccacatccagaaatttatcaaatcgcagtaaatgcattggatgttagacattgcatcgcagtagaagattctcctgttggtattgcatcagcaaaagcagctaatttatatacgattgcattaaagcaagatctgccccttgatcaggcacaagcagatatcgtgattgatgagttgaatgatatcatccaaataatcgaaacttacgatatatagtacttcaaaaaatactaaattcttgtagctatacgttctagaatgggttgacgattgtatgatatggtggaataatagtcaaaaatgactgttaggagcatcaatatgacaacaaaaagcaattctttatccacctctgaatctagtatcgaaggcttgaaaatcatccatacaaaaatggtgacggatgatcgtggaacagtacgtgagctttatcgacaaagtagttattctgaaatcattccttatgctgtttcttcatggaaacaggtgaatctaactagaacgaaacaaggagcagttcgtggtcttcacggagaagcgatgtcgaagctggttactgttgctcacggctctgcttttggtgtgtacgtagatacaagaccccatagcaagaccatcggcaaggttgtcacagttcttctaaaaccagggatccaagtttttgttcctcaaggagtatgcaatggattccaagctcttgacgatgatacagaatatctttacttttttgataatgaatgggtgcccgggatgccgggagtcgcattatgcccgctagactctgaattaggcattacatggcccattcctatcgataccaataatcctgcacaaatatctgaaaaagatttaaatgctccgaaatttcgtgaaatttttgaacaagaatcttaagcatataattaattgattgagagaaaaaatgattgtcaatcaatataaaaacaatccaaaaactgattgcgagaagcatcttttcatcaggtatgaaaagaaacttctatcgtgatcagtttttgatttttgcaaaatttattttgctaagactggttagcagaaagaagagaataatctcttctcttttttctattatatatagattttctctattttttggtaagggagctgtttcaaaaatggtaaagagcggaaatgttgcgaatatcagttatttaatgatatgatattcggaaaaagaaatctcaaagggaggtaacttttatgggattgaatgaatttattttaggattgaacaatttagagacgatcacaagggcacctggattttttaaatatacagagcatacagttgcagcacattcgtatcgtgtagcatctattgcacaagttctgggagatattgaagaagcaaatgggcagccaatcaattggaaactgctctatgaaaaatcattgaatcatgactacacagaacgttttattggtgatatcaaaacaccagtgaaatatgcaagcaaagaattaagagggatgctgcaaacagttgaagaaaagatgacggacgaattcatcaaccaagagattccagctgagttccaagaagtgtatcgccgtcggttgttcgaaggaaaagatgaaaccgtagaaggagaactattagccatttcagataaggttgaccttctttatgagtcttttgatgaaatcatcaaaaataatccagaaaaagtttacaaggagatgttcattgaggcagtgactactatcaaaagctttgaacatcggccttctgttcagtatttctttaaagagatatttccggaactattgaaccaggaattttatggaaaagaggcgtttttagaaactgtctcaacgattgtaaagaaagaagaaaaataaaaacgatatgggatgcagggggaagtatagttgaaaaagaatatggatgtcgaatggggctattctggagacagagggccggaaaattgggcgaatttatgtgattggtttgcgagaggtgcggaatttccgttgcagtcacctattcatttaacaaaaggtgaagaaataaaaacgaaaggagatacactttcgtttcattatcaaaagcaacggtttactgacaaggaattcaaaaacacgattcatttagtaccttttgaccaactcagttatgtagagttcaagaaagaacgctattatttgacagatattcatttccacttaccttctgaacatatcatcaacggaaaacaggaagatattgaatttcattttgttcatatgaacagcaaaaaagagaatctagtcgtgggtgtcatgtaccagctaatggaacaggaaggttggctgtataatcaagaaaatggggaaagttggaacttagaaaaacatgagcattgggtaaatccggatgtgttctttccggagcaaaaaagccatttccattatattggctcattgacaactccgcctaccagcgggccaatccaatggtttgtaatggatcatgtaggaaaactgaaccaagagtttcttctccccttcgatggtcagtatgctcgaccgaacaaccgaccaatccagcccttgaatggaagagaaatttattatttcgaggagtttgagcaatgaatattcagcagatgaaatacgtggtcgctgtagcaaacaatggtagtttcagagaagcggcaaagaaaatgtttgtctcccagccaagtctttcagctggtatcaaagaattagaaaccgagttagggatcacgctgtttactcgaacgaatcgaggggcatatttaacagaagaagggcaagacttcttaaatcgtgccgagaaaatattggtccagcttgatacattagaaactcactatctaacgagtgaaaagagagacaatttttcgattgctgcccagcattatgatttcttaggtcctttgaccgcacagctactcgaggaattcaaagacgagatcaaacaattccggatcatggagacgacaacggcgagagtgatcgaagaagtcaaagagcagcacagtgagatcggtattatttatatgaatgagcagaatcaagctggtatcagaagatatttacaacaaggagagctaagtggccgcagcattggaaaattcaaaacgcatatttttttaaggcaaggacatccattagctgaacacgcagagatcaccaaagaagaattgttatcttatcctcaagttcgttttacacaggatggaaataatttcccgtatttttatgaagaccttatcgagatccctgatcaagaaacagtgatttatacgagtgatcgagggactttgatgaatatcgttcttgaaactgatgcttacgcttcaggttctggtattgtgattggagggattcgcgagcatttgcggttaatccctttggcagaaggcgaactaaatgaattttatatcatttattcggcgaaacgtccgctcagtgaaatcgctcaaagatttatcaaagagcttactcggttactggaccagcagaattaagaaaagtaggcggaacatctgattgatattaagtagaaagaacagccaaacaaaacagtttattcgaaataaggggttgtgacacgaattttgtcacaacccctctttttatagaaagcaatctataactgattgcttttatgaaaaagtacgaaaatatgattctaagaaaatacgttcattacccgttttgtttcatagctataattttctcttcttctggtgtcacgatgactgttttctgattttcataaatgacgtaaccaggtttggcaccatttggcttgcggatatgcttcacttgtacaagatcaactggtacttgggcagaatatcgatattttgaaaaataggcagctaactcggcagcttcggtaattgtttcatctgaaggctgatcacttttgatgatgacgtgcgaaccgggtatattttttgcatgaagccaatagtcggtttttttagctgtcttcattgtcagctggtcattttgaagattgtttttaccaacaagaatgagcgttccgtcagaagaaaagtattgatcaggctgagatggtttcttacgtttttgtttttttaagttcttctttttcaggtatccttctgaagtcaattcttctttgattgcttcgatatccattgggccggcaatttccagttgagataagacagattcaagatattggatttcatctttggcttcttggatttgttcgccaatcagcttaacagcgttcttcagcttttggtaacgatggaaatatttctgtgcattttgatttggtgtcaatgccggatctagtgctattttgattggccgatcttcttcataataattaggtaaaacaacttcttttgcgccgcgtggtacttgtgtcagaaaagtagtaagtagttcgccatctctacggtaattctcagcgttttcggattctttgagtgtttgttcacgttttttcaatttatttttatttcgttttagttcattttcgatttttcggatcagttctccgccttgttgttttgctcgatctttctccgctttttcatgataatagctatctaataattgactgagtgttggataagttgtcacagcagatgcttgttcggaaaatacttggtaaacaattggcgtaaagaaatctttatttgtcgtttcgtaaaaagtaggaactgggtgattgatgattgatgagaaaaattcgtcccaaacaaccattttttcattaggacgttccagtaatcttttggtcagctcttgagcggtatcgaaaccgattccctgaaactgacgttggattgcttttggctctagttcagtttgggaaagccgctgaaagattttttctttctcggagctaaatgggttcaagacctcttgttttggcggagcaacatattctacaccaggaagcaaagaacgataagtgttttgagagcttccgatgtgtttgatcgcatccagtatttttccagtttctcgattaactaagacgatcgtactatgacgtcccattaattcaacgatcaatatgatattttgtagatcacccaactcgtttcgtttagcaaagtggaaatggatcactcgatcattttcgatttgttcgatgtcttctaaaatagcgccatccaaatattttcgaagcatcatcacgaagttaggcggattatcaggattctgataatcgatttgggtaatctgtacacgagcataacttgggtgcgcagataataataatcgatggtttttgccgcgtgaacgaatcaccagcacgatttcattttcataaggctgatggattttcgagatccggccagatagtaacgtttcacgcaattcgttgaccatcgcgtgggtaaatacaccatcaaaggacatggttcattcctcatttcttttcataagtatgttcattataacgaaaaaaagaagaaaaaccaatttgtccgaatagtgaagcaaaagcctagaaaaatcttggactaattacataaaaaacagtgtttctatcgttgaaatccaaatttttaggtataataaaaaataggagaaaaagtagaaaagaaggtgtttgttatttgggaagtagttaaatcgagagtacaagaaatgaatgaacatttctcagtgtcattcgcagaaaatccaagtaagtattttcgacgtcttgtttttctgctcatcttatcattgctgttaacagttgcaatgtttttattgccggaaaaaatccgagaagagcaagtaaatagtctcgtttattcgtccataccaaccagcaaattgaaaccttttgattacagcaaagctgatcagaaaatcaaacaaagccgggcgatatcggtgatgttcagcaaaccgaacgggaaaacctatcaggacatgcttgatgtttttaatgatcctgagcttatggaagaattgaatcgaccgatcttttattatccgatcgtttatgatgtacatgaactggaacaaaaatataacatacgaacggatgaagtgacatttattttctttgatggaggaaaagaagcaaatcggataactgcgggtaagggaggaataactgattttgataaggagttgatccctgaactgaatcgacttccgttagccaatatcaaacaattagaagaagaattggatagaacgggagtaacttcccaaaattccgagattgctaattgagacattggcgcgatgaaacggtgggtctatatagcgctatttttaattatcagaacaagtgatgtttgatcttcaaaataacaaataaaaaattaaaaaatatagttgacgaaattcaaaaattcgattagacttaaatcaattcttaaggaaagggtgacctgtaatgaacttatcaaaacgtatttcagcagaaaacaaaaaaaattggcgcagctggcgtagataagttgtattaatggtgagactttcccatagatacaactttttagagtgcatttctaaagcttgtatctatgctagacatgaacattgactgccgcatagattagaatctatgcggttttttgtgtaaagacaatgaccgctttggccattgtctttttttgtagactggatacttgcctaattataataaataaaaagattgactttgcaggaggaaaaaaatgaaaaacaaacgattaataacagttatagtaattattttagtttatttagcaggtgcatttatttatggaaaagcctcaggcgaaaaagaaagtacttcgacgaaccagacaaaaaaaacaacagttgttggggtattgcaatacgtgagccatccggcattagatgagatttatcgaggaatcaaagatggtctgaaagaagaaggattaaaagaaggagaaaatcttgagatcaaatttcaaaatggacaagccgatcagagcaagctagccacaatgagtcaacagctagtacaatctgatccagatgtcttgattggaatcgcaacacctgccgctcaatcattagcaaacacgacttcatcgatcccagttgtgttaggtgctgtaacggatcctgtgggggctggattagtcgcttctttagagaaacctggtggtaatgtaacaggtgtttctgatcagccgcctgttgcttcacaaatcaagcttgcttctgatttgttgccaaatgcaaaaaaagtcggaatcttgtatgcttcttcagaggataattcaaaataccaagtagcacaagcagaagaagctgcaaaaaaagaagggttagaatcagtaaaatatgcggtgccttccactaatgagattgcacaaacggttcaagtgatgagccgacaagtcgattttatctatgttccattagataataccattgccaatgcgatgcaaacagtggtaaaagaagcaaacaaagcaaatatccctgtcattccatctgtggatacaatggtggaacaaggtggactagcaacaatcgggatcaatcaatatcaattagggcttcaaagcggtaagatggcggcagaacttgcgagtggaaaagaaaaaccggaaacgacgcctgtttatacatttgatcaaggggatacagtgatcaatcaatctcaagctgatcgcttaggaatcattgttccccaatcgatgaaggaaaaagccaaaatcattacagatgactcgcagcaagaaacatctaaggaggatgacaaatgatcgtatcagctatttcacaaggcatgctttgggcaatattaggattagggattttcatgacttatcggatcttagactttcctgatatgacgacagaagggtccttcccattaggtgctgctgtctgtgtgacagctattactcatggggtagcgccgattgtagctacattattaggcgtaggtgctggcatgatagcaggactcgttacggggttactttatacaaaaggaaagataccggttattttagcagggattttagtgatgtcaggattgaactcagttattttgtttgtgatgcgaacaccaaatctttctttattgaatcatccgattctacaagacagcttccatcgccttgggttacctgattactttgacacagtccttcttggcttcatctctttgggcatcttgattgctgtactgctattcttcttcaatacagatttgggtcaaggctatattgcgacaggagacaacgaaacgatggctcggtcgttagggataaaaaccgatcgtatgaaaattttaggtttaactttgtcgaacggtgtcattgcattatccggtgcgctgattgcccagaacgacggatatgcagatgtaaataaagggattggcgtaatcgtcatcggtcttgcttccatcatcatcggtgaagtgatcttccaagaattgacgctagcagaaagattgattgctattgttgtcggcagtatcatttatcagctattgattttagtagtaatcaaactagggtttgacacgacttatctgaagttgttctccgctatcatcttagctatttgtctgatgatcccgcaattgaagaaagcactgaacttaaaaacgggttttgagaaggaggcatagtaatgactgatatattgacaatcaaaaatggcagaaaagtcgtaaacaatggaatgaatgaagagaaagtactattggatgaaattaaccttacaatcagagaaggggacttcatcactgtccttggcgggaatggtgctggaaaaagcacactgttcaatacgatcgctggtacgcttcaactcagtcaaggatcgatctcttttaaagatcagctgatcacaaaagattcagaagaaaaaagagcacgattcctttctcgagttttccaagaccccaagatgggaacggctcctcggatgacagtagcagaaaatttgctacttgcacaaaaaagaggtcaaaaacggaaattccgtttacgtaacttgaaaaatcaaaaagaagattttttcagactatgtcaagaagtcggtaatggcctagagcaacacttggatactccagcgggtgaattatctggtggtcaacgccaagcattaagcttgctgatggcgacgatcacagctcctgagttactattattagatgaacatactgcagctttagatcctaaaacagctaaagcattaatgcgattaacaaatcagcggatcaatgaacaaaaattgacttgtctcatgatcacgcatcgaatggaagacgccttgaaatacggaaatcgtctgatcgtactccaaaaagggaaaatcgttcaagatatttctgaaaaagaaaagcaacatttgacaatgggcgaccttttgcagttctttgaagaagtagtggattgatttcgacagaaaaattcctttcagtagaaggacttgaaaactcattgacatcttcctttgattcatcctatacttaaaacaataaacaattaaacatatttgggtgttttgtaggatcacgtagtcaatgattttaacaattaaatagaatattctttgctctgacaagtaaacgatgagaaaagaatttgctactttgccacctagacgtttcgtactttttcgtatcaaacgctaagtggctttttttattgaagtaagaacaaaggaggaataagatgatttctggacaaaccaaattagctgggctctttgctgatccggcttctcacagtttatccccattgatgcacaatactgcttttgaagcaaacaacatcgatgcggtgtatttagctttccaagtaaatccaatgaatttgaagcaagcagtcgaaagtattcgaacttttgatatgttaggtgtaaatctttcgatgccgaataaaacagcggttattccttatctggatgaggtaagccaggaagcgcaattgatcggagcagtgaatacgatcgtgcacgaaaagggtcgtttgattggctataataccgatggtgcgggcttcatgcaatccgtgcaagaagctgggatttcgatcaaaaagaaaaaaatgactctactgggagctggaggtgcagcaaaggcagtcactgttcaagcagcgttagacggcgctgaggaaatcgtagtttataaacgaaacaaccaaacattcgctcaagtaaaagaaacattcgaacaactcagctatcgaacttcttgtaagataaaagttcgtgactttgccgatacgcatcaattaagaaaagacttgaaagaaagctgtcttctagtcaatgcaacagatatcgggatgggaaagaaaatcaatcagtcaccgctcttagatataagcatgatgcatgaggatctagcggtttttgatttgatttatgcacctagagaaacacgtttattaaaagaagcaaaaaaagtaggagcaaaaggatacaatggacttggcatgttgatctaccaaggagcaatcgcgtttgaattatggacaaaggaaaagatgccgatccatgtgattgaaaagctgtttgattaaaaaaggataatagataaagattttttattctcgcataaacggtctcaagaaaagtaatcctttatgtatcgaagcatttatttcgttattttttattaaattatcaaaaaatgataggcttttgtcgattggttatcgtatcctttatttatcagtaagaaacgaggaggaaccacaatgagtcggatggatcgctataaggacatccataagaaggcgaaacctctgaagcgggatacggggagtatttttgctagaagagaacgaaaacgaacgcgtatggaaaatgaggaagatgctacccgtatttatgaaagagagcagcattcatttgaacatttgaaccaatacgagcaacagatatacagagatgcaccaagagcagaagaacaacaaaaaaataaaaaatttttcaatcggcaaaagaagaacaaaccgttaaaacctcgaagaaagcgatcgtggaaaaaaatcattctatcgattttgcttgttttgatcctttattcaggtatctcattttttattggtaaatatgtagctgaacatgacacaagcttagaggcagcgacttcagaaacctttcatgggcaaaaagcgacgaatggtgcgcataatattttgatccttggaagtgatacacgcggagaagatgccgggcgagccgatacgatcatggtcttacagttggatggtccttcccataagccgaaactgatttcttttatgcgtgacagcttcgttacgatcccaggggtaggacaaaataagatcaattcagcttatgcatacggaggagccgatctagtgcgtcaaactttagtagaaaattttggaatcgattgtcaatactatgcgaaagtcgatttcaaatcgtttgaaaaagtgatcgatgccttattcatgaacggagtgaagatcgatgcagaaaaagatctgaatctggatggtgtagatattaaaaaaggggtccagaagatggatggacatgttcttttgcagtacgcacgtttccgaatggatgaacaaggagactttggccgtgtcagacgccaacagcaagtaatgaacgctattttcagccaattgaagaatccattgaatctgatccgtgcaccttatgcagctggtaaagctttagggtatacatccacagatgtcactgcttggttcttgacgaaaaacctcttttcgattgcacgaggagctggtggcattgatcgaataagtgtgccagtagacggttcgtggaattatgggcaaagtgattatgctggcagtattcttgaaattgataatcaaatgaatcaatctgctattacagattttttgaataaatgatcataaaaaagatcaagaagaagctgcgcaaggcttttgtcatgaatcaatcaaacgattcactcgtaaaaaacgctttcttatggtagatttaaccaagagaggagctgtttacattggatatctatctgaacttcaaaaatgagtcgcgtgaagccatcgctttttatgaaaaagtttttgagactgaagcatcaggtatcaccacatacggtgaaatgcctggaatagaacaaatgaacttgccagaagaagcaaaaaatctaatcacgaatgcacggctgaacatttatgatacattagttatgtttgcagatacgccagaaggaattggtcctgaattagttgtgggaaataatgtttctttagtcatccagacaagaaatgaagaagaaacgaagcgcctatttgaaagcttagctgagggtggtaagattgagatgccactggatgctgttccgtgggctcaattgtatgggatggtaactgatcgatttggcatcaactggcagatcaaccaagagtgacagctaaagatgaatattttttggaaacatcatgcagcaaacggaacatcgtttgtttgcttgatgttttttgttcctatttcgactatacggtatcttttttttattgccagatgcgaaaatatgttccataatagagaagtccgcaaaaatcaagtaacggaggtcagaagatgaagacggtgatactagctgaaaaaccttcacaagcaaaagcctatgccgaaaccttccaacagcgaaagcgacatgaagggtattatgaaatcagcgatccattgtttgctggtgaagtaaccatcacttatggttttggacatttggtagatatggttgctccaggagcttatgaagagcgttgggcaaaatggtcgttagaaaatttgcctattttcccagaaaccttccgttacgaagttccaagggacaaacgtacacaattttcgatcgtaaaacgagagttacagtcagctgataccatcattattgcaacagatggtgatcgagaaggtgaagccatcgcgtggtcgattattcgacaagcaaacgcattttctaaggaaaagaactatttacgtttgtggatcaattctcttgaaaaagaagcaatctatgatggttttaagaatcttcaacctgggaagaactattttccaaaatataaagaagcgcaagcaaggcagaacgctgattggctgattggaatgaatggaagtccattatatagcttgctacttcaacgaaaagggattgatggtagtttttctcttggtcgtgtacaaacaccgacactctatatgatttatcagctgcaagaagaaatcaaacacttcaaaaaagaaacgtactttgaaggagaaggtttaattacgacaaacaaagggcagttttctggaaaaatcgtaccaaaaaaagcatttaaaacccaagaagagttaacgaaggaaatagaaaaacttggagcgcatttaggtaagcaaaacggacggattcttgaagttacgaaaaaggaaaagaggttgcatagtccacgtttattttcactatctagtttgcagacaaagatgaatcagctaatgaaagcaagtgccaaagctacacttgatgctgctcaaggattgtacgaaagcaagtttctaagctatccaagaacggattctttttacattacagaaaatgagcatcagtatctggttaaacatctgcaaaattataaaaaatttttaggaatagaagaagtacagacaactgagatcaaagcaaagaaacgatatgtcgatgcgaaaaaagttcaagaacatcatgcaattattccgacaaagacgattccgactcctgcacgctttgcgaagctttccaaattacagcaagcaatctatttgcaagttttgcgcactactgtggctatgtttactgcagattatatctacgaagagacgattgtaatgacgggcgtacagcaattaaagctaaaaagcatcggaaagatcccattacagcaaggttggcaggaaatcttacgcatcaagtcaaaaaagaaagaagctcagactcttcctcctatcgtagaaaatgaagaagcagaagtagaactgaaaagtatggagaaagaaacacaacctccaaaaccctataccgaaggaacgttgatcacagcaatgaaaactgcaggaaaaacgctggataatgatgaagcgcaagaaattctcaaagaagtagaaggaatagggacagaagctacacgagccaatatcattgaaaatcttaagcagaagcattacatcgaagtcaataaaaacgaaataactgttacgccaaaaggaatcactctttgtaaggcagtagccaatgaaccattactgacgagcgcagaaatgactgcgcgctgggaagggtacttaagaaaaattggtaaacaagaggggacaccatctgtttttttagagaatatcaaaaaattcatcctacatttattagcagaagttcctaatcaaatcgacaaggtagacttttcagatgagattagcgggacacgacagataaaagcgatggagaagaaaaacgatcaattaggaagatgtccaaaatgtaaaaaggggatagtcatgctttatcctaaaatcgctacatgcttgaatccggaatgcgacttcaaattgtggccaacagtagctaaaaagaagctgactaaaacgaatctcagagatttgctttcaaaaggaaagacaagtaaagttgtcaaaggttttactggtaaaaaagggaaattcgatgcagttttagtattaaaagaagatatgacaatcggtttttcttttccttggatcgaaaacagtggaacaaaagcagttgatggaaacaaagaaacatcaagaaaaaataatgaaaacgaagtagagtaaatgaaaacaatgaaatagcggaatatttattccgaaaagtgagaatataaataccaataaaactaaaaaatatcagtaaatcaagcaaaaatgttggagtaggctgattttatatagatagcaaggagtttttttatttgaaaaaagtgcattcatttttaaattatcttatgggagcaatcacaattgtggctgtgtaccaagcatttctaaagtatcctgattacgggacgaagttgttgtcattgacgcacaatcaaacagcatattcaccaacgttgattttatcgactttgactgcaggagctaaaagcgctacttatttttttcataaaacgacaagcatgctaaagcgaaagaaacagcgaaaacaattgttgatggtggtagcggctatgatcattatttattttctaccagttattacacaagtatttcatcaatattttggttaagaatacgagagtttgtgacaaaagtcatgtcacaaactttttttctttgtcattttttcgtaagaaaaagcaaaataaaagtatatacattgattaaaagtatatacttggatataatgtacttactatagaatgagaatggtatagagggtggcgaaatatgaaaaaaatgaaaaagtataaaattagaaaatctggcaatagcgatgtaacaactatcccaccagaagtaaaagaattcatgggtgtgcagacaggtgacgcaatcagttatgtttttcaatctgatggttctgtacgaatgatcaaagcacaagaagaacctgatattgattcattagttgattcgatcatgaatcaatatgaagacgcgttaaaagatttggttgatttatgaggtatctttcgactaaagaaattatcaaaatcaacgcgaaagttattttacgtcactcgccaggcgaaatgatcggtgtaaaagatgcaaatgcattagatatggccgtcaaacagccttcacaagcagtattcaatcaagaactctatcccgaagtctatgaaaaagcggcaattttagcaattaatttagctaaaaaacatccttttcataatggcaataaacgaactgctcttgttgccatgttgttgtttcttcaattgaataattgtccagttgctttttctcgtcaagaagctgttgattttatcataatgattaccactagttcattggatttcgattcactaaagtccaagataaccaattatttacgacaaaccgcaataaaatgaacgaattaaaaactttatttctcaattagatcagcatgtcattaaggaatatgctgatttttttgtatggttaatcatacaaaattgttttttcataaaaatatggattaattttgaaataattgatttaaaaagaatacaaaagagtggatagtaggaaatagtggtttagaactagtggactggttttttatatattttagtttacataatatatattatacaaagtagattcaaaaaatgataaacctctctcgaacggttttttatcaaaaatcgtcatttttccatcaaaatctgcttatgcaaaattataaaaaaattttgcagtttttcttactttttttgtcgtttaattgaatgataaaaaccagtttctttattcagttaatcaaatatgaacgaattagatatgaatcatttaaacattgataacgattcgcttattgtaatcaacagattaaatttcatatgttcatatgtacggatacattttcagaccgattaattttaaccattctgtttatttgcttacctattagatatcaataaaaaactgcttaacagctatttcagctgttaagcagttttaggatttttagttcatattcattgtttcttataatacagtgttcaatacttctcttaaagcacttgttgatttgctaaacattgctttttcttcttcgttgattgataattcaacaacttcacgaacaccattttcgtcaacgattgatggcacacctgtaaagatatctttttcgtcgtattcaccagttaaataagcagatacaggcaatacagcttgttcgttattcaagatagcttttacgatacgtgcagtactcataccaataccatagtaagttgcttttttacgatcaatgatctcataagcagcattacggactttatcagcaatcacatctaattcatcttgggcaatacgatggtctttttctacaatttcaaacactggtttaccaccgacagttgtatgtgaccatgcagcaacttctgaatcaccatgttcacctaagatatagccgtggacgctgcgtgggtcaacttttaatttcaatgcgatttctttacggaaacgagttgtatccaatgttgttccagtaccgataacacgtgatgttggcagaccagattcgttccaagcgatatatgtcaaaatatctactgggtttgaagcaacaacgataataccgtcgaatcctgatcccatgatttcttttacgatttggcgcatgattgacgcatttgttttaactaaatctaaacgagattgaccaggtttttggttgataccagctgtgataacaacgatatcagcatctttacattcttcatagccacctgaccatacagccacattttcatcgccccaagccataccatctaaaaggtccaatgcttccccttctgctttttcttgattcacatcgatcaatactaattcattagagattccttggttgatcattgcataagcgatacttgttccaacaaaacctgtaccgacgattactactttacgacttgtttttttcatgaataaacagctccttttcataactatttgttactttcatgaaaagtatagtcttgtttattcattttatcaacatgttaattataatagttgttattataatttttgatggaaacgaattcctgaatacgcataacagataaatgacaaatgtttacacctatatcccctgataatacaaccaaaagtttagaactgaaaataaatccaaaaaaaattcgctgcaacgatataataagacagcaaccgcacctaaaacaattttccttcatatgctttagtgaaagattttcttcttaatgtttatttctccattcattgggagtacatgttgaatactttttgaataatttgaataaagaagtcgtttgtttatatccgatacgattagcgatttcttccaacgaaaaactcgtttcttgaatcaattccaacgcaaagtcgaattttttctttagaaccagttcttgaaaggaagcatcaaaatacattttcaatttattactaagatagaccggattgtagccaaaatgagctgctgtttcttttaacgtacaagaagtaaaatgcttatcgatataatctaatactctaagcatctcattttctgcgcatccatctgctgatgaaaagctttgttgttctaataaatgagtcaattcgatcagtaatagtgatgtatagagatttaacgaacggatcttatgactgtatgtatcaaaataaatcaacagcatattttcaatcaaatgcgtcaaacgacttgtttttccgccgcgaaaatgaatgaattgtgtatgttcccctttttcttttgatgcattgatcaaaaaagaagaaagtagattatttgtgcttgccaaatgattcaatatctctgtagataaggtttcttcttttaataagatgttgattaaaatatcctcttgccctgtgtattcgattctttgagtagcttctttatcaatgatcaccacgtcactttcttccatctctatcctttctccattgataatttgtaaacatgtaccgctatacatataattgatttcaacaaaatcatgtgtatgctcgggaacttccgcatatcgacggtgtttactgatatgaatatttccctgttgaaatagatctcctcggtggatttttggcggtgtctgaagatggtaagctaagtttaaatcattgatattcattccttgttcacgctgcagagtttcgattgattcttcgttacgcaaaaaagtgtctaattcagctagttccaattgactccctcctttttgtaagtggtttctttcgcttattagtttacgctgtactgctattatatgcaaagctatttttggtttcataaagactttctatggttgggacatgaacttcctgtgattccgctattgagagaataaccacttcatactatatttttgataagcgattacaaaaatgaaaggaacatgcttatgaataaaaagatgatgaaattttctctgctgtcagtctctcttattctgacttctgctggtgcagtcacgtctgcaattcccagtatgtcagctacttatgtcacgcgttctttatctgctgttgaattattaacgactgctccctcctttatggtcactatttttgttttgattagtagttttattgctaggaaaatcggacaaaaacaaactgtgatcatcggattagtgattgcatcgatttgtggtatcctccccctcttctcacaaagttacagtattgtcttagcttcaagagctggactaggtattggctttggattgatcaattctttggcagtcagcatgattgctgccttttatcacggagatgaacgcgcctctatgattggttttcaaagtgcattttaaggatttggtgcagctttaatgacatttgttgcaggacagctagtacagttcggttggcaatatacctttttaatctacgccatcagcttacctattcttgtcttgtttgttttgtttgttcctacacctgaaacaactgaacttcaatcacatggcacagccccaacaagacaagtaatcaaaacgaatcctaaaatgattagttatggtatttttctcttgctggtcatcgtggtatataatgctgtatcgattaaattagccacagtcctgacgacttattctctaggaaacgaaactaatgcagcgaatatcttaacaatcatgcaattggcaagtatggctgccggagtttgttttggctggcttcagacaaaagcacatcgctatatgcttacactttctttactactgatgggaatcggctttgtattgattaccactgtgataaacctgtatgtgattgggtttggtgcgatcctaacaggaatttctttttcgttattcattccttacttattcaaccaagtaagtatccaagcgcccaagcacgcggagagtttcaatacttcaatcttattggttggcgctaatttaggtactttcattgcaccatatggtttgctctttctctcttttgcttctcttgggagtaaaacacttgctgttttcgtcaatggcagtatcttgctgttgattagcgcgcttattagccttctagtagtacacaggacgaatagaaagacagtgataagagtagatgaagaaataaaagaacaattgacaacaaaataaatttgatggaagtcgtgtaaaatgacaaatgaaaaacataaagatagatggctttggtatcctggagactttgagatccgccatggactgctacaaaatttccaacgggaagaacgaggttttgactggccagcgtactggtacatggatgattgccatcggaacgtcaagtttaagagatattactttcttgatcaaccttccatgtttaaagtgacgatccaaggagttgggtatgtagaaattaatggacaaaaacatccatgtggaaaatggctgacttgtccagctggtaaagcaaaaattcgtatctttgtaggacatacatcagggctaccagcgatgtttatcgagggagacgaagtaaaatcagatattggctggacagcaagtaattttattgaagaatatccagctggctggagtccgctttatgtcgatatcgcaaaagatccaaatcaaatctattatcaaaaagaatgcgtccatccagtcactgaaacggagattggcggaggaatcttattcgattttgggcgagcagtgaatggctgtgtagaactaatatctctggatgaccacatcgaatctatcactctatgttatggagagtccgatgtagaagctatggatatcgattattgctactataagcaaataggaatgacaagaaaaatgaaagctcgtaaacgcgcttttcgctatttgtttataccagaggtttctactggaatggttcaacttcaagtttttcatgaatttttatctctttcgaaacaagctgctttttcaagcgattcttctttactgaatcagatctggtcagtatcagaagaaaccttcaagttatgtagtgatttgttttttatcgacggtatcaaacgagatcgctggatttggtctggagatgcgtatcaatcattcatgatcaatcaatatcttttttttgacgaggaaatcaataaacgaacgatattagcattaagaggacaaaatgaaatcaagcagcatatgaatactatcgttgactattcgatcttgtggttgattggtatcgaaaaccactatatgatgacgaaagactatgaatttttacgcatcgtctaccctaagatgcaatcattaatgagatacttgatggagcaaacgaatgaattagggtttatttatgggagagcaaaagattggatatttattgattggtctgaaatggataaagaaggaacgcttgctgcagaacaagtcttattactgaaagcctatcattccatgatcacttgcggagatatcttagctgaaacatatggagagaacgaaaattatcatactcatctctatcaagaaaaatatcaactattgaaacaaaacctatttgactacttttgggatgaagaacttggcgcttttatcgattgctatgaatctgggagaagaaatgtgacgcgtcatgcgaatattttcgctgttttattcgattttgctaacaaagaccaacagcaatcgatcttaaagaatgtcttattgaatgacactatcacacagattactactccatatttcaaattctatgaacaagatgctttatgcaaactcggacagacgaatatcgtctaccaaacgattcttgattattggggagggatgttatctcatgatgcggtaactttctgggaagaatacgaccctactcaaacaggaaatgaaaagtacagtatgtatggagatccttatggaaaaagcttatgccatgcatggggagcaagcccaatctatcttttaggacgctattttatcggtttgtatccaacaaagccaggttatgaagaatttatgatacaacctaatctagattcatttgaaacactgaattgtacgctacctatcaaagatggaaagatttcgcttgaaaaaacaaaagataagatcgtgattacttctgatagaacaggcgaaacagtgaaaatgaatggtaaaagttatcctcttctagcaaaacagccacttgtcttaacaagctattcaaaaataaatgcataaaacaaaaaactgcttgcgacatatcagaagactttaaatcttcttctgatattgtccaagcaatttttattttgaagtttgcttaattctgttctttagaaacaatgtttgttctttttccggcaaaaagaaagctagataatacgacaagtaaaaagaaaacgatgattccaactgtcaaggccatttgaccgtattctcctagtttcccaagtacaagtcctggtactagataatcagtatcggcaaatgtagaagaagcgattttaagatctcctaatactggaaggataaataatggcagccaactaatcaataagctattgaaagcagaacctaataccgcccctcttctaccgccagtcgagttgccgaagacaccagaagcagctccgcagaagaaatgtcctactaccccaggaatgataactgtagtttgcaagcctatcatagcaaacatggatagtgttcctacaaagaagctaacaaaaaagccaattaatacagcattaggtgcatatggaaaaacgataggaacatctaatgctggtttagaatcgggtacgagttttttagcaatcccttggaatgctggaacgatttctgccaacaccattcgaaccccttgaaggacgataacaaacccagctgtgaatgttccagcttggatcagtgcaaagattacagcgttgtctccattgcttagctctctttcaacaaatccaggaccagctaacaaagcaagtgcgacatatacgatcgacatcaagagcatgatcgatacagtagaatctcgcaaaaagctgaaacttttaggaatctttatgtcctctgtagaacggtctttgtttccaaaaaactttccgatccatccactagaagcataaccgatatttccggtatgccctaacgcaacttgattgtttccagtgatgttcttcataaacggttgacaaagagcaggcgtaatagttaatagtgttccttcgaagaccccgcctaataagatcatccacaaatttgcagtaaaccccgcgcttactaaaatgactgctgttagacaagaaacataaagcattgcttgacctgtaagaaaaatgaatttatatcttgtgaaccgagcaagtaaaatattcacgatcatccctactagcatgatcaaagcagtaggtgtaccgtattgttgcaaagcaatcgccactactgcttcattgctaggaactactccttgagtatgcagagctgtttggaacatcgaagcaaaaggggttagtgaattactgattagaccagcaccgccgatcagtactaggaatccgacaaatgttttgatagttccttggatcacttctgaaaatttcttcttctgaagaacgagaccaagcagtgcaatcaaagaaacgaggatggagggctgactgacgattgacacaaacaaattcaacaatttatccattgatagttcctcccttgaatcatttttattcttttgacaagatcttctttactttttcttttacttctttgctgtcaatgatcgattgcaaaggtacgagcttttcatcaggtatagaagttagcgtatctttcaaagaatgctcaatgaagaaataatcagccatatcgctagatacacttccaacatccgtatgacttacttcaaactcgtccacatctgctccaagatctgcaagtgcttgtttgatgttcatctctaccataaaacttgttcctaatccactttgacatactgcaaaaattttcatatcattcgtctccttttcttatgatcgctaatatttcttcttttgttgatgcgtgtaataaatcttgaagattttgtttattagaaagtagctttgttaaatttgccaacgcccgaagatgcgcctcattatcgatagcagctaaacagatgaacaaactaatgggatgggctggatcatcaagcagatccacaggttgttgaagtttcagcaaagacatccctacttcgtttacgccatcttctggacgagcatgaggtaatgcgatgtggtcgccaatatggataaacgcaccatactgctccacgcgctcgatcatagctttgatataactttcttctattttattttctgataatagcggctgtgcggcaaatgtgattgcttcttgccagttttttggttgatccgataattggatcatttcttctgttaataattcagatagcataggacgttgatcctccttcttttctaaaagtttgttcattttacgatttaatacttgatagagcttttcttcgtctacgccttcttttaattcgatataaggcagtagcgccgacaacaattcttgggcagaaggcattgaaaatcctggtatcagccaatctctttgtacttgattgatcagctgatttttttccaagtcagtcatgattgggtgcagaacatagagcgactttttcttatcagtaagcgtgagaggtacagtagaaaaaataatatcgtaagaagtttcgtcaacctcatgtaagcgatcagctgaattagtctctgtaaaaaagatcatcggaaataattgctgaagttcactttttaagatcaatgaagagctaatgccacttggacagacgatcacggctcttatttttctatttctttcttctgcgtccgcttttctgatctctccgccaaatagtatagtgaaaaaaccaatctcttcttcagggatgctcttccctattcgtctttctaacggaagtaatgcttttcttgtcatttcgtagatggaagcatattgatgcttaatttgatcgatcatcacattaggtaaataaaaagaataggaaatacgaaaataggcagggaccaagtgataaaagacattcatcaataattcacgaaacgaagcaaattctacggccatcaggaattccatgcgatggatgacttctgaagaacattccagcaaaaaatcaagtgcaggctcctggacatctccttcaacgatcgatgctaagcaaagagagaaaaatataatctccgaattttgatgttcggaatagccaaggccagtcaatacttgtcgactaatgtcagtgactgcaagagaagccaacagttcagcatcttttaccagttccatggatgtttttccaattcgaatggttgtcaaactcaaataataagctaattcatccattcgatttggtgcgaatcgaagatctgatagtgaaatcgttttatctagcaaatctctaactttggcgtaataatcaatggaaagggttgcggttaaatacgtgagcccaaatcttccagcaagtgactgcatcaaatgagcagtgcgattttttgcttctcttcttaatattgcttctgaccctagcagcctaaaaccagttttcctagtatacgacagctgacaatcttccacttctaattcatttcttacctttttgatatctgacaggactgtccctttagaaacctgaagaaaatcttgaaaatgaaaaacagaaacagacgttgtagtcgaataaaccatcaaataaagaagatctcttcgctcttgttcggtatacacagcttcaaatcgagtaatatccaaaaatttttctgcccagtcgattgctcggaatttctttatacggatatgggtatcatccacatattcggcaaaaggagttaattgtttgatcgcctcgcttgtatttacttcgatgatctctgctgctttttctagactgatttctcttggtgttttcaggagataactaattttgtagttcacagcgctgttcacctcctacttatattctagtatggtagcgcttttaaatcgaggggtgtttggtacaacttacagttggattttttttacgactgcaccgaacgacttctatcgaatggatgcagaaaaaaagcaggtgaccaaatgtctcctgcttttatgaattgatttcgtccgatcaatgatgatcatgtttattttttgaggtcagttcttcaaatttttctttgacatcttcaaccgctttttcgatatctttttcaaagtgattgggctcattaggctttgtttcctcttctacagaatttgaaccagataaagctgtttctttattttctgtttcaccagagtttgtgccagctaatgattcttctttgtcttctgtttcaccagaattagttcctgctaaagccacttcttcttctgttttaggggccattgaacctcttaatcgtttgtgtttttcaccgtcataatttgtcatgttggttcctcctagtagttctatactttttcatcgtacaataagacagtttatgcgtcaaaaaacaaacccgattcttacaaatatgtcatatttttccttctgattcttgaatgcttttgattccttcttccaaaattttcatttgtaagattgtttcttcatctttgatgactttttctgcgccattaactaatgtctcgtaaatcccttcgtagacacggctgtaatcaccaacctcggaaattactttttcttcatgataactcccttgttcatctatataggtcaatacaccataatgttcgggcaaatcgataccaaagtcttcatgatcaggcatgtaaaacattttcagatgttcttcttgtcgatcttttgtttgtttcacgaacatccctttttttccgtaaacgacgaaacttggacgttctttgatgcggaaataactggattttatcgaaattttcatatttccatagaaaaaatccagatcgaagtaatcattcattcgtcctttccctaaaagttgacgtacatcatagctgatatcatctggttcgccgaaataagaaagaacttgatctactgtatgacaagcatgtccatataaatagctgttcgcagtagaaaattcatgcgtattttctggtacttccggtctgaaataatcataatgcatttctacttctaaaatatcccctaattttccgctttcgattactttttggactgtcaagaaatcagaatcgaaccgtctgttttggtaacattggataaatagccctttttcttttgctaatgcaaataactcttctgcttcctttgacgtttctgcaaaaggtttctctactagtacattcttaccatgttcgagtgccatttttccatattcataatgaaattgactaggtgtagtgatgacaactaattggatctcaggatcatcccaaagatcagacagctgatcagtatattcgatgtcttcgaatgttttccacactggttcagatggggaaaaaatttttttgatattgattttgttcgtaagttttcttgaaaaaggcaaatgatagcgatttgtactctttccattgccaagataagcgattgtaagcatgagtggtgcctccttttattgatgttttcagtatatcctagaaaagcgcagaaagtatttataatagctattctggtaaaaaagttcagaaaaacacttgttatcattcggtttggtgaaattaatgttcaaagtaaggataaaaatcaaaaagatagtagcggaaccaagtgtttatcagtaagatagaatttggaggtcagatcatgcttattgaagaaaaactaacaaaacaagagttgtttaccacgacagagaaacggattgccgattacatccgtaggaatatcgaagctgcagtctacatgacgattgaagaattagcaaaagctacgtatacttcccattcagctatcattcgtttatgcaaaaaaatgggattcagcggatttaaagaattccgtttcgagctggggcgggaagttcatcaattgattgctcagttcaatcaaacgattgatcctaattttcctttttcaagtgaagatagcactcagcaaattgcaaagaaaatggcggatttatcgatccagtcaataaaaaaagcacaattgcagattgaacatgaagatttagatcaaatcggtaaagtattgaacaaggcacagcgaatctttctttttgcaaaaggtgattctcaaatcacggcaaggaaattccagaataaaatggtcaagttgaataagtttttgatcatggccgaagaatacagtgattcttcttggaatgcagccaatttgactagcgaggattgcgccatttttattagctacagcggtcgcatccatcattatgaacgaataatgacctatttgaagcatgtagaggcccctaccttgctgattaccggaaatcagcattcagaaatggccaaacaggctgatatgtgtcttgttatatcgcaggaggaatatgattttgctaaagtagcgactttttcctctcaaattgccttcgattacgtattaaatacgttattctcagtgatatattctcaaaattttgaagagaatatccgcaacttgaaaaacaaacaagaattgatgcaaaaaggccttcttaaagaatatcggaaaacttaaaaaaagaggggctgtgacaaaaaacgtgtcacagtccctctttctgaacaaacggtgttcaagaagtagcttctacggaaataagccgaaatttcacaaaaatttgagaagcaattttcgtaaattccttcttatttcttgaagctgaccacttctgccacaacctcagatagtgtttgataggctctctttgatatcatcataaaaacaggctgaagtttgaaaaagaaaacttcagcctgtttgtttacggaacgattcgaatagatatattatagaaatgaggaatagctaacttctgtttcttattttgaacgattgacgaaaaagatatataagaaggaggaaaatcagtatacatgcagctaacaatccatacaggaaaaatcgtttgttctcggatactttctgtacttctttttgaacttcttttgcatgataaggaacccggtgccctctgacaagtaagcgatgactgttgaccatataaggtgtacaagttaggagtgtcacgaaatcctgccctttttcgattctcagatcttttgtatcagtcggttctaccgtcttgatctgatcgacttgataagcgagtgtccgtccattgatttcgatatagaaagaatcacctaaagtcagtttcggtaagtctgtgaacaactttgcttgaggcagtcctcgatggctggaaataacggcatgtgtattttctccccccgtaggataagacgttccttccaataatgaggcacctttttctagcagcacagtattcgtttcatcaaaaattggcaaatggacattgatctcataaactatcgaacacagcattgattttttctttatcctgatcttcaagttctcgaacaatatgaagataagtagacattgtagtttctaaactgctatggcctaaacgtttcgatacgctaagtatatttactccttgataaagtaaaatagatgcatgcgtatgtcttagtccatcaataaacagtcgaagagaaaataggcaaaaattgattactaaagaaaaacttactaggtcgacggtgtagttgattttcatacttcaacagattcgaattaaacgatttcgcttggcttataccagtcctatccaacgaaagatatatcgttcttaactctagcggtataacttgaagctttacgtaaaaccaatgggaatgaactggagatgactttttattatttttagtaatagctgatgggttaatacttacaactttccttttcaaagtaccatataaaaaaacggtggggttgtttagcgaaataaaggatctaagccaatagcttagatcctttattctatgctttatattattttttgcatgtgtgcgaaagtatactcaagcccaatcgccatttcggaaaatcggtactgtagagccatcttcacggattccgtcgatatccatcttgtcagatcctaccatgaaatctacgtgggtttgacttctattcaatccagcttctgctaattcttcatcggacatttctgtaccgcctttcacactgaaggcataagcagaacctagtgctaagtgattcgatgcgttttcatcaaataatgtattgaaaaagatgatgccagattgagaaataggtgaagggtcaggtacaagtgcgacttctcctaaacgacgcgcaccttcatctgtatcaagcagttttgctaagacatcttctccttgttcggcagaaaaatcaacaacttttccatctttaaaagtaaatttcatacccgagatgatggtgccagcataactcagtggctttgtacttgaaatgtaaccatctactcgatgactgtcaggtgctgtgaacacttcttccgtcggcatatttgccatgaatttttctccacgagcattatagcttccagcgccttcccaaagatggtttttaggcaatccgataatgatatctgtaccgggagcagtatagtgcagggcagaaaattgttctcgattcaattcttctgctttttttgctaatttttcatcatgcttcttccatgctaagacagggtcttcttcatagacacgagtcgttttgaaaatctgatcccataatgcctcaacttgtttttcttctggcagttctgggaagacttttgctgcccattgtttaccagccgcagccacgacagtccaactgactttatttgcttgagttgccttgcgtaaattcattagtgctttgccagccgctgattgataagacgctactcgatggctatctacaccagcaaatgcatcgggatcggcagaaacaacactgatcctgcttgctcctttttcaagccattcatccgcttgatcgattttagattgtggtacattctcaatacgatccgttgcagcatgtaaaagaaattctctttggatctggtcgtcagtccattgaacgataacctcagcggctcctagtttataagcttcttgtgtgatcaatcgagcaaggggtgcctgttccacgctgatctgtaaaacaactgtgtgtcctttttctgtggctacgccagtttctgcaattaagcgtgcatatttttttagaagttcattaaaatcagataacataataaaaattcctcctcaccattttttctggtaactattagcatgataccatttaattatgattcaaacaatgaggctttaaataaaaaaaggaggttatttttttaaggttaagtttcatgatatatgttactacttgctatttcagcttgtgaagaaaatcaaaaactaattttgcatatcaaaaaaaacatgttacaatgaaattaatcaatggtggaagcgttataaaaaaattaaggagattaaaaaaatatggcaagaaaaaagacgattactagagaacagattttggcagctgcttatgaagtagctgccaccgatggatttacacgatttactgcgagaaacatcgcgaacaaaatgaattgttccacgcaaccgatttatcttgagtttaaaaatatggatgacttgagacaagctctttttgagcagatctatgatcatttacaatatgaagtgttcactgttgagcatacagggaatacgattatcgatcttgcttttaattatatccattttgcaagaagagagaagaagttgtatcgttcactgtacttagaagaatatggtggaggaaaagagatgcagaatttctcttatacttactttgtgaatacagtgaaacgcgatccagcttatgtgaatctttcagaagagcagatcgaatctttgtataatgggacatggatcatagctactgggatcgcagctttgatgtcttcaagcatcatccatccaactgatgaacagattgaaaagatgatccaagacagtatagatgctatcttgaaattcaaagaaccaatcgaaatcgattgaatatactcaaaagttccacaaatcagtagataacaagagatgtgtcaaaataaggaaaagttcgtttttcttacagcgtatgcatttttaactcccgaagaactcttccatgaatgcaatgaataaaagagccgtacagattgaataaatctggatggctcttttattgcaagtatattaaatttttgcgactagttctttagcgaaagcttctaaattttcgatatcttcttcttcagcattcagatccactttaacattttcggctccttttgatgcgcctgtttttgcaaaagcagcatcgaaatcatccaccgatttgcagaattcatcgtaaaaagtatcaccagatccgcatacaccgtaaatttttcccgatagatccaattcttgcaagtcttcataaaagtctacgatctcatcaggcagatcgccatcatcgtatgtataagtagctactacgcaaatatctgcctcctcgaattcatctgcatctacttgggtacattcgttgatttcgacttcgatatccagattttcaaatgcttctgcaacaatatcggcgatttcttcagtgtttcctgtcatgctagcatatacgatttttgctaaagccatgatgtgcctcctcgtttataattatttaacaattatgaattataccaaaacatcattgaaaagaaaataaaacctagagacacctggggaatgtcatttggctaaatgtatgccgctatgttaaaatgagagggatttgtaaaaaggagacgaaaatatgattactttaaaatcagcacgtgaaattgaaatgatggcagaatctggagctttattagcagatgtacataaaaatctgcgtgattttataaaaccaggaatcacaagttgggatattgaggtatttgtcagaaactatatcgagagtcatggcggaattgctgcgcaaattggctttgaagggtatgaatatgcgacttgtatcagtataaatgatgaaatttgtcatggattccctcgtaaaaagcctttgaaaaacggtgatttggtaaaagtcgatatgtgtatcgatttgaaaggcggcatttctgattcttgttgggcctatgtagttggagaatctacacctgagatcgaccgattgatggaagtaacgaagaaagctttgtacatcggtattgagcaagcacaagtagggaatcggattggtgacatcggtcatgctatccaaacttatgtagaaggcgaaaatctagcgatcgttcgtgattttattggtcatggcgttggtcctacgattcatgaagaaccagcagttcctcattacggagaagctggaaaagggttgcggttgaaagaaggcatggttatcacgatcgaacctatggttaataccggaacttggaaaatgaaaatggatcctaacggctggactgcgtatacaagagacggcggactttcttgccaatatgaacatacattggctattactaaagatggtccaagaattttgacatcacaaggagaagaaggcacttattgatctagccagtcaataggtacgggagaggtacatgaaagtttggaacaaaataaaacaaaatgaaaatctgatgcgctttattgagacgactcaaaagcgcatcactgattcagaaatgagtacgacctctgtcgtcgttgcttattatttactcttgtctttatttccattgattattgcttttggtaatattttaccgtttctccacatcgatcaagagactgtactgacctatttacgagaagtgattcctgagaccgtttaccagtttatcggtcctgcaatcaaagaccttttgacacaaagttcaggaggcttgttatccgtttctgcattagcggctttatggtctgcaagtcaaagtatcaatgctttgcaaattgcgatgaataaagcgtatggcgtagaaaatagaaaaaattttttgatcgtccgtttcttctcactaattgtcattgtcttgttcatgattgctattagtggggtaactatcgttcttgggttgggacagctgattttggatgctattcagccaatcgtacaaatacccgtgaactttatcgatcagttccaaactttgaagtggccaatcacattggtagctttatttgtcatcatgttcttgatttatttaattgtccctaatgctcagttgaagttgaagacgatcattccgggcacgatcttcgctactgtcggctggatgctgttatcacaagtgtttagtatctatgctaggtattttgcaacgaggatcagcggttatcagatcataggaagttttattgtactcatgctttggcttaattttgctgctacgatcatcattttgggcggaatcatcaatgcagttgttcaagaatacgtgacgggtcatcaaatcaaaaaacgtcgagatccaagccgaaaatggttcaataaattgaaaactaaattttctcataaaaaaaagtagaaacaagagttcttattgtaaatttatatcagtaatttataataattatgactcttaattaaagtaggtgcccatatgcttgtttcttttagtatggttataagattttttctgacaattttattatcactgatattaacacctgtattcaaaatcatttcagtacaaacaggtatggtcgacaaaccaaatgaaagaagaataaataaagttccaatgccttcagcgggcggactgcctatctttatttcatttgttatatcgactttattcttattccgtaaaattatccctcaatcgtatattgtaccgatcctgattgcttctttagtaatcatagtcacaggagtgctcgatgataaatatgagctgacacctaaacaaaaaagtatagggatcttgattgcttctcttattatttattttgtagcagatatacgtattgattccttcacgcttccttttattggatatatccaactaggctggcttagttttcccgtaacgattttttggatcttcggtatcacgaatgcggtcaatctgattgacggtttggatgggctggcggcagggatttcattgatcggtttaattacgataggaatcattggatattttttcctccatgcttctacagtgtatattccagttgttattttctgtcttgtagcaagtattatcggtttttttccttacaatttttatccggcaaagatttatttaggcgatacaggagctctattcctagggtttatgatggccgtcctttcactacaagggctgaagaacgtgacttttgtttcatcgatttctttgctgatcgtcatgggagtgccggtaacagacacgttttttgctatcattaggagaaaagcaaaccgtgtttctttttctacagcagataaaaaacatcttcatcaccgactaatcagtttaggctttactcataaaggtgctgtcctgacgatttatgcgatggctttgatgttttctttcacagctatggtcatgaattatactggaagaatcggaacgatcatattgattattgccatgttgtttgctgcaattttattatttgaattgattggtctgatcaatgagaaacatcagtttattttaaaaacattgcgatttttagggaataaagagtaccgtacgcaagtaaaacagaaatatttgaagaaatggaaccgtcatatagatgaataacaaattaaaccagccgatccttattagtattgtgacggcaaacagtgataaaatttttcggacactagataattttatttcaactgtaaaagatgaaacagcagtaaaaatccgaatttttgacaacaattcacttcccgagtacaaaaaaagactaacagagtataggaaatatccctacatcgatatctattttcatgatgaaaattccggatttggttatggacataatcacaatctgatagctagcgattctcgttatggcattatttgtaacccagatattttagtggatgaagagacagttacagcattggtcttgttattgaaagaacatccggaatgtgcgatgttagcacctaagattcttaatgaagatggaacaactcagcacctcatacgtgagcagctggctgtttttgattacgttttgcgctttgtgcctttcaaatgggtcaaaaaaaagtttgacaaacgactggctgtgtttgaatgccgaggattgcctactgatgctaatagttatgtacggatgatctcaggtagttttatggtagctgatattgataaatttaaagagataaaggggtttgatgagcgtttcttcatgtactttgaagacaacgacttgtgtttgagttttgaaaaagcaggttacaagttattgtacacacccttttatgcagttatccatttttacgggaagggtgcgcatcgaaatgcaaaactgtttcgcgtgtttttgacttctatgatgaaatttttcaataagtgggggtggcgttttttctgatgaaaccagaaatattagtagtcgttgtgctttatcagcaactattcagtcaatctccagcttatggaccattaagcaaagcacttagcgaaaagcaaattcagcttattatttacgataatagtcctcaaaggcagcaaaatgagctgtttgaaaaagaaaatatcgtttaccatcatgatccgcaaaatcctggtttagcggtggcttataattttgcgttgtctcaagcagatgaaggaacacgttgtctcgtcactctggatcaggatacgaggctagtcgacgattattttgaactattgcgtaaagtaacctttacagatgaatgtgttgctgcagttccgatgattttttctgggagccgacaagtttctcccctatattcagatcgttatatcaatcgtacagctcaagcagtagaagttgaaggcccaacagctgaacgaatcatggcaatcaattcaggtgttgcctggtctgtcaaatttctaaaaaagattggcgggtttaatcctgctttttctttagattttttggatcattggctgttttggaaagtggatcagttggaaaaaactgtggagatccttcctgtacgaatggaacatgatctttcggttttagactatgaaaaagtttcaagtaatcgataccgttctattttacaagcagaaaatcgattttatcatgaatatgatcaaaggcatttatccagtcaccgacgacaattattgttaagaacagctaaacagttcttgaccgtcaaaaaccggcatatctggcggatgactttgtgctcatatgttaagaattggaaggtgtgaattcgtgcgttcggtttgtatagctacctttaatggaggcagatatttaagagagcagttagatagtattttatctcagctttcagcagaagatgaagtagtcatttctgatgatgggtcagtagatgatacatgggatatattaactgaatacgcagaaaaagataagcgaatccagcttttttcggggcctcgtcaaggattgatcgctaattttggttatgcgatccagcagacgaaaggagatctaatctttttggcagaccaagatgatgtttggttggagacaaaagtgaaaaagatcactgactattttgagcagaatccggatcagctagtagtagtttctgatttgatcattgtggacagcgagctgcaagagatccatgattcgtatttttcgtttcgaaattccaaagaaggatggcttaataatgtgataagaagtcactatattggtgctggtatggctttccggtcttctttaaaacccgatattttgccgatcccgtcagaagtgccaatgcatgatatgtggattggtttgctgggaggaaagaagactgggttcctaagagaaccgttaactctgtaccgaagacatgatttaaacgcgagtgagattgaaacacattctaaattacggcaaaaaatttcttggcgtgttcatctgattacggcgttgatcaaacgaaaatggtttaaacgttgataaaagatgtttaaatccttaatatttccatgacaaatataacaattgatgagataataacaaagtgaaatttgaaatcaaaaaggagagcatatatccatgaagggaatcattcttgctgggggcagcggaacacgtctgtaccctttaacaaaggcaacatcgaaacaattgatgccgatttatgacaaaccaatgatttattatccaatgtctactctgatgttggcgggaatcaaagaaattctgattatttcaacgccacaagatacaccacgtttcaaggaattatttggaaacggaaatgatttaggactgcagatcgaatatgcagtacaagaaagtccagatggattggcacaagcgtttatcattggagaagaatttattggagatgatagtgtctgcttggtattaggggacaatatttactatggtggcggtctgtctaaaatgttgcaacgagcagcttcaaaagatacaggcgcgacagtatttggctatcatgtcaatgatccagaacgctttggtgtagtagaatttgatgagaatatgcaagctttgtcgattgaagaaaagcctgctcagccaaaatcaaattacgctgtaactggcctttatttttatgacaatgaggtaatttctatcgctaaagatatcaaaccttcagaacgtggagaactagagattacggatgtcaataaagcatatttggataaaggaaaactatccgtagaacttatgggacgcggatttgcttggcttgatacaggaacacatgaatcattgcttgaagcatctacctttatcgaaacaattgaaaaacgtcagaacttaaaagtggcttgtttggaagaaattgcttaccgtatgggctacatcgataaggaacaattgctggcccttgcacagccattgaaaaaaaatcaatacggtcaatatttattgaatttggccgctgaataaggagtccttacagatgaaagtaacagatacaaaattaacagatgtcaaaatcgtagaaatggacgtctttggcgatcatcgcggtttcttcacagaaagttattcaaaagcaaaatttgcagaacatggattgaaatatgactttgttcaagacaaccattcactatcagctgaagctggtgtccttcgggggcttcatttccaaaaaggagaagctgcacagacaaaattgattcgggtagtcactggagcagttttagatgtagtagtggatatccgcaaaggtagcccgacttatggtcaatgggacggatttatcttatctgaacataatcatcgacagttgcttgtacctaaaggatatgcccatggattcgttactttgacaccaaatgtgaacttcctttataagtgtgataattactataatgcagaagcagatgggggcatcgcatttgatgatccagatttagcgattgattggccaattgatccatcaagagcgattatgtcggaaaaagatcaccgtcatccgacattaaaagaatttgaagcagaaaatccatttgtttacggagaaatctaagaattaaggagaaattttcttatgaaaaacatcattgttaccggaggtgccggattcatcggctctaatttcgttcattacgtggtaaacaatcatccagaagtgcatgtcactgttttggataaactgacttatgcaggaaacaaagagaacttggctggacttcctagcgatcgcgtagaattggtcgtaggagatgttgcagatgcagaattagtggaccgtctagtaaaagaagcggacgcagttgttcattacgcggcagaatcccataacgataattcattaaaagatcctttcccatttgtacaaacgaatatcattggtacgtatacacttttagaagcttgccgcaagtatgatgtacgctatcatcacgtatctactgacgaggtttacggcgatcttccattacgtgaagacctgccaggacatggggaaggcgaaggagaaaaattcactgcggaaacaccatataatccttcaagtccatattcttctacaaaagctggttcagatctgttagtaaaagcatgggtgcgttcttttggcttacgtgcaaccatttcaaactgttcaaacaactatggtccttatcagcatattgaaaaatttattcctcgccaagtaacgaatatcttaagcggtattcgtccaaaattatatggcgaaggaaagaatgttcgtgactggatccatacgaatgatcattcttcagcagtgtggctgattttgacgaaaggcagaattggcgaaacctatctgatcggtgcagacggtgaagaagataataagaccgtgatggaattgatcttagaaatgatgggtcaaccaaaagatgcgtacgaccatgtaaacgaccgtgcaggacacgacttgcgttatgcaatcgattcgacaaaattacgggaagagttaggatggaagcctgagtttacgaacttccgtgatgggttggctgacacgatcaaatggtacgaagaacatgaagactggtggaaaaaagaaaaagaggccgttgaagcagcatatgccaaaaatggacaataatacagagaaaatgtcactgtattattggaaaaacacatgtgaggcaggcgctcgcctgtctcttttttaaaataaaaatcaaggagcggataatcatatgtttttattaactggaggaaatgggcaactaggtacagaattgcgccatttattagatgaaaaaaatctgccatatgtttcaacagatgcaaaagacttggatatcacagatgccgagaaaacaatggcttacatcacagaattaaaacctgatgttattttccattgtgcagcttacacagcagtagataaagcagaagaagaagcaaaagaattagatgagaagatcaatgttgatggtacaagaaatgtagcacttgcagcaaaagctgtgaatgctcaattcgtctatatcagtacagactatgttttcgatggaaaaaacaaaaatgtagaatacgaagtagacgaccaaacgaatccactaaatgaatatggtcgtacgaaattattaggcgaaaaagcagtagaagagattttagaagactattatatcatacgaacttcttgggttttcgggatctatggacacaatttcgtcttcacgatgcaacgtctagcggaaacccgcgacaaactgactgtagtaaatgaccagtttgggcgaccaacttggacacgtactttggcagaatttatggtatatgtcatcgaagaaaaagcaccatttggtatttatcatttgtcgaacgaaaatagctgttcttggtatgaattcgcaaaagaaatattgaaagatacagatgtagaagttgcacctgttacgtcagaagaatttccgcaaaaagcaacacgtccgcagtattcagtcatgagcctgaaaaagacagaagcgttaggttttgtcataccaacttggcaagaagcacttgcgcaaatgctggaagctgccaaaaaaatgaataagtaatttcctttttatcaaatagaatttggagcatgatatggaaaaacaaacaagaagtgcacgacgaaaagaaaagccaaaagcgaatcaggcagattcgaatttggtgcttgacctgtttctaaaactccgctatcttattggcgttttagtcatcgtggtcatcgttacttttaatttaaatggaagttcacttggtgtttgggataaatatgtgtcgcaaagagacgatgggaaaaaaactgatgtgatttttggacagaatcgggaagtgcggtcagacgaatggctggtgcagacacctttttacctctcacaagctgaagaggactttccgttggtgaacgaggattattcattaaacggacaaaacatgatcattgcgtataattctcctgtaaaggatattacggttatcggaaaaccattcaactggggattctttttcctcggaagagatcgaggactttccttttattgggcgatgaaattagtcgtcatggtcttgcttggattcgaagtactgatgatattaacgaagagaaaaaaagctctatcgctaatcggtgcatttgcgctgacattttctccagcagtccagtggtggttcatgcaacatgtgggcgatttgattttctttactttgggactgatgactgctttttatcattatttctacaatcatgataaaaaatggctacgaacgttgatgatgcttttggtggttattttcggtattgggtttattttagtgatttacccagcccatcaagtgatgctggcgtacttgctgattttttattttgttggcctgcttatttactatagcaagaaagtttcatgggatctgttggatgtagtgttgattggaggggcagttttatttattggcggagtcatggttcatttctggctaacgtcaaaagacgcattgttagcttctttgaataccttatatccaggaaaacgggtaagtactggaggaaagtggacgattggcgaatttttttctttccttacaaattggaaaattccttttgaagatatcaactattcgaataactctgaagtggccctgttctatcacttttttccaactgtattcctagcaagtccatttgtgttatttggcaaaaaagatagcgaacaaaagttactgggacgtattttgatgattttttgtctgttttctatcttttggattaccgttgggttgccaaaatggctagcagaaatcactctgctgtcttatgttcctccattaagagccatccttacttttagttttgcggcttgtttattatcgatctggtttatcgcttatatttggagagaagatgttattcctatttggtataaattcattttgttggcagtaaatgcatggtcttatttctatgcgattacgcattcgaaaatggataattatttttcggattttgaaaccatcgcagttgctgtgttgggaacagtgattttagcttttgcattatttggctggagacgcttgttttacctcgcttttgccgccttagttatcgtatctggctttttcgtcaatccagtcgtagaaggtacaggagcgatttttgaaaaaacactggcaaaagaaatccaaaaaatcgatcaacaagatcctggtaaagtttggttgtctgaagatgaattatataacttcaccccaacattgggagtgaaatccttcaatacagtacgcttttatccagatatagctgcatggaagaaaatcgatccgaaagaagaatacgagaagtattataatcggtatgctcatacaagagcttttatcgctaaggaagatacaaagttcattttagatcgtccagatatgttttcggtcacgttgaattttgaagacgcagaaaaattagggatcgactatgtgatcagtaaacgaccattaactgattacaaccaattatatgaagcgcagttcacgcagctatatggaccggataaagacggttatatgatttttaaagtagaatatccggattatccagatgtaccacaaacacaaactcaggaaaatcagctagtcgtacagtaataggctagctgagaataatcctgaaatgttagtagaaaggagagtggagataattcaagcaatcgtacaaaaatttgtcaacaaaatgagtgtcggtttcttgcttttgttgctgacgctagtcttttttgtttggacagcagggttaggttttccagcaactttgtttatatataacaatagttcattacttatcgcttttagtgtggctattttgctcattttaaatgtttataaagcaaaaggcgtcgattttctttatctaggtgttgcgcttgcccttttcattttcttttcttactttcgggaattaagaaatgagtctttatttggagacttactgtttcctttgattattttattttgtttagtaattaaatggatcgagtggacaaaatgggatcgcggtatttatctgattgtcttttcggtcttcctcggaatcacgttatatcgtgtatttacagagatccaagtaccagaaggacaaagcatctgggctccaggcaattcgctttctgatatttggatcaatacgaatacaatcggaagttctttgatgactcttgctttattgatcagtggatttgccagttcttttgaacgatggtatgtacgaatcatcggtgcagtagcagttgttgcagcttttctcgggatttgggtctgccaatctagaggtgcattagtcgcgttgattgtttttgcgatattggatcttttacctaaatcgttgatgcgtgtcattcgtgcgccatttattgcttacacggttacgattcttttagctttgccgatttcttatctggcggctgtctctgaaaaagtcaatttgtttaccggtcgagaagatatttggcataaattctatcagacgctaggagaaaaatctgaacaaattttactaggaatgaaaacatttatcttccaacgaggaaaccaatttttaggaaaccacaatagttataattctattttgaatatctatggattgataggatttgggattgctgctttgctgcttatcctttttattggtcgcttaacgttgaaagcagatttatccaacgggcagatgacttttatctgggccttttttgcggtgatgatgcagtcatttatggaggatacattgacttcatacccatgggttccgattatttatatcctgttggctatggccgttcatcgatatgatgaaccagaagttgcggaggaattctatgttatggaagaggcatatgacgatatgacttatgatgatacatcttatgaggaacaaccagatagcgctcattcttccaggatccaacgctatcattgataggcacaaaatacgagagaggctgtgacaaccgtcgcagccttttttggtttattgcaattgtctagcatcttctgtaaaatagaaacgttagagaaaatcttgtatcatagaaaattaagaaagaaataagaacgcagctcggtaccaaaaatatggtaaaatggcacttgactgtaattcactgaaaatcgcttggaggaacacaaatgtttaaagatttgtatttatttatgaaggacatttatcagaacagaaaattattgctacagttttcgatcaatgacttcaaatcaagatatgcaggatcgtttttaggaatcttatgggcgtttatcaatccgctatttactgtattgatttattggctggtatttggtgttggactgaaagcacaaatgatcgatgcaaaatacccatttatcgtatatttagttaccgggatgattccctggttcttcttctcagatgcatttgcatcaactacggttgtttttcgggaatatacttatttagtaaagaaagtcgtattcaatattcgtatcttgcccacgacgaaaatcctatccaatctgtacacccatttattcttcattctgattggcatagctgtcgcgcttataaatggtatatatccttcagcaatgtctttacagctgatttattatttattttgcatgtgtgctttcttgacaggattgacttggctgacggcatcgatccaaccatttttacctgatatcatgcaattaattacgatcgtgctgcagttgatcatgtggacattaccgatattatggagccctaatcagtttgattcaggtcttgtaagcatattgaaattaaatccgctgtactatgttgttcaaggttatcgtgagtcatttttaagtgaagcttggttctgggagcatggaacatatactttgtatttctgggttttcacgttagtaatgttcgtaatcggctctgcagtgttccgtagattgaaaccacatttttcagatgtgctgtaaggagaatagctatgacagaatatgcaattagactaaaagatatcacaaaatcttataatatgtacgcaaaaccttcggatcgatttcgtgaagccctcaatccttttaagaaatcctatcatgatgtattttatgcgttgaaaaacgtgaatgtagaaataaaaaaaggtgagatgatcggtttcgtgggagaaaacggatcgggaaaatctacaatgttgaaaatcattacgggagtactgacaccaacatccggcacgatggaaatcgaaggaaaaatctcagctttgctagaactaggttcaggattcaatcctgagtattctggttatgaaaatatctatttaaatggaatggttctaggattttcaagagaagaagtcgatgaaatggtcgatgatatcattgaatttgctgatattggcgaccatatttatcaacctgtaaaaacctattcaagtgggatgttcgttcgtctagcttttgctgtagcgatcaatgtgaatcctgatattttgattgtggatgaagcattggcagtaggagatcttgaattccaactgaaatgtatggaaaaatttacagaaattaagaactcgggaaaaacgattttattcgtttctcatgatattagttcgattcgccgtttttgtgatcgttcctattggttgaaaaatggagaagttgtcgaatatggtgatacgatggaagtaacgacgaattacgaaaactttttgaagaaaaaatcagttaaaacagtagatcgaaataaaaaccaagtagaacgcttcgcagctccagatatcgtagacgtgacgaaagccgaattgttggataaagataaaaatccagtggatatgctggaacaaggagaaaaactatacgttaaagtaacctatgaagtaaaagacgatacaatcaaaaatccagttttaggaattgctctgcgtacagtcgacaatttttatgtgtgcggactcaatactctactagatggtatcaagatcccttggaaaaaaggtgagaatatcttttatctggagtatgaaaagttaggtttgttagctggtgaatattattttgacgttgcggtctttgaagaaaatgcaacggttcctttggtatacaagacaaaatacatgaacttgtttgtcagcggttcttatatcggagaaggcatcgtggtcttagaccataaatgggaagaagggactcatagcaatgaaatatgattttgaaatggacctagatgaacaaagcagtgtgggaaaaattgcctcacagatcaaaccaggaagtaaagttttagagtttggtcctggaaacggccgattaacgaaacatttgatcggagcaaaacaatgtgaagtgagcattgtcgagctagataaggaattgttcgattttgtcagcgagtttgcccaagatggattttatggagatatcgaaagttttgaatgggcaaactattatgctggacaaacatttgattacgttttgtttgccgatgttttagaacatttggtagatcctggaaaaacgttgaagaaagttagagaatttttgaatgaagaaggagaaattctaattacattccctaacttggcgcataattctgtcatgattgatttgttcaataatcaattgccatgggcttcttatggtttgctagatgaaacccataattctttttatactcatgatggcttccaaaaagtttttgaaaaagcaggattatacatcaatattgaagattatttgtacttagctgtaggtgatacagaattaaaatcaacttatgaagaattgccggaagctgtacgttatgatttcaaaatgcgaccatttggcgaagtctaccaatacttcttctcattgatgaaacatccagtagcacaaagttccattgcgcagccacaaaattctaattatgtgaaagtattagaagtaatccagcaaacgaaacaagatgaaataattcaacaaataccattcaataatttcacaggggaaaatgagacactaagtttccatgtatcagaattagcagaacgaatggtgtttcgcttcgcgcagcaacctagctttatcgaattcagcgcagaagctgctggagaaaaactcacatttatcgattcaaatgctgtagtcaaaacagtaaatgattgttatttgtttgatggtaaagatttaccagagttctttttaacggatattgcagggaaagaagtgactatccattgtcactatcgttttatcggagaattgacaccaacaatgaaagaattgctggaaacaatccgtccaatggctgaagttacaaagcagctttctgagaaaaatgatgaattagaaagagaaaatcattatcttattgagaataatacaagattagatcagacgttgaaaacaaccataaatcgctattgcacgttgttggaaagtgatgaatggacaatcaaacatagattagggcgacgtaagaaagaaacatcgaaaaaaatccaagaaaaagagctttctctatgtattgacgaaaaaatctgggatgcagaaacaaagatattgaaaatcatcgggtggggaatcgctaattcggatcgccaaccattgtcctataagttatcagccgaccaatcaccattttttgaagcaattcctgttttacgagaagaagtcaatcaagcaaaacagctagctgaaggagcaaaagcaggatttgaactgcggatcctttgcgagaaggaacgttcattcttagttgaagcagtggctcaaaatggtcaatcatggatcattgaaatgtaaataatgattaacttataaagataaggagtaaacgaatcgtgcaaaaaaaagaaattgccgtatttatcgatcaaatcactcgtgaacgggccactggcgatttgcttattgtgggctgggcaattgatgaagtgaccaaagaaatccctacgataaaggtagaaaaagaaaatgtgattgctgaagcaacacatgtcgtaagattggatatcaatcatttatataatcttgatgttaagacccaaagcggttttaaggtacgtttatcagggaaaatgagaggaaaagcaatcttagacttccaaacagcaagacatcaaaatggcatagctgtgaaattaaacggtaaatatccttatgatgacggcattgaatcttcatgggaaagaaaaaaaagattactgaaaaaagggataaattatgcaaggactcatggcgtaaaaaaagcaatccgccgggtcaaactggaattgaaaccaggatcgatcgactatgcagagtggatcagtcgtcatgagaaacctgatctgaaagagcaaaggaaagaagtacaaggatttgcctaccgcccgttgatttccatacttatgcctgtctataacgttgaaatcaaatggctcgaaaaatgcattgattcggtacttgatcaaacgtatgatcactgggaactatgtatcagtgatgatgcttctactgatccagctatccgaaagtgtctagaatcctatcaagcaaaagatgatagaatcaaagtcgttttccgacaagaaaatggacacatcagtctggcaactaattctgcattggaaatggcagaaggagagtttatagcgctcttagataatgatgacgaattacctccatttgccttatatgaagtggcaaaagtgctaaacgtacatccagaactggatttgatctacagtgacgaagataaaatcgatgcagatgggaatcgctttgacccgcacttcaaagcagactggtctcccgatacattgatgggaaataattatatctctcacttaggcgtatatcggacaagcattgttaaggaacttggcggtttccgtaaaggatatgaaggctctcaagattatgatttggttcttcgtgtgacagaacaaattcctgcagaacacatttaccacattgaccgtgtcttgtatcattggcggacgatcccgggatcaactgcaagcaatggagaagctaaaagctacatctatgattctggagtgaaagcattgacagatgctctatctagaagaaatatcaagggaagcgtacatcctggcagaatttctggtttttatgaaatcacttatgatgttttgcaagaagatttggtcagtgtgatcattccaactaagaatggctatgaagatctaaaaacttgtgtggattcgatcatcgaaaaaacgtcttatccaaattatgaaatcattattgcagataatggaagtacagatcctaaaatgcaagaattatttgcagaatacaagcatcagctgaaagaccgatttatcgttgaattaattgacattccattcaattattcacgtatcaacaatctggcagcagaaaaagcaaacggcaaatactttttattcttgaataacgatacagaagtgattgaacctgactggatgacagcgatggtttcttatgcacagtttgatcgaatcggctgtgtaggagcaaaattattttatccggatgatacaacgcagcatgcaggtgtattattagggatcggtggcgttgcaggacatgcattgaataactatgatcgaacacattgtggttactttggccgattggtcattgacgtcaattacttagcagtcactgcagcttgtatgatggtcaaggcagctgacttcaatgctgtcaatggatttgatgaaacattagaagtagcattcaacgatgttgacttgtgcttgaaagtttatgaactgggtcgttacaatgtctatgcacatcaagcagaattgtaccatttcgaatctaaatcaagaggttatgaagatacaccagaaaaacaaagacgttttgctggggaaatcaaaaaaatgcaagataagtggccttcttatattgctcatgacccattttataacgataatctaactaaagaaggaatcggcgatttttcgttgagacctgactaaaaataaaaaactgtttcgtcatctaaatagatgatgaaatagttttttacttatgcaatattgtataggtatccacaacaattcttattaaaagacaagaatttttcttttaatttattttacaatttggttattcactaggtttttaaactttgctatggtaagatgatagaggcattattttatggttaggagtgtatatatgaataaaaatggggagtggaatgcggcacgcaggatattcattatcatcatggatgtacttgtattgaatgtgtctatctatcttagctttttgctgaaattccaaggagaagtcccagtgagaaacttagagacctttcagcattcagcagtttttatttccattatctttattgcgttgaatattttgttaggagcttatgtattctataaccgaatgatcagtgatatcgtcttcattactgttattggacaggtgctgatagcattggggatcatggtggttacttttgctggacgatggtttgcatttccgcgtggcgtcattttgatctcgtttatcctaggtacgatattacttagcgtttatcggatagtcgtttacaaactatacttaagagtcagtcgtgataagaaagtacttatcgtaggtttggagaaagatgtcgcaccagcgatccaaaactttcaatctaagaaaaacaacaaacataaggttgaagcagtggcaatcgataattattacgaaaatacaaaaaaattgatcgatgatatggatatcgtctatttggcttctaaaatcccagaagatgaaaaaatcagcatttatcaattagtgactaaaaaagagaagaagttatttttaaatacgacttttgagaatctgacaatgataaatccgaatattatgaattttgaagatgaaagcatcattgaagcttctgggttcagaatccaaccagaatacgaactattcaagcgtctctttgatatcatcgtttcgcttattttactgatcctcgcctcaccttttatgctaatcacagcgattttggtaaaaacaacttcacctggaccaatcatctataaacaagtacgtattacgaaaaatcaaaaggaattttcaatctataaattccgttccatgagcgcgacagctgaagcaaaatcaggaccagtcttggctaaaagtaacgatgcacgtgtgacaccagtaggtaaatttatccgtgctatacgttttgacgaattacctcaaatctttaatgtattgaaaggcgatatgtcgattgtcggtccaaggccagaaagaccatttttcgttgatcagttcaatgaagaaaatccttattattatttaagacacaatgtacgtgcgggaattaccggatatgcacaagtatacggaaaatatgtatcagattataacagtaaactacgttttgatttgttgtatatcaaaaaatattcattactattagatttgaagattttacttcaaacaatcaaaatcttatttgataagatgtcctctcaaggactagatgaagatgaaaatatcagttcattagcagaaagtgcatttccaaaagaaaaaacgtatcgttagattggaaaaattttgagcaaagaagtaggagagaacattggaaaataaaaatataagtatactgctttctttgtatgataaagaaaagccggaatatttaaaggaagcattagctagtatctttgagcaaacggtgatgccggcagaaatcgtattggtttatgatggccctataaatgagaagcttcaggcagttgtcacttatttccagcaaaaagttcctcacttgtttacagttgtaaaattagaaaaaaatcaaggattggggattgctttagcaactggattagaacatactaaaaatcgcttagtggccagaatggatacagatgacatcatggaaccacacagattggaaaaacaattagagatcttccaagaatatccagaaatagcgattgttgggagtaatattgaagaatttactggcacacttagcaatgttatcggaagaaggattgtacctgagtataatgatgaaatccgtgtgttttcgaaaagaagaaacccttttaatcatatgacagtcatgtttgataaaaatgctattttagaagtgggaaactatcgcccattaattggatttgaagattattatttgtgggtaagactattgaaagcgggatataaaggatataatatccaagagattctagtccatgctagagcaggtgctgacatgtatgctagacgtggaggaagtaaatatcttttaccaggaattaaaggccgatatcgcgtatggaaagatggtctaggatcactaaaagattttctgatagttatttgcggacatcttgtaattagtttattaccgaataaaattaggggaaaagtatatgaatcaaaacttagaaaaacaaactaaactttctataatcatacctttttacaatgcaaaaaatactttaagaagagctgtagacagcgtcttaacgcaaggttatcccaatattgaaatcttgttaattgatgatggatctacagatggtagtagtgacattggtgacgaaattgctaatctagagagtaaagtagcatgttatcacttagaaaacgctggtccatcagttgctaggaactatgggataaaagaagcaactggaaatttggtaggatttttagatagtgacgattattttttacctgattgttttaataatgttttgaaagactaccataggaatcaccccgatatcattgcttttggattaagtaaaggaaaaaatatagaaaatgcaaatttatttgttcccgaaaagaagattggttgttcaagtgaagaagcaattgagcaaatgtttagaagtaaggcagtggacttttacgtatggaataaattttttaaaagggaattattcaatcatatagtttttccagaaaataaattatatgaggatatggttcctatgtatgaagcttttagggcggctagtaaaattgatattttgccattttcaggtattttttattatcaaaataacgatagcatcgtttatcagtcttttaattcaaaacagtatgataatattttgcaaagaaaaatattagttgatgaagtaaagaaagattatcctcgacttattaatttggccaatgctcggttagtagacggatatctttcaacagggtttaaaattactggcaagaatcaaaatcagaaagaaaaacaaaaatattataatcagtctaaaagagaaataaaaagtatatattcaaaaataagaagtaacaatgagatatcaattgctaaaaaattagctttatttttatacttaattaatcctaaaacttattttattttatataaaaaagttctaaaaaaataaagtttttttcgatatgttattttttatgtttattaacttcggaagactaaaatttttactggtaatgatacatttgtaaaaataaaaaagatgatttttaggaagtgaagagagtgcataaaattagtgttatagtacctgcatataacgtagaagactatttagaaaactgcttagaatctatttccaaccagacacattcaaatattgaaataatagtagtcgatgatggttccccggatcggagtggggaaattgcagaagaatataaaaaaaaagatatgcgattaaaagtgatacatcaagtgaatggtggtttaagtgcggctaggaattctggtcttgattctgcaacaggagattttgtgtgctttattgacagcgatgattggatagaaccagactatcttgagttactatattttggtacgcaaacttatggagcagatatctcggtgctaaaaataaaaaagatttcaagtttagaacaactaaaagaacatacaattgctgagagaaaatgggaaatatttgatagagaacaagcaatgaaaaacttatttataaataataaaattggctattctgcaaataataaattattcaatagaaatttatttgataatataagattcccactgggtaaattaatggaagataaggctactacttatttgttgatcgatcattccgaaaaagttgctgtcaattcatctgctaaatatcactattaccaaagccctaaaagtatactgagaggaggcttcaatcctagaatttttgattcttttgaagtccatgaagatatactaatattcatagataagttttatccggaattatcaattaatgttagaactcgctatgtctatgaagcaataaggatgatgatgacaatgattaaaaataactataccaataaagaagattatttacgttctataaatattttacaacgctttgaaaaagaagtgaaaattgatcccgacttttcaccaaaattaaaaaaattagtaaagtttttattaataaataaaaacttgccttactatatgtcaagtagtaagatagcaagtaaatttttgattaagatagaatctgtgaggtaagagatgaagaatataaaaaaatttttttcaaggaatattttcccggtttttattaaaatattacctattcaaaaaaatttaattgtattttcaagttttggcgggcgcaactattctggaaatccaagagttatttcagagaaaattcatgaaaaaaaattgaattacagaattatttggttaatcaaaaaagaagcgattataactgatttaccagattatattaaaagaattgattccgattcttttttagctgccttttatttgtatacagctaagtattggatagacgatagtcggaaaacgattaagtatgcaaaaaggaaaaaacaattttattttcaaacatggcacggtacgcctttaaaaaaaattgaatttgatgcaaaagataagttacctaaacgttacctaagctatgcgaaaaaagatagtgagtcaattacatatttattatctggtaatcgctatagttctgagaagtatgtttcagcattcaatatcgttccttctaaaatattagaagtaggaactcctagaaacgatgaattagcctctagtaaagagcaagtgtttgacttgaaaaagaaacaaatcaatgtcttatttgctccaacttttcgaaataatattgaggacaacggaattacgcaactagaatggttaggtgtggataacttacgtgaattttttaaaaagcaaaaacaagaattaaattttatgactaaatttcatcctaatgttcatagtaaattagcaactgattctaaaagtatagaatatatgaaaaaacatcaaattactttaattaatgatgggattcctcttgaaatgctttttgaagagatagatgttttaatcacagattattcatctatttttttcgattttgcgctaacaaaaaaaccaattatcctttttaactatgatgaaaaagaatatagcttagaaagaggtttttatatacagttaagtgagttaccaattataagcgtacaagatagttatggccttgttgatgtttttaaaaaccaacaagaaaagcttttgaaaagttctcaagagttacttgattatattggaaattatgaaacaggggcaagtacagaaaaggttcttgagttgttagagagggatataaagtgaaaaaaacagtaaaagatatattttataatgcgatatatcaagtctttttgattgttttgcccttacttactatacctatacttagtcgtagaataggttcaactggtttagggatttatgggtatgttttctcaatatcacaatttttaatgactgtcattgctgtgggaatgaatccttttcgtattcgaaatatcgctaaatcaaggaaagataaaaaagcactatctttacaattctggaatatttactttcttcaatttttaataggcttgagtgtttcctttctctatatagcctatatttatttttttgatgtaaagtataaaaatttatacttaattcaattgatatttattgcagggctaacattagatatttcttggttttttcaaggaattgaagaattttcgaaagtggttattagaaatacagttatcaaattatcatcggtattgttaataatcctttttgtttcaactaaagatgatttgtggatttatgtgttcattacttcaattactaactttttaggaagtttagttttctggttgagtatccacggaaaagtaggtaaaccactctttaactctaatgtttttaaacagttgtggaaaccagcttttattattttgactcctcagttgtttatgcaagtgtacacaactttagacaaaacgatagttgggtattttgtggatccaacagaattatcttattatgatcagtctcaaaaaattgctcgtattatattggcagtcttaacatcaattactattgttatgttgcctaaaatatctaaagcacaggcagagggaaaatcagaaaatattttagtttacacaaaaaaatcttttgattacacgattattattgcattaattctttttagtgtggtgtttatcaatacaaaagaatttgttccatggttttttggggagaatttcaaaccgatgacaataaacatgcttatttcttgtctaattatagttgttagtccaattggtggagtttttgctaaccaatttgcaattgctctagaaaaagataaggagtatgcttatccaatgatcattggtgcgattgtaagtattattggaaatgtagcttttgttcctacttatggcgctgtagcggctacgatcgtactcgtggtagtagaattattagtctttttctttagagtattttttgtacgaaaagaaataaaaatatcctatttctttgggaagaacgttatcttattttttatagtcaatcttactttgactacttcggcctattactttcttccacaattattctcttcttcatttttagatatggcaattaaatcaataatgattttcattatttatcttccgtttgtttattttctttttccagatatacgaaatgaaataagaaagattattcgaaaataaaataatgttgtaaataagtagttctttgtcaaatcgggctgataaggtcatttatgatcaacaaagttagtaagagttactagcttttaatgcatagcttattaacccgttgattagaaaaatccacaagcgcatattggtaaaactgcgaaatccataagcaaatcgttgcaatgttttgatatgtgtgcgaagattctctaattttgtattagaatactttttcgaaaattctagttaaaagcctttttcagatatgaaaaaggcttttaagatagtgaagtttcgagggaacttctttggtcatttctcgaagtagctagctgtttcttgtgataattgctaagcagcttttgataatactgctaagccattttaagttcataagagattgagggtagacaatcaactacttcactttctgttaaatagcgccattgaaaattctgccatttcttgaatgttgtataatccaactcgtcatctgattttagaagtaatttatacaaaggtttcaattgtcgatagtacttagcttgtgaagcgtctttttgattcaactgcttcatcacacgttttcgaacacgatcgaaaaacttgttcaagtgttgcccaatgtgaaagcaatcaatgatgatttgtgcatttgggaagggctctttgactaatgaaaaataaggggcattcatatctgtgacaatgtatcgaacccccatatgagcttttcttgtaaaacgcatgaaataagcaatcaaatcttttttttctccggctggacaaaatgtcaaagagcttccatgtctctcaattcatacaagaaaaggagaacttcccatggaaaattgaaagagagcgaaactcgtcgaatagtaaacaatgaggtaaatagtctagcttctgtcgcagcgttgccgatagagcagataatgtccgttgaactgtcgttactgaaagatcacaacgtttcgcaattgtctttaatgcttgacgctcggtcaactcttctaatatcgtgtaatgaacttgtttcgaaataaaacatgaaggagcgacaagatacgtatgagcagtaaaatatttcccgcatgattggcagtggtaatgttgttttctaagacgcaaataggtttgtttattcccactgcgatttaagataatcattgaaatcttcttgccgtttttctcgatctgctttgcagattctttacaaaatagacaatatctaaaagtgcgaactaatgtaccttcgattacgatggctttcttgtccttataaaaagtttcttgaaaagaattaatttcaatatttttatctttaatagtgaagagctctttgatagaatgagaaatggatatcaaaaacttcctttcagattgatgttttagacgactctattctatcggaatttttttatgtctgttttttttacaaaaaatctaggaccgacagaaaattctatcagtcctagaaattatagagccatttttttacgtcttatccagatatattgttcttttattgtttaaaaaatattatttatcactatttaaagaattaagttcgttctttatttgagttgtagagatctcaggtgttcttggtaaataaatcacttgtgcatctgttagttgttcaagttcatcaaaatgtccagcccaatcatcgcccatcacgaaataatctgcatggtattctattatatcttttactttttgttcccaattttcttcaggaataactaaatcaacgtagcgaatagcttcaagtaactgttttcttttttcataactaaaataacattttttttgtttcgcattccaattgaattcatctgtagaaagggcaacaataagataatctccatattgttttgctcgtttcagtaaattgatatgcccgtagtgaagcaaatcaaaggtaccgtaagtaattactcttttcatctttcacctctcgaaattcattaatatacattgttagtttagcatttttttgttagaattgaaaggacagtttatcctaaaaaggataagaaatatttatgagaaataggtggatggaggaaaaatgttgaatgaaagatttttaaaatatgtgaaaggttggtattttatttattttggttttattttaatgttacgagcaataggcccgtatttactattacctactagatatgatactttacttttttggcctgctggaatagcgggagttgtcttgatcattatagatgcaattattgcatttagagaaaaaaatctaaaaaaatatgattggctattaattgcttttattggcgcgatgctagtaagcagtttaatgaatttaaaatatggatatagcgaaaatattaagttaatcatgtggcaattaatctttttctttatgatttatcagtttggcaaagactatagtagtaacttttttttcaaagtatttacctggatactttcattggtatggtttttagctaatttagtatcattatactggtttgtcattcaatatggcataaaaattccaataaaatataagtattacccagttcgtttagggtggttaggcaaccgtttatttggtgtatatacagatccaaattttggtgcggttatatcattaattgtcatcattattgctatatattatttggtcacttacaagcatttaaatcttctatttaaaatattttttgtaattaatatttttattcaattctcgtttattgctttatcgggttcacgcaccacattagtttgtttattaataacaacttttgtttttagtttctttacaagttatagtagtcgttttcttaaaactaatactttaaaaagatggctaactgcattagtagtaggattgctaagtataattgcgatgtattatgtaacagatataactgctcatgcatgggcacatgttccgcatattacagaagtaaaaaaagatacatctgattcatcaggaacaactagcagcaataaagttgatttaaaacgccctgacactgatagcggggatgtttctaatttaaggtttgaactttggaaaagtgcaattgaaatattcaagagtaagccgatatccggaggttctccaggctactatattgaatatgcacatgataaactaccatatacattaatgggaaaagatactttaactgctcataattttattttcttagtgatggctgctacaggaggattaggtctattgacattgttaaccttcttatttatccaatgctttaaagccttgcgttattgtttcacacaaccaaatctagtaaaagataagcacttttttgctattttaatgattcttacaatagcagtttcggcattatttatcacagaactcattttggttagtacgataggttcatttattttttggggatatctgggttctatccaaaaaactatatctaaagaagaaggagtaactaattgaaactatttttaggtatatgaaagtagaaaagaaaactagttatcctaacttcaacaaattttatagtttttacaatataaaaatggtaaactaatattatttgatacgaaaatgtgcaattggagtgaatttgatggatattatattgattactggcggagctggttttatcggttcaacgctagcgaattatttgggaaaagaaaacaaaatcgtagtagtcgacgatttatcaatgggaaaaaaagaaaacttggatatggataaacaagtgactttcattgagggggatgtatcagatcctcaattgatggaaagaatcatgaaagaatatcagtttgcctatatttttcatctagctgctgtagctagtgtggcagattctgtagaacggcctgtagaaacacatcgtgtaaattttgacagtacgcttttattgcttgaattgtcacgaaaatatcaatctaatttaaaacgattagtatttagttcatcagctgcagtttatggtgatgaaccaacactgccaaaaaaagaagaatcagtcatccgtccattaacaccatatgctatcgataaatttgcagcagagcagtattttttagattatcatcatttgtatgatgttccaacaagtgctgtccgattttttaacgtttatggtccaaatcaaaatccgaactctccatatagcggagtcatttcgattctagtggaccgatacaaaaaacaattggcaggagaaaaagcagaatttactttatttggtgatgggagccaatctagagacttcgtttatatagaagatgttatacaagcacttttacttgttgccaaggaagaaaaagctttaggacagcaattcaatgtcggtacaggaaaaagcactacgctacttgaattgattcattcaattgatcaaatcttaggaacagagctagcgcttaaatatgaagcggagcgttcaggggatatacgtgattctttagcggatatttcaaagatccgttctttaggctatcaacctaaatttgatatattgagcggaatggaacggtatttaaagacagaaatttgatgaaaaaatgattgcatctttggataaataattctaaaaagtaaaacaagaattaaagttgtataaccaactatttaattcttgttttactttttatttaggaaatatataattatagattacaaatagtatcgtatttcgcaatcttaaaattatcttcttactatgaataagataataaaatttgtatttgtcctttttaggtaacttattttaatctatatacctttctggatcaacgaaagtatactttatatagtcataacgccgatgatcgcttcgagcgtctggcacgtcagtcacgacatcaaacaaaaaatatacgtctttcttcattctagttttcgcagcagggattttaaagtagttcttattagaatagtagagattgattaataagctatcttcgattgctaaaaagaaaacttctgaattccatactttataaaaatctttgataaatctattcgaatggtcaaatttaaaccataattgcgtctcattaaaaagcataaccattactccgatctatttttaaacttagtttctacctctaatatatatcgagtttttattttgccttcagagaatactgtttctttttttgcagttacaggttggttattttcggaaaaagctaatatagctaagattgaaacatccatctggaatttatcttttttgctgcttttctcataaaagtctgcatattcgtcactgatattttttctaataaattcttccatcataaaaatcacctcaaaacgattatacgaacttacgttcttgttgtaaagcgatatttgaggggcaaaaagggggcaaaaatgcgtttacctttgatatatctcagattgaacatagtgtttattttatgtcggtattgttgatttatagctgttttgagggtgttagatacataatagaatatagtggttttgtttacgtgcattacacggaaaagctgctcgtatcaaagaaatccgtcgttaatcattgttatcagactgagaaagaacccttggtattcaagggttcttttttcttagcatgtaatttgaacaccctgatccagtttttttctttaattattggtaggggagaataatggattagaataaatctacctataagtagtagtaaaaaaaagagcactatgataatatctttcttaagagtaaccgctttaataaaaaatccagaatattctaacataaatggagtattcttagaatcaaaaggagaaagaagatggtttatacttatacggagcaagaaaaaatgaaagtttgagacacattcatgaatgatggaaaagtaaaacaagtaccaagttcaacaaaaaagaaaaacatcctattgaaagaagtcttgaaacgctttgaccatggagtgacttatacagaaacagaggttaattcgatactgctgaacgtattttctagtggcgattatgtcgaacaaagacgttatctaatcacatttggctttttcaaaagaagttcagacggtcgggcatatcagatgatgggaattgaaaattagaagttttaatttatactcattgaaaaaagttcaagtatgcgatattggttctacaccgcatacttgaactttttttgtcatctgtatctataatacaaagccaagaacgttattcaaaatatggatagctatgataaaagctaatgagcgattcgcagttaaataagcaatcgtcagtaaaatcgttccaggagcgtacatgaaaaaatcaattggatgcgttacatgaataaagataattctcttttatttgtacgaataaataccaaaacgtacctcctaaaattagattcaaagaagatagcaaagaggaaaaagatagttctgcagcagctatagcggcatgtggattgctagaactttccaaacaactgcctgtttcagatcctcgtcatttcgattacgaagagatagcaatcaaaatcttggaagaattacagaaaaactatacaacgaaacgagttaacggatcaaacggtctgcttctccatgccgtttatgataaaaacagcttaaaaggtgtagatgaatgtgtgatctggggcgattacttttatgtagaaggaatcactcgtctagctaaaacatggtactgttactggtgatgtataagagaagaggaggattcatataatgaagcgatggaaaaaaatgatgattggatcaatagttttaggaatgtcactcgtatttggtgcttgtggtaatcaagaagacagtagtgaagaatcagcaaatgaaattaccgtttcgacatggaattatgaaacaacacctgaattcaaagcgctctttgaagcattcgaaaagaaaacgggaatcaaagtgaaagcagtagatattgcttcagatgattatgatacgaaactcaccacgatgctttcttctggagacacgacagatgtattgacgatgaaaaatcttttgtcgtattcaaattatgctttacgagatcagttagtcgatcaaacagaacgaattagagaattagacactgatgctgctgaagaaacatatgaaatgtatgatatcgatggaaaaacatatgcattgccatatcgaacggacttttgggtactatattacaataagaaaatgtttgatgatgcaggaatcgaatatccaaaaaatctaacttgggacgaatatgaagatttagcaaaaaaacttagtaaaaatgacggacaagtttacggagcatatcaacatatctggcgttcgacaatccaagctattgcagctgctcaaaacgaggcgaatcttgttgaaccagattatcaatatatgactgattattatgatcgagcattgaggatgcaaaaagaaggcgcgcagatggattttggcacggctaaatcaacgaaagtaacctatcagtctcaatttgaagaacaaaaagcagcaatgatgtacatgggaacttggtatatggctggcatactcgcaaacaaagaagcaagtaagacagaagtagaatggggaattacagctattcctcagaagaaaaaaggagaatcggtcacgacgtttggctcaccaacagcatttgctgtcaataaaaactcaaagaaacaaaaagcggcgcaagaatttattgaatttgcagccagtgaagaaggagcaaaagtattagcaggagtaggagtagttccttcatatcgtacggatgagattgatcagctttattttaatctcgctggaatgccaacggatgaaatttctaaaaaagctttttctcctgatgaaatcaaacttgaatttccgattgatacgtatgggcctgcaatcgataagattttacaagaagaatatgacttagttttggttggagatgaaacgccggaaaaaggaacggtaaatatggagaaacgtgtagctgcggaaaaagaataatcatgaaaggagagaagccaagagatcaaacactcttggtttcgtcatcgaaatggagaatagtataaataagaaagctacaaatcatttgcgtagaaaacgaacgtggatcgcttattcgtttatcgccccgaatttcattggttttttcgtttttacattaataccaatcctgttttcgcttgtactagcatttatgaaatgggattctttttcaacgccagaatttgctggactagataactttcgtaaaatggccaacgatgagacattttggatttctttgaaaaatacttttttatataccgctgctgtagtgcctggcacacttgtttgttcgttagggctagctttactactaaatcagaaaattagagggatgaagctttttcgtacgatatttttctttccgtatgttacttccttagtagcaattgctgttgtttggaatatgttgtttcatccaacagtgggacctattaatatctttttaagacgatttattgaacatcctccaggttggacttcaagttcaaattgggcgctttgggcaattgtaattgtcagtatttggcgagggatgggttattacatgattctataccttgcaggactacaaagtatccaaaaagaactatatgaagcgtcttcgctagatggagcaaaccgttggaaacaatttttgaatgtgacattaccttcgttgagaccaacaaccttctttgtaacgatcatgcttgtcatcaattgtttcaaggtgtttgaccttgtgcaagtgatgacggatggcggccctggtcgagcgacaaatgtgctggtttaccaaatctacaatgaagcattcaaaaaatttgattttggttatgcttcagctatttcacttgttttgttcgtaattgttttgggcgttacggttgttcaattttcttggaataagcgtcgtacttaggaggtgtgatatggaagagagtgttcgaaatgaaagaaaaaaagcaaaaattcgttcaaaaaacatgccctttattcaatggttgggtatgattctgctgattgtattagctttattgacgatcattccttttttatggatggtttctgcttcattcaaagcaaataatgaagtgttaacgattccgattcaatggatccctaaaacttggcatttagagaattatctggttatttggtctcgtattcctttagtgacattttttaagaatacagcttttttaagcgttgtgatcacgttgattcagttgtttacttctagttttgctgtttacgggttttctgaactaaattttaaagggcgcgatattttatttttagcatatatcggcacgattgctgtcccttggcagtcttatatgatcccgcagttcattatgatgagaaaagtgggtttaacagatacgttgtggtcgttggtgctattacaagcgttcaatgcttttggtgtgttcttgttgaagcaatattacagtagtatcccagattctttatgtgagagtgcgcggatcgatggcttatcagagtgggaaatctatcgcaagatcattttacctcttacaaaaccggcgattgccagtttgacgatcatcacattcgttaatacatggaacgattatatggggccattcatttatttgtcttctacggaaaataaaacaatccagttagggttgaaaatgtttattgggctatttgatgcagagtacgcattaatcatggctgcctcagttgtttctgttcttcctgttgcttttatatttttagcgatgcaaaaatattttgtagaagggatcgcttcatcaggaatgaaggaataggaggtgattatgaaagagcagcgttttgacaaaaatgtttatatggaattcttttattggttgtatcaatcattggcaagtagcctttgtttttggtgtgtcaatatcttgtatatagcagctgcgttccttttgtcgatagatggaaggaatgtcttttcctttattttttctttactttttattggtccaggttgcatcgtgatgataggtatgacagaagaattagcaaaagaaaaaagtttttcaccagtacgtttgttcataaagacgtttcgccaattttggctaaagggatttttttattggctatttgcttggatagttagtgtgataatgatttttgattgtttcttttttatacgtttttcttatggaaaatggttgattccgttgtttgttttacttgcttgtttatcagtttcctttagcatcaactgctggtattttcaggtgagaaatccagcgtcgaaaccaaatcaagttctacggatagcgttctactatacgttgaaaaaatggtatgtgagtttactagattttttactattgacaagtttgtttctcttctttttcgtaaagccccaatggtgtattctactaggtccttctatcgtatttggtttgatttacttcaacaatcgtaaattgatgagaactatggatctgtagactttataaattgaaactttcaattaagaatgacagttttttatgtaaaaactgtcattctttttcattttttgaaacatatggctaaacaaatgaaataaaacatgctatacttttgaatgaaacaggtttagaaactgtatcacttatttgtgattatttctaactaataattaaaaataaagcataaaaaggacgatgttcaatggctaaaaaaatgaaacaaggttcgaaatctgtagtagaaagtttgattaatcatcatgttgattatgtattcggtataccaggtgcaaaaatcgatggtgtatttaatgaattagaggatcaaggtcctgaattaatcgtgactcgtcacgaacaaaatgctgcatttatggcacaagcaatcggacgtattacaggagagccaggagtagttatcgcaacaagtggtcctggtgctagtaacttagctacaggtttggtaacagcgacagcagaaggtgacccagttttagcaattgccggacaagtaaaacgaagcgatctattgaagttgacccatcaaagcatggataatgcagcactgttccagccaatcacaaaatacagtgcagaaatccaagatccagaaacaatttcagaagtgattgccaatgcttatcgtatggctaagagttcaaaaaaaggcgcgagctttatcagtatcccgcaagatgtagtggatgcacctgtccaaggtaatgtcatcaagccattgagcgatcctaaattaggttctgcttctgcagatgatatccgttacctagctgaacgcattagagaagcaaaactaccggtactattagtaggtatgcgaggatcaagtgaaaaagaaacgttagccatcaggcaattagttgaaaagacagcattgcctgttgtagagacattccaagcagctggagtgatctcacgtgaattagaagcgcatttctttggtcgtgtgggtttatttagaaaccaaccaggagatatgcttttgaaacgaagtgatctagttattgcaattggctatgatccaatcgaatatgaagcaagaaactggaatgcggaaaaagatgcgcggatcattgtgatcgatgaagcgccagctgaaatcgatccttttatgcagcctgaaagagaattgatcggtgatatctcagccactcttgatttatttacaggttcattagagcctcaacaagtgtcagaagatgcaaaagaatatttagcatctcttcaagcaaaattaacggagcgggacattgttcaatcaaaaggagaagcaggtatcttgcatcctttagaagttattaacacgcttcagtcaaaagtaacagatgatatgactgttaccgtagatgtaggtagtcattatatttggatggcacgccactttagaagttatgaacctcgtcatttgttattcagtaatggtatgcaaacgcttggtgttgcattgccatgggcgatttctgctgcattggtgcgtcccaatacacaaatcgtatcagtttccggcgatgggggatttttattctctgcccaggatttagaaacggcggtacgtaaaaaattgaatatcgttcatttgatttggaatgatggacactacaatatggtagagttccaagaaaaaatgaaatatcagcgggcgtcaggtgtagactttggtccagttgattttgtgaaatatgcagaagcttttggcgctaaaggaatccgagctacaagtgtagaggaattagaaaaagctttagaagaaggatttgcgacagaaggacccgtaattattgatattccgattgattaccgtgataatgagaaattgggagaaacaatcttaccagatcaattctattaaggaagtgtcgacatgactgaaaaaatcttataccagcacgggacattaggagctttgatggccggcttgatggatggaacagaaacgattgctcatatattagaaaaaggaactctgggattgggaacattgcatgggcttgatggtgaagtcatctttttagatggcgtagcttatcaaggaagatcagatggctcagttgcccaattagatggaagtgaacttaccccctatgcagcaattacagattttacgccagatactagtttttctgtctcaaaaactgcagatggagaacaattgaaaaaagacatattagtaagagaagccggggaaaaccaatttttggcagtgaagataactggattattcaaaaatatgcacatccgtatcatgccgaagcaagaaaaaccttacagaagactagcaaaaatttcagagtctcaaccagaattccaacaaagcaatgtccaaggaacattagtcgggttctttacgcctgaattattccaaggagttgctgcagcgggatttcacctgcattttatcgatgatacacatacatttggcggacatgtaatggattttgaagtggctgaaggaaaagttgagattagccgcatctcgtcccttgtacagcattttccagttgatgatccgacttttgttcacgaaacgattgattatgctgatttagcagcagaaatccaacaagcagaatagaaaaagacagcgagatgcgttcaaggtgattaacctgacgtatctcgtttttttgaggagaaaacctagcgtttacaaaaaaactgagctataatcttctccatagatcaaaaaggagcggtttttatcatgtggacagaaaaacagaaaaaagatgcatacgaaattttattattacagcaacaaggattattagaagcagaagataactggttagcaaatttagcaaattcatctgcattgttgaatgagactttgcctgagactgtctttgcaggatattatttattcgatggtaatgaattgattttaggaccgttccaagggcgagtttcttgcacacgtatcaagatgggaaaaggagtttgtggagaatcagctgaaaaacaagaaacattgatcgttgatgatgtcaaaacccatgcaaattacatttcctgcgattcagccgcacaatcagaaatcgtagtgccaatggtaaaagaaggtaatttaatcggtgttttagatatcgattgcggagtaacgaaagggtatgatgaaatcgatcaagcatttctagaaaaatatgtagatcttttattatcaaattttaatataaatgctttttcatttattaataactaaaatcgtctattgaaacaaaaaagaagagaaatcaagaataaaaagagccggaaagacagtgggcatttctgtttttcggtttttttatttttttataaaatcacaagtgttattgattttcataatcatattttaatgttattatcattttaaataatgaaaaaacattaaggatggatgaaatatgaataacgaaactatcattttaggaaaaaaatatatttgccaacctattggcttgaaacaaaaagtggttggagaagtaatcagtaaattagaaaattgtgttgtgatctgcgtagacgaatatcatgacgtcgatcgcaatgaaatattagaaaaatgcggaaaagtagtggcaaaatatactcacgtttatgagttggaaacaacagaatatctatataactatagcaacaaatatgaacatactttagtttcataaagatttaaataaagtgccttcaaaagcgagaagaccaagcttttgaaggcactttatttagttggcagtgattgttcatgatttttgatttattcaaaaggtttgcctagagaatctgtctctgtaacgaggcctggtggagaaactcgataaaaacctatactgccagaactgtcctattttcggatagacaaactagtagttttaaaaagatcatccgatccaatcatttcaaaaaatgcaaaactgatatcaggatcatttagctcaggcttgttatcgtaaagcatttgtaaaggttgcatttagttaggagtaaacgcgaaactatcatcattatttgctgaagaagatgaagaagctaattcagagtttgtttgaaataaaggagacgtgctgacagtttctttaccctgttttttgcagaggtagaaacttttatatcggaagtttctaccggagaatttttctcatttgtagaaattgttgaatcgatactattcgaaatttgcgtatctgaaggtatgttctttgatgcagaagtcccacaagcagtaagtaacaataaatttgataaactgataaacagaattcttttcattatgtacacactccttatagtatcgtttagcatacacctatgctcagtattaggcaaaatcaatgcaaaactatcaagtcttttatagtatctattagtcttagtaatacatatatggagagggtgatatcccagttcaaaccagatacattggttaccatctgtattaacgattatgcctctaaacgctttttttatgaaaaaatttataagtgaaaacgtaggtatgatattatctagaggtcatttttttgggtatttaaatagttgctaggaggatagcttttggatttttacagtaattttatcttaataatagcaatattattacttctaaatatttggttttttgataagagtagaaatgcagggataggttttagaaccaaacgaagtacgtcttctgaaaaaaagtgggtatattcacagactattttttacggaggggttatttcaatcagtttactttcttcaacactttattcttttaatgttatagacgtttccatgtcaaattttatatctattattggaatccttatttctgcaattattacacaactacttcttgtgtttgaagagaagtcaaaaaataattaaagcaattatgccttttagtacaggaattattacttcttacaaatgtatagcgaatgtgaagcctgctgttttaattgttctagaaaaacttttgagtgaacaattattttatgttaggatgaattaatttctctagagtttataattaaaaaaacttatttgaaggaacatgcttaaaccataattgtgtttttccttccatcagcataaaagttcacctcaaaaagagtgtacgaacaaaagttctttttgtaaaccttaaaatagattttcctgaatacgtattggggatttctaaatgtttgaatgtttttttgaatgcaaaatcaatgcaaaaaattttgtatttctctacttttctctccttgaccaaaataaaaaaacgttgatttaacaacgtttttcatacatgtttatctgtctcaaccatacatatatggagacggcgggagtcgaacccgcgtccaaacacatcgccacttaaaaatctacgttcatagtcaactcatttaaggattcactttacagcttgccgagtgacaggcattctgtatcgctagtctgatgttctctttttcaacttacagacggaaagttgaaacgtatcccactaaagttaggacccttactcgagcacatgggcgatgccgagaggatctacgctaactgtttttaggcagctaaagcgtaagagttgttttcgtttttagcagttatatttaactgtaacgtttttacgtagacgtaacctacgaaacgcaattcaagctcgactgtgcctgtcgaatccgtaacgtccccgttagctaacaagggttacgtgtatttttcatacaaaattagtatagcatatattgggataaattcaataaaaaagcgaatcatatcccattatttatataataactgcccctttcttaagaaaaaataagcgattttcttaagaaaagaggtagcttcaaaaaaagatcttaaatcagatcaaaatacttcaatgcgtggacaattccgccttctgtatttttctttgtgataaaggtagaaagttcttttaatccgtcataggcgttgtccatagcgattttgttgtcgcaagcttccaacaaggcaaaatcattcggaccatcgccaaatccaaaagtaggaactttttccagctgaagttctttttgcagacgtttgacacctgccccttttgagattcctttcttcactgtatcgatcgagtaaggaccattccgataaaaagttagctcaggaaaatgttcgtgatagtattcgtcacctgattgagataagatcagcaacatatttactgtgttttctttaaagcctaaaggatcaatttccggaacatctgaatgaatgaagtcgtaagcattgatcattgtttggctatgaccggtacaccagattttctgatcgttatagtaagaaagttcatgaccgttcaactgtacatgatcatacattttttgacattcttctgaagaaaatgtttgagaatagatttcttcgccgtctactcgaatgaaagaaccattcatggtgaccgcagaagtaatgcccgcatcttccatgatagagtggatttctgcttctgtacgtcctgtagcgatgacggggagaacattgttttcttttaatgcgttcatagcttttgccacttcgggtgtgatttttgatttcgcatctagtaatgttccatcaagatcaaagaaagtgattgcacgataatttgacacaaataaaactccttttttattggaataagtttatcttaacaaagaatgaacaaaagacaaacctttcgtgaagaattcctgaacatattggttcagtcaacaatttagagtatactataagaagagaatttaggagggaaagaatgatttttttcagtattggtatcttattcttaataattggcagtctttttcggattctgccctcaaaaggaaatctgcctttttatgggtatcattcgcctcttgccgcaaaaacagacgctcattggcggctggctcaaaagacaagcggaaactggttttttcttatgggcttactgatggcattgatcggctattatttaaagacatctgggcatacgaattattttctgattgaaatgcttctgctagtatttccaattatgcctatttttattatgacagaaaagacattacagaaatatgacctggaaactggagggaacgataatgaatattttaatgattgaagataatcaatctgtttctgaaatgatgcagatgtttttcttaaatgaaggttgggaagcaactttcaagtatgatggaaaagaagggctcgatgcctttttagaaaacccacaacattgggatatgattacactagacctgaatttgcccacactggacggtatgctagtaggaagagagatccgcaaagtttcaagtactgtgccgattatcatgctgacagctagagattctgaaagcgatcaggtgatcggcttagagatgggggcagatgattatgtcacaaaacctttcagtcctctgacgcttattgctcgaatgaaagctttgcatcgccgtagtgagttggcagaagcaagagaagaagcagcagtttcagatgatcattttgatatcgagactagtcatttcaagatgaatacgaaaacacgagaagcgtatctggacaaccggccaattgaaggactgacgcctaaagagttcgatctattgtttactttagcaaaaaaaccacgtcaagtattctctcgggagcagttgcttgaattagtctgggattatcagtactttggtgatgaacggacagtggacgcccatatcaagaaattacgacaaaaaatcgaaaaggtcggaccacaagtcatccaaactgtttggggagtcggctacaaattcgatgattctggtgttgcctaatgcgttatttgtatcagcaactcttagctttttgcggaatggtcgcgttgatcttattgatcgttggagtttcttttacacaactgacaaaacaaacgattgaagaaaacaattaccagcaactgtttggatatgctgaatcagttgaaaagacaacgcaaacctatgccgatacgctcccgcagtttagtcaagatcaggcgtttcaaaatgcattgctgctgacagagcaagtactgacagaacaaaatgtgaactttatatttatcgataaaaacgaacgtgtcatttatccgactaatacagctttactgaattttaccttaacagctgatcaatggaaaaatctgaggaatggacgtcaagaaaaattcacatcgaataaaaatattttaggacaagcacaggcgacctcttacgcacttgtgccatttaatttgaatcatgaattctatggagcacttgtagttagtcaacctgcgcgaaatatcgataacagcgttcgtccaattacactgaacctgttcaaaggatttattttttccagtatcgttgcagttattgccagctatgcttttgcagcattccaagttaagcgtatcaatcggttaaggaatgcgacgaaagaagtgacgaatggtaattttgatgtacagctccccgtacatgacaaagatgaatttgatgagttagcagatgatttcaataaaatgacgaattcattgagagaatctcaagcagaaattgaagaacaagaaaatcgtcgaagacaatttatggcagatgcttctcacgagatgagaacacctcttacgacaatcaacggacttctggaagggttagaatacaatgcaatccctgaaaatcagcgagaaaacgcgattaaattgatgaaaaatgaaacagagcgtctgatccgtttggtgaatgaaaacttggattatgaaaaaatacgtacgaatcaaatcagtatggtcattaaaaaattcaatggaacagaaacattgaaaaatattgttgcacagttagaagctaaagcagaagcagcaggagatacattgacattgaaagccgttgatgatattgatgtttacgctgattatgaccgatttgtccaaatcatggtcaatattattcaaaacgcgatacagtttactgaaaacggccaaatcacgattactttagaaaaaggctatcttgaaacgatcatcacgattgaagatacgggaattggaatgtctgaacaacaaatgaaaagtatctgggatcgttattataaagtagatccttcaagaaaaaatacaaaatatggtgaatcaggattaggtttaccaatcgtgcagcaacttgtacgcttgcataaaggaaaattagaagtagaaagcgaactaggaaaaggaacaaaattcgctgttcgtttgcctgacgtagaaatcaaaaaagagtaaaaaacaagcggtataaaagatcatgaatcgatcttctataccgcttgtttttactataaaatgattgatttagcccgcgggctctaaacgatcaatataaggactttgagcaatagtagcatcatgagtaaagagtaagataccttgattttcttcatgagctaaataagaaagcaagtggagtagctcttggatctccaatacactaagttcatcaaatgtatcttcaataacaatattgtttcgcttggaaagcaaggcatgaagtaattgcagctttactttttcaaaagacgtcaactcagctgccgcacaattaagcaaggaaggagagatatcaagtttttcttgataggccaaacgatcttgtttgatttctttttccggtacatccaacaggacatggtctttaagattcagataaggaaacatcggccaatttttttggatgatcgcaaaattatccagttttgcaacaagaacctcttttttcaagtgctccaatattttatgctgtttttcgagaggacacaaaataacggtcaagtgttcagcatgaatcaaatattcaggtttcattacgtccaggcctcctactttgcaaatgatggataaaaaaagtgaaagggaatagactaagaatgagacagcatccactgagcccaataagagtttgggcaaatcccttaagtatatctgtgaaaaaaagatcattttggaaatcgatggtaaaaaaagtctgttgatccatcggaattgtaagtccgcttaccgaagtcaagatatcacggatatctggcagttcagtagtctttaagacaagaaaattgatcctttgaagaagcgcttcataaactgactggaagctgacgatccacaataaaaccaagatacaacaaagaaagagaggaaagaacagctgccagaaaataaaaaggaataatttggttttagaaagaccagtcaggcgccaattgatcaattcctgcttgttttgcctgactgaatagtaaaagaaaaagataaaaaggaaggcaaatagaaaaaataaactgaatatgccttttatataaaatcggctagctaattctaaagccggaagaagctctgtagatgcagaagcgccaataaatgaaagccgatcttggacttgattggctaaagccgattgcaaatggtaaagagtcaggcatgctatcaataaaaaagcagaaaagcttgaaaataaacaatagagtattgtctgctttttgtaataaattaatcgagcagtagcatagcggattattttcatacttttcacctctataaaaagtatagaaaatgaatatgaataaagtatgaaattcctttagtgaaatcacgaattaaaaccagaaaatattttgtaaaaagcaagaggttgtgaagaagctgccctattctattaccgtagatgcaagcttttgaacactgtttattcgaaaagaggagcagcgacaataattttgtcgctgctccttttaaatttattttatcattcggaagaacttgtggtcgttccgtgaagttcttggtacgtttgcgttttataaagatcaacagttgattgtcccttgtgttcactaaagacactagttgacttgtcaccaagagatttttcagcttcttttaatttctctaagccattcttgtagtcataatcactggtatcaattgggtctaatccactattcgtatagaaccgaagaagatcaccattattgatttggtcagaaacagctaactgtttatcaactttttctttcagtgaatcaatttcattctgtacttcctcagtaggttcagtaatagcttcaccagtttcgttactatagatcgtaccaccgtagtaagtatattttggtgtaacaaaatcaccatcacggaaagaaacaagctgttcatgatctttcgagaatagatcttgtcctaactgaatataattttttgtatctacacctagtaagtgaagtaatgtaggcaaggcatcaacttgtccgccgtaagtgtgattgattccgccctgtgtttgtccagggatatggatcatataagggacacgctgcatttgtgcattgtcgtagtttgtccaagtagaacttgtttttccaactaattcagctagatttttatttcttgaattcgagacaccgtaatggtcaccgtaaaggacgatgactgaattatcatacaagccgctttctttcaaataattgaagaattcttgtacggcggtatctaaataattggctgtcgcaaagtaaccgttgatcgtttcatcatttgtattggctaacgggaatcctgcttcgtcattggtgaattttgaataaggataatggttagatacagcaatgaattttgaataaaatggttgttgcagacgttccaagtattgtacggattgttggaaaaatggtttatcatgcaacccgtattggaacgaattgtcatcattaacatcataataagaagaatcaaagaaataatcatatcctaaattcttgtatgtctcgtttcgattccagaatgtaccagcgttcccatggaataccgcactagtgtaaccttgtgtttgacttaaaatatcaggtgcagcttggaaagtattttttccgcctaattgtgtgaacaaggagccttgattcaagccaaacaatgaattttccatcagcgtttccgcatcgcttgtttttcctgcttttacttgatggaaaaagttgtcaaaactgaacgtgctgttgctgtggtaaagactattgatgaaaggtgtaacttcatgctggacaccattctcatctgtcaatttataatcgatcaagaattgctggaagctttctaaatggatataaatcacattttttcctttagcaagcccgaacaaatcgtcatttggtgctgcataatgttcttttacataattttctacttctttcatatcattgggacttgcttctgcccgcacttggtttgtctggtaagtttgaacaccgtcataaaccatgaaagcattcaagccaagatatttgaccaaataatcacgagagaatgttcgagtcagcaattctggacgatcagcttccgccataaaaagatttcctgagaaaatcataactgctaatgtagagatcgcaaaagccattcttgctcggatcgggcgagggtccaacttgattttttttgcaatcagcagaacagccaagataataaaatcgatccaatagatcacatcatatgggcgaaacagtcgaatggcactttctcccagaccactcgctactttcccagcacctaaaatcgtgttgatcgtaatgaagtccgtgaattctcgataataagtgacattcgaaaaaacaagcaatgtcaaaagaaaataaatgaccatcatcgtgatataagcaactctagggcgtctgatataaagagcaattccaagtaataacaatgtagttgcaatagggttgataaacaagataaagtattgaatgccactttcgattccgagatggaaatcaactaaataggcaaaaatcgttttcaaccaaagtaaaacgactagtaaagaaaaaaatccgagcctcttattcaaaaaggcaggtgtttttatatatttcaagataatcttcctttctgcacttcttaatcacagaagtgtcatgaaaccatgttacacagctcacttattctcatttattttactagtatgacaatatagtgtcaattgaaaccagaagtttatgctgtttcattaaggttttctttaagcttcatgaaaaaatgagcagtaagacaagtcctatgttttttgttatacttgggaagagaaagctaaagtaggtgaaggaatgaaagtacaagtaaaaaaaagagcaagcaatcgattgaaaaaaggatatccactgatccaaaaagaagaccttgctcatccccaaaaagaaaccacgcaatgggtggaattagttgattcgcaaaaccaatttatcgcaaaaggatatctaggaaagcagaataagggaatcggttgggtattgagccagcagaacatcccatttgatcaatcattttttgaagaactttttgtgaagtcaaaagaaaaaagaactttctttttttcagatgattctactaccgcttttcgtatattcaatggagaaggagacgggatcggcggtctgattgttgattattatgcaggttatgctgttttttcttggtataacgaaacgttatatgcacatcgtgaattattgattcaagcttttcgtgaaatctacccggaaatcataggaggctatgagaaaattcgatttgaatcagtaaatctgcctgagagccagttcatttacggaaaagaggcaccggaacccttgatcgtaaaagaaaacggagtaaaatttgccgtttatttaaatgaaggattaatgactgggatctttttagaccaaaaagaagtacggggatcattagcagaaggtttcgcttctgggaaaacagttttgaacatgtttagttataccggcgccttttctgttgctgccgcaatgggaggggcaatcgaaacaacaagtgtcgatctagcaaaacgcagtttaaaaaaaacacaggaacagtttgaagtgaatggtttggatgtcgatcagcaaaaaatcattgttatggacgtattcgagtatttcaaatacgccaaaagaaaacaatttttatatgacatgattgtattggatccaccaagttttgccagaaataagaaaaaagtctttcgcgtagcaaaagattatggggaactggtcaaggatagtctggatattttagcagaagacgggatacttattgcgtctacaaatgctgcgaatgtctcgatagaacaattccaaataatgattgaagaggaattccatgccaaaaatgtttcttttgaacaacttgctttatatcgtctgccaaaagatttccagacgacggatacctttttagaaggcaattatctgaaagtgtttgtttatcaaattaaaaataaccattagaaggagcgatgcagaatggttcgggtaaagggattgaatataggaagcggtagaccaaagatttgtgcgcctcttatcggggccgtccgagaggaagtattacgtgaagcagttcttgcacgtgaagcaggggccgatttagtcgaatggcgagtcgatcattatcgtgaagttttttcttttgatgaagtagcagaaacattggttcttatccatgagatgcttgatggactgccgttattatttacgtttcgtaccttagctgaaggcggagaacaagacatatcgatccgtcagtatcgcgacctttatgaacatgtgatacacacaggattagtagatatggtcgatatcgagttgttcaaagtagaaagtctaggaaaaagactgatagaggaaatcaagtctttaaacattcctttaattatcagtagtcatgattttaaagaaacaccagcagaccctgtcttgctttaccgattgaatgttatggaacattttggagccgatatcggaaaactggcagtaactcccaataatgaacgagatgttttgcggttgatggagttgactagacgggcaaatgcttttgtctccatgcctattattacgatgtccatgggaaatcttggtaaaatttctcgtctggctggcggaacgacgggttccgttatgacatttggttccttaagcagcgattctacttctgctccaggacaattaccggtcaaagcattgaagcaaattattcaattattaaatgaaccgttgtagaacaagtttgaggtgatattttttggcaaagaaaaaaatagtaaaaacgaatgcaatccgtatggtcgaacaaaaaaagattccctatacagagcacgaatatgagtgggacgaaagccacctaagtgcgtcatcggtcgctgaacagcttccagaaagccaatctcgtatatttaaaacactggttgctgtgggcaatgtgacggggcctcttgttgctgtgataccgggagaagccgaattgaatctaaaaaaattagcaaaagtttcagggaataaaaaagtagaaatgctccatttaaaagatttggaagcaacgaccggatacatacgtggtggctgctcgcctataggtatgaaaaaactatttcctacttatttagatcaaattgcagaaagctatgaacaaatcattgtctcggctggcagaagagggctacagatggagttagcacctcaagatatctgtgcattaacgagcggacaatttgcagatataaaacaataaatcatacgtataaaagaaagaaggaggccgggatgttgtttgcccagtcttcttctttcttttttatacattatgctctttgcccagcattcattcctgctacatgccctgtagcgaaagccgctgtgatattaaagccgccagtataaccattgacatccagtaattctcccgcaaaatacagaccatcaatgattttactctccaacgttttaggatgaatttcctttagagaaacccctccgccagttacaaatgatttctcaataggaaaagtcttgttgattgatagcttaaactctttgcataattgaacgaaatcttgaatttgtttttgagaggcttgttgtcctgtcagatgatccatttcaagccgctcaagaaagaaaactaacaaccgctcaggtaataaaccgtgccaggcatttaccaagttctttttggtggttttacttttttctgtcaataaatgaataagctcttgtttggtttgtgtagggaaacaatccagagaaagtgtcactggttctcccgttttctctaattctttattgacaaaacttgaacaacgcagtgcagccggaccagaaataccgaaatgggtgaaaagtaaatccatcgtatgttcagtcaatacacgaccttttttatttaaaacgcgtaaagtgatgtcttgtaaagaaagcccttgaagtgttttctcctgaatatacggttcatccgatatcaagggggactctgtcgcataaagaggcgtcaccgtgtgacccactcgcttcacgatcttgtacccatctccagtagaaccagtagatggataagtccgtccaccagttgttaagataacggcaggagcatgaaactcttcgaattccgtgcgtataccgtaaattttatgttctttgtggatcaatttctctactcgagtagagaatagaagcgtcacatctagttctttcagacgattgagcaatgcttcgataatcgtttttgatttatttgttacaggaaacatccgtccatgatcctcttcttttaaatgtacgccttgtgattcaaagaagttcatgatatcgaaattattccattgcgcaaacgtactatataaaaactttccatttccaggaatatgtgcaatcaaatcatcaacaggacgattgttcgtaacattgcaccgaccaccacctgtcatcagtagtttttttcctgcttttttgtttttttcgatcaagagtacgcgtgcgccttgttcagctgcactgatcgctgccatcatcccgcttgttccagcgccgactacgatcacatcatacagtttttccattccctcacctcaaggaaagtgtagcatatctgaagaaagaaaacagaaaaaaatgttttgagccaaaagagaaaatgagctaaaatgggggaagataagcaaaggagcgtggaacgatgacaaacgcaacagaatatgttcaagcaattcaagaaaagctacatcaaaaggatcaagggcaagaagaatttttacaagcaatcgatgaattcatgcccacggttatgtcttttttggacactcatcccgaatatatcgaaaagaatatcttagaacttttaacggaaccagaaagagttattcaatttcgagtgccttggcaagatgatgaaggaaactggcgagtaaatagaggctaccgtatccaatacaattcagctatcggcccttataaaggtggattgcgcttccatcctagtgtcaatctaagtatcttaaaatttttggcttttgaacagattttcaagaatagtttaaccggtctgccaatcggtggaggaaaaggcggaagtgacttcgatcctaaaggaaaatctgataatgagatcatgcgtttttgtcaaagtttcatgctggaattgtcaaaacatatcggcccatcgattgatgttcctgcgggagatatcggtgtaggagctagagaaatcggctatttgttcggcgaatataaacgattgaaaaaatatgatactggtgtgttgacaggtaaacctttggatttttggggaagtaagatacgtacggaagctactggttatggattagtgtattatgtcaaacatctattgaacgaagaaaaagattcatttaatcaaaaaacagtttttgtttccggaagcgggaatgtagccatttatgcaatcgaaaaagtgcaagagctaggcgggaaagttgttacatgttcagattctagcgggtacatctatgatccagaaggaatagatgtgaaactattgaaaggagtcaaagaaatcaatagacaacgtttgacggaatacgcaaaccaacgtccttctgctatttatcatgctggagaatctgtttggacattgaaagaaaaagcggatatcgctttgccatgtgctactcaaaatgaaatagacgaaagcttggccgaaatcttagtagaaaatgggatcaaaatcgtagcagaaggcgctaatatgccatgtacagtaaaagctgtttctgttcttcatgaagcaggcgtgtggtattgtccaggaaaagctgctaatgctggaggagtggcagtatctgctttagaaatgagtcagaacgcccagcgattgacttgggaaagagagcaagtggatgagcagctggatcaaatcatggaaacgatttaccatgcgtgtcgccaaacagcagccgagtacggcgacgaaaaaaatctgcttcttggagcaaatgttgctggatttgaaaaagttgccaaagcaatggcagcagaaggtttagtttgaaaaatgaaactttcttggaaatattgtcagcattttgtttatttgcttgaaaaataataaaaaaaaacgtaaagtattacctgtagagtaaacctataaggaggagaacaaatggcacacattcattttgactattcaaaagtagcaccgtttgtcaacgaacaagagttagggtacatgcaaagccaagtaacagcagcccacaacgaattacgggaaggtactggcgcaggaagcgacttccgcggctggatcgatttaccaacgaactatgacaaagaagaatttgcacgtatcaaagaagcagctaaaaaaatccaatctgattctgaagtattagttgttatcggtatcggtggttcttatttaggcgctcgtgcagcgattgacttcttgaatcacacattcttcaatttattagatagcaacacaagaaaagcaccacaaatcttctttgccggaaattcaatcagctcaacatatattgctgacttgatcgaagtaatcggtgatcgcgacttttcagtaaacgttatttcaaaatctggaacaactactgaaccagcgattgcgttccgtgtattcaaagagcttcttgttaagaaatatggacaagaagaagcaaacaaacgtatctacgctacaacagataaagcaaaaggtgcagttaaagtagaagcagatgcagaaggttgggaaactttcgtgattcctgatgacatcggcggacgtttctctgtattaactgctgttggtttgttaccaatcgctgttagtggtgcagatatcgatgcattgatgcaaggtgccgctgatgcaagcaaagcatactcaagcgacaaactagaagaaaacgaagcttaccaatacgcagcaatgcgtaacattctttaccgtaaaggcaaagtaactgagttgttgatcaactatgaaccaggaatgcaatacttctcagaatggtggaaacaattgtatggtgaatctgaaggaaaagaccaaaaaggcatctatccttcaagtgcaaacttctcaactgatttgcactctttaggacaattcatccaagaaggacgtcgcaatatttttgaaacagttgtgaaggttgaaaaacctcgtaaatcaatcacaattcctgaacaagcagaagatttagacggtctaggctacttgcaaggaaaagaagtggacttcgtaaatacaaaagcatttgaaggaacattgcttgctcatacagacggtgacgtgcctaacttgctagtcaaaattccagaaatggatgcttatacattgggttatacaatgtacttctttgaaattgctgtaggtatttcaggttacttgaatggaatcaacccattcgaccaaccaggtgtagaagcttacaagaaaaacatgttcgcacttctaggcaaaccaggctttgaagaccttgccaaagaattgaacgaacgcctgtaagataaggttttttcgctagatttaaaaaatcagtgatagaaacatgttcgcttctaaataaaattagtgatagttttagtgatagcgaacttaaaaaaaagcactcaatttgagtgcttttttatttgctcttctatatagttttctagttgattcattgatctttttttcacttcgggagaaatatgggcatagacttgtgtagtagaaatatctttatgacctaaaaaatctttgatatcttctaataaggactggaagaacaggaaagtgacttcgaagacccattctatttttttgttttctaaaatcaacaaaaaaagcactcacttcgagtgctttttacgatatattcttagcttaagataggcctaatttttcttttacagatgagggtaccttatcgctggtaattacttttttctctatgatccgcttttcgcttgctttcaactgcaagatcgttccttcggggtaagcagaaccattggcagagtcaccagaagtaatgacatcgaaatctaactgtcttttttcaccgttttcagcataagcatctacgttgtatttaaaacctcttccaattacttccccattatctgctttgatatcagtttctgcaggcattggagctttgactaccgcataataatctttacctacataagtagactgatagtagtcccaacctttccatcctataaaagcaatcaatatgataacgatcaaccctaaaatttttttcatgaaagatctccttttttatttttattatattaaatattatacagataataacggaatattatcatcgaaacagctaacaaaattgtcataaaaaacgagatggttgatattagaacttgtgtttttgtttaggtctagagataaagagagacaatttccaaatatatgtaatgaatacaaaaagacgtttgtcgcggattaccgttacaaacgtcttttattgattttccgagatctcatcagtcgccatttggaatggttcactccttatctagattcgtttaatgctcggactgcttgttcgattgtaataccaaacgcaacgttattttcgttttgtgcatcaatcgccataaaacggttagaagttgtatcaaaagctacgcggtattgcatatttgtttttgtaaacgtcataaaattcatctcctttgtaatgtaatttagttcttgaaagtttcctttaaactttcgaacttataccaagtttagcatcgtacgttttttgatgcaattaaaaagcatttatcattttccttatttattttttcttaaatggtttagctattttcttttaatccgataagtagcccaatcatcaaggttacaaatactattgcttgaatataaatcatatgctcacctctttataaataacttagcaatataaagaaaaaaacgcacgaacaacataggaatataaacaaacgtttttgtcacaacgtctaagatcgtgttaaaaaatagttatctaaaaagcagaaagatactcaaaataaaaaataaaaaaatgaataaaaacgttttcaaatataaggtaatttgttattataaaataaagaaaaacaaaataaaaataaagaaaagagggaatgaaatggtaaaagcagaagtaggaagatcttatatatgcaaaccgatcggagtatctcatgaactaatcggctgtattgaacgtacatatatcaacacggctgtcgtgtatgttgaaagttatgaccaacgagactatcaacttatcaatgaaagcaagtatcgcatgctcgtaaaattctgtgatattagcgcacctgctgaattggtttcttaaacagtatttttgagaattcgcaagaactcccttataatataaataaagacagaagggagcgagaagatatgccaaaaagaaaaagttcagggaaaatgggaattattcttgcagtgatctctgcaattcctgctattttagctattgttcgtgcgatgaaggaatcaagagaaagttaagcacacattatgagcgtcaaacaaaaaacgcatatacctgcggtggcaggttatgcgttttttgttgtataaagacttttttcattaacgatttttgattagccgactcccaaaacaaaatttagcagtttatctgaataagtgatttcttcatctgtttgtttcacactttcatttagtagtcccatctcatcggttatgataccatccacaccataaaacatcatgcgactcatggcatctgaatcgttgattgtccatacatatacttcttttccgtcttggtgggcagaattaatgaagttacggttgatcgtactatattccattgtcagaaaatcagcaggcgtcacagggggcccaacaatattgaaaggtaagatgtagcccacataaaagtttggttctgcttcttttaaatctgaaacggtttggtacgtcaaactttgcaaaatatgatggttctctaagataactttgcggtatttatggacaaatcgttcgacaaggtcatccgaatcttttttagaggtcttgatctcaataagtaatttttggtttagcttatgtgctttttccaaataagaatcaaaagaacaaacaggggcttgcactccgttttcagtaactgtaagatttgtcaattctttcaatgtaagatcctgtggtgttccatttacccctgttaagtgacgaagatttgcatcatgcatcactacgaaatgaccatcttttgtttcctgaacatccatctctacataatcaggatgatagtctctgcttgttttttcaagtgcttctaaagtattttgcgccccattttgggtactcacacctctgtgagagacagtcactggttttgtctgaacagctgaagtcagataatccatattgtaaagacagacgccaataccgaaaaaaactgcaaaaagagtcaaaccagtgtttttcagcgcagagaaacgcaagttgagggcttgtgggataaaccacttagggatctcaggcaagaagccttcgtcatccatgaaatcaacaatgatataaaaaatccctacggtagacatcacgatattgaataataaaatcccttgtaaaagcgtcatagcaaacacagcgctgatcaatgcatagtctgggaaaaattgttcaaccatactttgtgccaaaataacaacgatatatcctaaagaagaaaggagtaaaatcgtaccgccaatcacaataaattggcccgtgatggccaaaagacgcgatttggtcaatgaccagctttcccgaatggctgctcgaaaaggacgatctcgtagaatcatttccggtaaagcaaaaatcagtcgaatcccaatatagccaaggaaaatataaacgagtaaaaaggaactgacgatgatccaacgattagcaaaaataaaatccataatgaaagcggggatttttatttttgacagtagatcagaattaaaacttaatccgctgatcggtagaatcaataaaaaataagcaaggaaaaacaaaaaagtaatgggtctcactttcttcagctgaagtatcgtcaagtgtaagagttgcttcaaagagattggttctttctttttaataaaaaaaacactcatcaaaagaaaagtaaattcgaaataaactaacagtaaaatcgtcatcaaaactacgattaacgagagtagaaccccaggatgttgagaaaaaattgaaggaatattgtcataagacaaatagtcaattgcccctcggtgtaaaataaaacgggtcgtactgctcaataagggtaaacaaataaataaaataaagccatgcatcagcaagacatcacggaaataagcttgtgttccttttaaaaagtcccaagcattacctaagctacgtttcaaataattcatcctatcacctgctcttcacattgtagcgcaaatctaatgaaaaaggaaagggtgcagtgtgttttgcagaccctttcccagatttaacattgtcaatcaatgactaattttacaaaataaatattatccaagaagaccacttagatattgacctccataaatcaaggccatactatataagaaaatcgacagtggtttagcaatcaaaatgattagtgtatatcgtttcactgacatgtttgtcaatccagccatcaaacataacgcatcgtcaggagcaactggaagaaaaatagctagagcaaacagcttctcaaaacggttttgattatccagccagccaatatatttgttatatgtcttatcgctaatcatggaaagtatgaatggctttccataacgacgccctagcagaaaaatgataatcgaaccaatgcagattccaatatagttatagataaatccagcataagggccaaatatcaggacaccagctgcagtactgatccctccaggaatgattggaataactacttgcaggatttggatgaagacaaaaataatcggtcctaaaatgatggaatcacctactaatcctcttaacgcattcaaatctttgaaaacacctaaattaataaaataaatcgtcagcgcgattgataggcctaatccgataatggatatgaaatttatcagttttcgagaggcagcaatattcattattcatcaactccttagaggttctttgttaactatactttactagaaaagcaactaactgcgccattttttgatatgacagaaaacaaacaattttgtaagttcatcataagtataaaagattgatctcaaaaaaacatccaactaaagacttatttaataacttgtttttttttaaaattaattaaaaatgttctgtaataaaataaaactttataacaactataacaaaaacgaatacaaaacagaagttctataagttataatcatagttgttaggtgattcatctagtaaaaacaccagatttcaaatttcacacaatttaaactagatcaatcatcaaccttcttcaaattgttagaaccctttcccgaggagctgcagcataagcaaaaaaacaaacaggaagccaaatggctaagacattttttctattagtctagttgtttctcgtcgcaagtttaagactttagaaagttatttctaatgatgtttgggttgttttgatcaatgcttatgcacagctccttacctattatttatctcaacagatctaacaaattaatggactatttaaggagtttttttatgcttacgatctattcttctcgcacacatagttaccatctgatggcaaactggctgaaagaccatcaaatgccttacagagaacgaattttcacacctaaacagcctttaacaaggaaagagatattttatttattgtcattaacagaaaacggatttgacgatctattagctaaacgctcgattgattataaaaatttgaaagatcaaatcgaccaatgtacgacctcagagcttgtcgatctgatcgtctcgcattttactttgttacaacgtcccatcattactgacggaaagaaattattagtcggattcaatgaagatagcatgcgtctttttatccctgtacaatggcgcagaagtcaactgaaatctgtctataacgattttacatgggtaagcaatctagaaaattctacggatttagatgatgaatttttaaattattatatataaaaaagactgtgacaaaagcgtgtcacagtctttttttctacgccggataaatagaatatttttacaaatctgaatacattcaccagtaataagcactttgagtgaattgacgataagaatgacggaccagactgccataaatgatcaagaagactcccgttcctaccgtaacaaaaaatatagaggcaccgatactaccatccatataccacattaaagaagccaaaagtgggaaaagtgaaaaaatacataatccgattcctgcaatcagtgagaagccaaaacttcgctgatacccttcttctttttcttttgcttctgctaatactttttcaggtattttccgatggtgcaaaaagtgatttaaacgtgtgattttcataccagaagcaataaaaaaaccgacagctaatgctataccgaaaatcagacaagaaatacccatgaacacatatcctgctgaacaaaagaaaaaaatacttgcaaaagataagctaatgaatagaacacctgatgccacttggagacttgccgctctgtattctttccagtagttttctgcttcgcttaaataaatagaagctgtgtttgtttccgtctcgtcagcttgatgttttttttcgacatctagttcttctaataattcatcgattgaaccaaatgtcgaaattactgtaccgatggcctcctgttcattttttccttctcccatcaattcatgataatggtcttccatatttgccaacaaatcagttttcagcttatctatctcggtactttgaggtactccgataaaaagactgtctaaataattacggattgtatccatttaatttccctccaaaaattgatcgactacgtctttcgtcgtcagccactcttgctttttttcttctaaaagattacgccctatttcagtgattttataatatgtccgcttttttccatgagtcacttctccaggatacgaaacaatcagttgattcttttctaaacgggcaaaaacggagtaaagtgttgtctctttgatcacataggaatcatttgtcctctcacgaatcgttttagaaatttcatatccataagaatcgtttttgttaaggatcgataaaataatcgcatcattgtatccgcgtattccatcacttgaaatcattttctttcctccatattactccatctgtcgttgtaattagaatagcatgattacttcatcaggtaaagtaattttttacaaaaaaataaaaggaacagaaagcaaaagaagcgttatgcttttttgctttctgttcccttaatttatttattttacaaccatgacgttacatgatgcgtggttgactacataggaagtagtggaacctactagtgcacgttctaccgcattcagacctgtcgcccccatgacaatcagatcgattggttctttcgattcatggaaattagcaatcagtgtctttggataaccgtaaagaacatatgtctcgatatctgtcaggcctttttcaattgccaagtttcgatgttctttcatctggttttccgcaacctcatccaattcttcctgaaggcttgttgtaacaaatgcaaaatcaccaaagtaattgcctgttacttcattgacatacaggatgtgcaacgttgcctgatttcgtttggcaatcgtgattgcctcaagaaatgctttttctgccttttcagaaccatcaattgctactaaaatattacgataagtatctaccattgtaaacgcctccttcactgttagtgtagcacgattacagtgttagaacaaacattttgtgaacgttttatcaaaaaatatcaggcatcaaatccgtttttttcagagaccgttttaaaccagcgacctgattttttgatcgtccgtttaccgtcttgtgccaaatcaacagcgataaagccatagcgattcttataagcatttgtccaagaccagttgtccatacatgtccacatgtggtaacccacacaattggttccttcttggattgcttgatggacgtatttcaaatgatccgtaacaaactcgatccggtaatcatcttcaataattccttcgctgttaacaaatcgttcttctccttcgacccccatcccattttcagaaatatagcatttgatattaccatagttttctcttgtattcgttaaaatatcatagattcctttttcgtaaatttcccatccacgatatggattcatttttttattgggcatgtcgtaattatcaaaataatcatctggcatgggactatgttcgtgattgattggagtttcttttgctttgattcgacgaggctgatagtaattgattcctagcaggtcaatcgtgttttcacggatgagttctaggtctccttcatggatctctggcattatagccaattctttgacaatttcgatcaactcttgtggaaactctcctttcactgcagggtcaaggaatgatcggttgaagaatgcgtcagcgatcttcgccgcttttacatcttctgggttcgtttcatctctcggatagcttggtgtcagattcaagatgattccgatctcaccatcatgtccgccttcatggtaggctttgattgcctttgcgcttgctagattctcatgatagcctacttggaccgcttctttcatattgatatgatttggatagtggaattgatacaagtagcctccttctacaggtacgattggttcattatgagtaaaccattttttgaccagatctccaaacagttcaaagcacgctgctgcataagaaacataagcgtcgaccgtttctcttgataaccacccgcctttttcttgcagtggtagtggcatatcgaaatggtaaaggttcacaaaaggttcgataccattatccagcaattcagtaaaataatctcgataaaaagaaacagctttttgattgatttcacctgccccttctggaatcaaacgactccattggatagatgtacgaaatgtgttatggccagtttctttcattaactgaacatcttctttgtattttgtgtaaacttgcgaagttttttcaggtcctacttgatcgaagaatttttcaggctctaattcataccaatgatcccaaatattttctcctttaccatcatcacttactcttccttctgtttgcggtccgctagcagcagaaccccaccaaaaattttctgggaatgtgtaggttttcatttttttacttcctctcttttttcttgataccgtaatcataacgaaccctaaaaaataaatcaatactttttataaaaatgactagacatttaaaatttttggcgttatactttgtatgtaatcgattgcaaataaatttgaggtgaataaaaatgaacggttttatggacaagctttctgagaaaatcatgcccttagctaatttattagggcaaaatcgttaccttacagtgctgcgggatgctttcatgctttccttccctttaacgatgttcggttcgatcgttgtcgttatcaataacttgccttttttcagtgacgcaacaaagggaactttatcgaacttattcggtaatgggcaaaatgcaacaatgagcatcatgtcggtttttgttacttttggtatcggctattatttatcaaaatcttatgacgttgaaggtattttcggtggtgccgtgtcttttgccagcttcttgattcttacgccttttgcaatgaaaaccgctggcggtgaagatgtgactggtgtgctttcacttgatcgtcttggcgcaaaaggaatgttcattggaatgatcgctgctttcttggctggagaaatctactgcagaatcacgaaacgcggctggcagatcaaaatgcctgatggagttccgcctgcagtaacaaaatcatttgccgctttgatccctgctgtagtgacactaactattttcttagtaatcaatgctgtgatgactggtattttcaatgctaacttacatgacgtcgtttatgaagtgatccaaaaaccattaactggtttgggaagtagtttacctgcaacattgattgctttgttctttgtccaattcttatggttcttcggacttcacggacaaatcatcgtcaactctgtaatggacccgatttggaatacactgatgcttgataacttagaagcttatcaacatggaaaagaattaccacacatcatcacaaaaccattcatggaaaccttcactgttggtattggtggctctggaatgactttagctgtcgttttattgatggcctttgttcttaaaaagaaacagtatcgtgatgttggacgattagctttagcacctggtattttcaatgtaaatgaaccagcgatcttcggtctaccgatcgtattgaatgcaacaatccttattccttgggttgtggcacctctaatcgtaacgacgttcaattatttggtaatggctgctggacttgtccctgcaccaactggcgtctctgttccatggactgtgccaatcattgcaagcggtgtcttagcaacaaattcatggcttggtggtatgctgcaagtcatcgactttgtcatcgttgcctttatctggtacccattcctgaaagtactagataaacaaccagatttagatattgcttaatagatcattaaggggttgtgacaaaaacttgtcatgacctcttttttcgaataaacaatgttccagatgctacttcgagttgtcggaagcataatctttcgttatactctagaagaggtgaataacgtgccaaaatacgaagaaatcgcaaatattttaagagaacgtatccgttcaaaagagtatcctcccgatagttttttgcctaatcaagtcgacttggtaaaagaatttggtgcgagccggatgacaatcaaaaaagccatcaatatcttagcaatggaaggacttgtctattcgcagcgaggatcaggaacgaaaatcttgaatcatccatttatgcaaaaagacacatcgcccgctaacgagtatgaaggtttgagtctccaaatgaaacgcagacatcgttctttgaagagtcaaatcattcattttgatgttgaattccctaatcaatatatccaagaacgattgatgatcgatgccgagcaacctgtctacaatattcaccggttaaggatcttagatggcgagccatatgttttagagcatacctttatgccagtccatcttgtgccgggtttaaaaaaagaacatttgttagcctctatctatgatcatcttcatcaagaattgaatgtccattttgcaggggcttatcgtgctatttctgcagataaaagtgatgaatatgatcagcaatatttgaactgtgcagaaaacgatcctgtactggaagttcagcaagtcgtctatctcaaagatggacagccgattgaatattcttccagccgaaaccgatttgatgttcggaactattctgtgctggatgtgcgttcaacttaaatgaagaggttgtgaaaaagccgtttaccaagagatcgtgacagtggtaagcagtttcaagtaacaagaagagatcgtgaaatcaacattctatcctatcctaagcattagctcaaaaatgaaaaaataactcagcataaaaagacttatgaccacccgtaatgattctaaagttagctttttaaagctagtttttttgaaatcgatacagctagtcgtaagtctttttattttattgatccgtccctcctcttttccattcttgattccttcctgatactttagaagacaaattaattgcaaaatagagatgcaccctctatactatgtctaaatcagctacttactttttgtaagttaacaggaggaaatttatcatggatacacaaatcagaggaattcaccacgtcacagcaatgacatctagcgctacaaaaatctaccgcttttttacagatattttaggaatgcgcttaatcaaaaaaacagttaaccaagatgacatcgaaacttaccatctttactttacagacgatactggtgcgccaggaacagatatgactttctttgattttccaaatcagccaaaaggaaaaaaaggaacagatacgatctctcgtgcttctttccgtgtgccaagtgacgctgcattagacttttggttggaacgttttgaaaaatatgacgttactcattcagcaatcaatgaacgtttcggcaaaaaatatatcgaatttgaagatttcgataatcagtattatcaattgatctctgacgaaaacaatcaaggtgtagcagctggcattccttggaaaaacagcaatgtaccgacagagtttgcgatcacaggacttggacctgtctttgtccgtgtcagtcaattagagcatatccgcttgattcttgaaaaaatcttaggattcaaagaaacagaccattcaggagatttctacttatttgaaatcagtgaagggggaaatggtgcaagcatcattattgaacatcggacagacttgccaaaagcaatcgaaggatttggaaatatccatcacttagcattgcgtgtagcagacaaagaagcattggaatactggattcaagtaatcaataagattgaattgccaaattctggtttcgtcgatcgtttctatttccaatctgagtacttcctagccgctcatcacgtactgtttgaattagcaactgatggtcctggattccttgaagatgaaccagcagaatcagcaggagaaaaactatctcttcctccattcttagaagaacgtcgtgaagccattgaagcctatgtccgtcctttcgatacaagtgatgcaaataaaaaacgtgaataatctcttcatgctacttcattttttgcatctatagaaacagaaaagagggaacaaaatgacctacatttttgaaaaaggaacaagtggcaagcatttgatcttacttcatggcacaggtggcgatgaacattctttactggatatcgctcactttcttgcaccaaacagtacattgctttcttttcgtggcacggtccaagaagatgggatgaatcgttttttcaagcgtaatggattgaatcaattcgacctggacagtttggaaaaagaaacagataaactccatgaaaaaatcaaagaaatcagcgaaaaagaactgataccgttaagtgattggctgcttgtcggctattcaaatggcgcaaacatcgctgctcatttattattggagcgtgagaccgagctaaataaagggttgtttttccatccgatgtctttaggtgttcatcaaagccgttccacattagaggataaaaccgtctggctttcttatggtgataacgatccaatcgtttccccttcttcctttaaagaattggccgatcaattcgaaacacgccaagcaaatgtgactattcagctaactgtaacaggtcatcagttgacgatggacgaaatcgagcaagcgagggaatggacagaccacctcttaactaaataaaagaaaagaactacgacttacataatacaacctgaagcagatatcgatctggatcagattttgtgaaagtcgtagttttttgtgtcagataggttagtctccaccagctgcaataacagatttattataaatagccgttttatgtttcaactcttccaatcccccgattttctcaccttttgaataaaaaccgtcagtaatccctaatgcttgaaaaatcgtctgcttgtaggcaatttctgcattccattcaactgtatcaaggatttgcagtgctttatggatagcttcgattcctgattctccagctgtgttgatcaatacgccatgagagttgagcagcaacatatgcggtaattcaagatgctgtttttttacatagtcgcttgtcaattctgcaagttcttcagagcaattaggctcaaagtccatgacaggaatctcttttactttagctgtggcttctgtcaaattaggcataggcaacccagtagtcgcccagaacattgcattaggcgcatgagcatggaggacagctttgatagctggattagtctcgtacatcgcttcatgcatattgatctcccgagttaaatgaccgactccgtcaacgattctacgcgttcttggttctactactagaacctgtgcaggagaaatctctcctagataggcttctgacatcatggtcggcgtcatgatgatgtagtctttcccttgatcatcagtggttttaaaggaaaaattccctcctgcgacatttgtgtttttcctttcgaaaatcactcttacgatacgtgccatgtcctgtcgttctctctcaaataacatacgtccatctgacataatgacccctccattatctttttataaaacttttttctctcaatatttctttggtagcttcttttatttttattgattcttctattttccgttttcttttttcatcgtactctctgaataaaacgtgatttccatatttatagatcactagtgcgaaaaaaatgaccaatagattgatgatgatattctgagtaaagagtccatatagaaatagcagaagtgtaccacaaagagcgactgtccattttattttatctgtctcttctcttttcattactttcccaccatttcaatgctatttttgtagttcagcataacgttcactcggtactttcgcttttatcatatatttataaagtagaacaaacagtcctagaaaaatcacgcatcctacaatagcgagaatattcctattaaatgcctccgcaaataaaaccctgaactccggcccttctatggatgaccatgtgatcaactgtcctttcttgattccctcgactgctccgcttttttctgctaaatcactgagtattggcgcaaggtaagtggccccgtacaaataaataggcatagtgatgattcccaagatcagcatacgagccaagtttcctcctgttaaaagtaatccgccgaccgcaatcgaatagttgataatccctgctaatggcaatacttggtttcctggcaaaataatggcataaccaataaacacaggaacaagtaaaatagcagtaacccaaatttctgaacgaccagctaatatcggccagtccaatccgatatatacttcacgatccttaaaccgctttttcataaattctgacatagcgtctgctagaggagacaaagattgcatgaacattttagagatcataggaaacaaacttaatgctgtagctgtttggatcgctagattaagagaacctgaaacgccatacgcagcagcaaagccaagccccaatccaataatgaatcccattacagagttttcagagaagatcccaattttcttcttcaatgcattcgtatccgctcgtttatttaaagcaggaattttatccatgatcatattgaaaggcagcaacaagacagcggcagatgtcataaaatgagtcactgttactaatggaatccctgtgagatcttgtatatgtttttgaaacatatcaccaagctttaattccaatataacttggaccattgcagtaagaaagcctgcagccaaactaccggaaacataataaactaaataagcagttaaagctttcccccaaacattccacatatcaacatttaacgtcttcgtccaattaaaaagtaacagtacaaaattgaccccaatcgttactgcaaaaaatataaaagcataactccacgaccatgtgatgcttgctgcacctgtccacccaagatcaagtgcaggcaaactgattcccgtatttttagccaatgcttctgatgctggacttactgcgttagacatatagccaatgaccatagacattccgctaaaagcaatccctaaagtcaaagcagacatgaatgctttttttaatttcatccctgccaacaatccaagtatcaaaataatcaggggaacaaaaatggctgatcctaagttcaaaacataattgataatggtttggaaaacttccataaataaaccttctttctttcgaaatatagtaaataaaactatgaaccaacttttttatccaacaatcctcctttactgtactaactctttgatactgtcataaataggttctacacccattccagttaaaaatggaattcctggaaatacttcaatacccaaatcttttgcttgttcaagtacttcctcatcaggttgtgcgacatacacatagattccagcagttagaagctcattttgaatcgatttgtaatcaactgcttctacaggaaatgcgatgccgtcatcctctaacatactttggatcttactagcgattgtctgactcgttgctactccacttccacatgcgacaattaaccgatttttcattttttcttcctcctaaatataatttgtaataagttcgtatatgttttgcggtgtttcttgtttcttataattttccacgaatgtttcatccatgaataaattcataaacgcttgaagtaatcctacttgttcttttggttctttgattcctaaaaaaaatagattttctacagtcatttcctgactatcccccatttgataaaaataaattgggttcttcagctgcataacaaaaacaaatggcttttcgacatattcacattccgaatgtggcagcgcgatatttaaatacttagtaatcaatccagtaggaaattctctttctcttgtaatcagtccattcaaataattctcattgacgtaccccattttttctaatcgttgtgcagcgattaaaaaagcttcttctttattttttacttctaccgctaattgaatcaaactaggaacgaacatctctttatatttcattccaaccccctcctttttgattaagtttgttaatttattgttctactaagttcatctttgttttacaagaacattatatttctgttagtttgttttgtcaacgctttcaaaagaaatttattttgttaaatttgatctacttgaaaataaaatcgtttatctatataattaagaagaacaaagtcgaacaaaaattgacttttatgttaaaggagtaattcatatgctgaaaaaagaaagacaagaacgaatcattacgttattagagaaagatttttatttaactaattcagaaatcgctaacaaattaggcgtatcagaaatgaccatacgccgagatgtcactgaattagcaaaaaaaaataaagtaaaaaagctatatggtggcgttgaacgaaagcaaccttataatcgagaactatcgactcaagaaaagattgatacgaatgtagccgaaaaaaaatatattggtcaagtcatgaacagtatgattcccgataattctactatttatgtcggtgctggaacaacgatcctatatgcactccctttcattcaaaagaaaaatctatttgtaattacaaacagtttgattgctttcaactatttaaagaatcatacaagttatcggattttacttactggtggcgaattttctcctattacagaagagttcattggggaagttgcagaaagatcttttgaaagtttgaatgtcgatatctctttcgctgcaacaaacggcatatttgataacaatgtgacaaccgctcaatttattgagggaaatattcagaacgcagcgctcaatgcagcaaaaatcaaatgcattgttgcagattattcaaaattaaataaatcagacgtctatacttttagaaaattaaccgattttgattatctaataaccgataatcatttatcagaacaggatttcaatcattattcaaaatacttaacaatattaaaggagcccaaaaatgatactgacaatcacgatgaacccatccattgattccatttattttacaaaacactttgaattaggtacgatgacacgctttgattctccggtacgctatgtaggcggcaagggaatcaattgcggacgagcttctgctctactaggttcatcagttattttaacggggtttttgggcggttattttggcagtatgattcaagatatgctgaaaaatgaaaatttgtttgatttgcattttttacctattgcagaagaatcaagaggtgccgtcacgatcatgcatgatgatgaaacgcagacagagctagtggaagctggtcctgaaatagcagatactactatcaaaaaattaatgaatgatatcaaacaaatcagtaaaaataattacctttcagtcattacaataaatggttctgttaacaatccagatccctttttgtatgctaaattattacaatatatcaaagaacaaatagatccttccacctatatattaatggatatatctggacaacatctccgtgaagtcttagcaagtaagtataaaccgatgttcatcaaacctaatatccatgagttttcagatatcatccatcaaaaaattactcaaaaaagcgacataaaacaccatctaaaaacaaatccactatttaaagatatcgatgttatcatgatttcttgcggctcgtatggtgcagtagtcaaagtaaaagaagaattttggaatgttgagatccctaagattcctatcattaatacaacaggctctggggatgccactgttggaggttttgctcattcattagaacagaattatcctttaaaagaatgtgtaaggtacgcaatggcttgcggcatgtcgaatgcacagcaatcagaagtcgggaaagttatcccagctgatgtaaaaaatttagcaaaaaatattaaaatcacagaaatgaaataaatagtacaaagtaaataattgtttatatgaaatgagacacaaagagactgtgacaaaaaacgtgtgtaccgacccccaaaagttagattttttggtctaacttttgggagtcgatacattgtcacagtccttttttcgaataaacggtgttctcctgccaactcctcggtcacaagttacaatattcaacaaacatgagaagctgttttttgaaattgctccttgtgactcagagttaaacggcaggatcacgacctcttggtataaacggtgttcaaaagccagtttctcggtattaagccaaatttatgcaaaaatgtggaaagccattttcacaaaatttttcttaatactcgaaactaagcggctttttcacaacctcttctttaaacggtgttcaaaagcttgcatctgcgctaatgagtccaaccaagtcaaaaatgaggagcttttttggctgtccttattacttgatgcagggcagttttttcataatctcttttagattaaatccttttggttacacaaggttctcttcaaagaatgttgccattttttcaaatggaatgatgtctgtctggtcgtatagatctgtatgggatgctcctggaatgatcatgagttccttgttgtcaccttttagttctttgaaagcgtcctccccaaagtaacgtgaatgagctttttccccgtgaatgactaagactgcatgacggatttctggaatataatgcaatagttttgcattcataagtgacaaccctgatgtcctattccaaccatcattggagtttaaagaacggacatgatatccgcggtctgttttataatacgcatgatagtctttgacaaattgaggagcatcttcaggcaacggatcaaccacacctccagcacgtgcgtagtccccttgtttgaaatcaatgattcgttgtgcatttaattcttcacgcatttcatatcgggcattttcatccataacatcgaagtagccatttgctgttactcgagtcatgtcatacattgtggaaacaactgttgctttgacccgcgtatcgatagctgctgcattcaatgccatacctccccatccacaaataccaatgattccgattctctcagggtttacatttttttgtacagataaaaagtctactgccgcttggaaatcttccgtattgatatcaggcgaagcaacatatcgaggtactcctccgctttctcctgtaaacgatggatcaaacgcaatcgttaaaaatcctctttcagccatcgtctgcgcatatagaccagacgattgttccttcactgcaccaaatggcccgctcacagcgattgccggcaatttcttttcacttacttcttttggttcatataaatcagcgactaatgtgataccaaaacgattcgggaagctcacctttcgatgattgacttgattgctttttggaaatactttgtcccattcttgtgtgatgtttaattctttattcatattctagactctcctttgatcaaaattgacatttgcttttgaatgtattattataataaaacttaaacttgactttaggtcaaggtaaaaattttattttaggaggatttttttatgtattccattggacaagtgtctgaaatgtttggattgcctgtttctactttacgttattacgacaaagagggattatttcctgatatccagcgtgtttctggtattagaaaattttcagagaatgagttagaggctttaagagtcattgactgtttgaaaaaatctggtttagaaataaaagacattaagcaattcatggaatggagcaaagaaggcagtaagacatttgaggttcgtaaagaactatttgaaaaacaaaaagaagtagtagaaaaagaaatagcaaaattagaaagagtactcgctatgctaaactacaaaagctggtactatgaagaagcaataaaagccggcaatgaagaagccgtattgacaatgattcctgatgatttaccccaacatgtaaaagaagcttatgtacattctcattgaacaaacggataactcactctccttctctatgaacttcatgaaaacatgaataaacacctctaactgattgttagaagtgtttattttttcactcaagtatcctgcacttacaaaaatatcctttttaccgccatcctaattctggagcgatatcttttacgattgtttcaagcaagtgaatgttatattctacccccaaagtattaggaatcgtgacaagtactgtgtctgcttctttgattgcttcatcttcagctagctccttgattaattgatcaggttcaccagcaaaagtttttccaaaaatcgttggatttcggtgataagcaagatagccgacagcatcttgttgcggactaccgtcttgtccaaataagcgtcgatccaaatcagtggtgattggctgaatcgagcgagtaactaatgttcttggttcaaaatcatgacctgcttgcttccacgcttctttatacgcacgtaactggtttgcttgttggatatggaacggctcatgggattcgtaattgactaatgtagatgattgcagattcattccatgttgtgctgcccagattgccgtttgctgcgaaccagctccccaccagattctttgtcgtaatccttctgaataaggttctatccgtaattttcctgatccttgtgggaacattggttgaggatttggttctgcaaatggttttccttcaagtaattccaagaattcaaggctgcgttcccgtgttacctctttgatttcttcttcactgtaatcataaccaaagtatttccagccatctagaacttgttcaggtgaaccacgccccactcctagttgcactcttccttgcgtgatgatatctgtcaatccggcattttctgccatataataagggttttcatatcgcatatcaataagtcctgtaccgatttcaatcttacttgtctttgcgccgattgccgctagcaaaggaaacggcgacccaatctgaggggcaaaatgatgtacgcggaaaaacgctccgtccactccgattttttctgcttccaccgctaaatcaatcgattgcaaataagcatcttgagctgatttcacaagcgatccttgctccatccaatgtccaaagcttaaaaagccgatttttttcaaggtaatgacctcctgtaaacctacaaaaatggaaggttttttatttttaatatgaactgattctactactttttttcttaaaagacgaataattgttctcgcctcacaatcaagaaatgtatcggcttactacacccctactttcttcatcatctgccgtgtcttaatctcttttaacagtctgttacatcgttgatttttgactcaaaatgattgtttctaacatgtatttatggtaaaaaagacaagatgagttctttgtacacatcgatttatacgctgaacaaaaagaaatatataaactaagaaacccattgtttttttcgctccatcacatagagtttactttagataaacagtgacatttactaatccataacggaggaaatcaaatgaaaaaaatctatttcttatgtacgggcaattcatgtcgcagtcaaatagcagaaggctacgcgcgtaaatacttgtctccttcaatgtttgagatcagaagtgcggggatcgagacacatggcttgaatccaagagctgtaaaaatcatggcagaagacggcatcgatatttccaaacagacgtctgatttgattgatagagattaatttactcaggcagacttgatcattacactttgtggtgatgccaaagacaagtgccctgccgttccaaacaatcacgaacaccttcactgggacctaaaagatcctgcacaagctgtcgggagcgaagaagaaatattagcggaattcagaaaagtcagagaaggaatcaaaagaaaagttttagacttaaatcaacgtacatcgatcgtataaagaagtattcaaaatgatttttcaagcactaagaaacaatgttaaaaaaatagctttccatattttacaaaattgtgccttattgccgacaaattgtctcttgaacaccgtttaccagtagtcaagacatcgtaagcaactataaaaaattataagaaactcaaaataaaaggatgtgccacaactttggccacatcctctttttttgtatttagttttctacttccaaataaatagatagaattattataaatataaaggcagttttttaatcgctacttattcataactagataacaacgttaagatttctagcggatgattggattgcatcaactgagccatttgttctggctgcttttctaaatagtgaataacagaaaatatttttttgaactctgcatgtttcaaatcatttttctttattgctaatagcagtacgatacgtatctgttccccgtgccataggactggttctttcattgtagcaatagaaatcatcgaatgcttcacatacagcggattaccgtgagggattgttacaaatggtgctactctagtactggagtgactgtctctttccaagacagaatcgatgaattccggctccacataatgatgttccactaagacgtttcccataaagtttaaaatatcggctgggtctgtccgttcaagttgaggaaagatcagaaatggatgagtaaagcttgctagatcaaatgtttttttcttcttgataggcacatgctccagcatatattttgtcaaataggctagatcagtttctgtgatcattggtgagatctcgattactggaatgcttatatgtttaaatggtaacgtagccaagataaaatcaacagagggaaaatcttgcctctttaattctggcttatattcaactagatccataatcgttaattctggaagttctctgttcagccgtgcttcgagaaaagtagccatagcttttgaatattcactaactaaaaccgtttgatatcttctacttttctgatgtttgtgtcgctcgatcgctgcttggaaatggatcgttaaataagctgtctcctcttgtggaacataaaaattttccttttcaaaataatcttctaaaattaactgtaaaactaagaaaagttgtgtgtacgtactaaacacatttttcgtcaatggattagaaatctgcaaaccataatggagtcgaaaataagttgaagataaatgagaccttaaattttgttttagtagctgatcttcttttaatgaatagcctagaaactgttccacttgttcgatcaaatgatcagcaagtgcgctagattccttttgaaaacgtgtggctgcttgtgaatttgtaaaaagattggcgatacgcaaagccagataattgatttcatcaggagaaaattcaattggatagatggtggctagtcttgctaatatttgactacttaacttttgtgcttgggtgtgttccacgacttcgttttcgtctttacttaatttcactttctggtactgtttcattcgctcgagcataaagtagatgtgaatctccacactagccagtccattcggctgttctaaatggttttcataaaaaacatcttgtaatgtatgttggataacttttaatgtatctttagcgaagaattctttcaacgacggactttgcggatcttctttctgcatatttcgtaatgtcttaacaagcaactgtcttttttcttgttcatcgcctttaagaaaagttcctagttttgttttggatactagctgtaaatggtgatactcaaaaaagctttgcaactctgtcaattctttacgaatcgtacgttttccaacatatagtttttctgaaagttcttcaagactaaatccgtcttttgctactagtagatggaaaatcaataactgacgaagctgttttttatccatttctgtttgagtctcttcattaagcgctcgtttcagttgttccctttcgtgaggcagaccattcaacaagatacctgtacctttttttctttcaaacattaaaggcagatgtttgtctctcaaccaagtttcaatggtattcaaatcgctatgaatcgttctttctgacacatggaaatgctctgctagcttttttgttgttatataattattgttctcacttaattgatagatcaaagattgctgacgctgattcataatgtgcagaaactcccttctaaataaaaaatcgatcatgataacacatctattatgtctcatcacggtcgatttttcatcttatgttacatttcgcttaataattggtgaactgctgttttatctggcgcttccatcaatgcttgacggaagtcatcatccatcaatttacgtgatagacgttgcagtattttcaagtgcatatcaccttggctgttttcaggtacagcaatcataaagatcatatgtgcaggttttccatctaaagaatgccaatctaccccagattgacttctggcaaatgccactgttggtttaagaacataagctgattttccatgtggaatagcaatccccataccgattcccgttgtactttcatgttctctatcatagatgacttctttaaatctggttttatctgtgatcgccgctgttttttctaaacgttggactaaatcttcgattactccgtcttttgttgttgctgtttcacctaaaacgattgcttcatctgacataatatccgtgatagaatcaaaagtttcagttttcgtataaacatcacttgtttcagtctctgatatatctgctactgtcacaccatttgctgcagcaaccgcagtttgttgtaatgtcggtttaaggattcttaacattagcacggttacagcaataccagcaatcactgctacaaaaaacatggctacgtgatccactgctcctaaaaccgctacgatcggaccgccatgagctacatgatctgtcactcctgaaagcatcgcgatcacacttcctgtcattgccccgactacaatgcttggaatcacccgtagtggatctgttgaagcaaacggaatagcgccttctgtaatcccaaacagtcccattgctaaggacgccttaccagcttctcgttctgttttcgtaaatttggtttttaaaatcaatgatgccagccccaatgctaatggagggatacagatagctacagcaattggccccataatggaataattgccttctgcaatcaagccagatccgaacaaaaaggctactttattgaacggcccccccatatcaaaagcaatcatcgctcctaagatcatagctagaacaatttcacttcctccttgcatccctgctaaaaagtgagtcaatgaactaaatagaagagctactggttctccaataacatagataaacacaaaaccaactgccaatgatcctaaaattgggataacaataattggcatgatcgattgtaaagctttcggtactcgcactttcttgattcctaaagcaatgaatcctgctaaaaatccagtgatgatcccgcctaagaatcccgcattcgcatcactaccatataatgctccgtttgccgctaacatcccaccaacaaatccaggaacaagtcctggacgatctgcaatactttgcgcaataaatgcagatagaattggaaccatcaaccccatagcgatacttccgatactattcatcgttgcccaaatcgttccttctggtatcttgatcccttcaggtgtagctgttcctcctaatgttaaagaaatcgcgatcaataaccctcctgtaactacgaaaggtaccatgtacgaaacgccattcatcaaactcttatagatttttttacctaaattttctgattcacttttattttcggaagaaataattgcctccgtacttttatagactggcgcttttcctgctaaaatatctctcaccaactcatctgcatggtggattccttcttgcacacctacggttatcaaaggtttaccgccgaatcgtgatttatctattttagtatctgctgcgattattacaccagctgcttcttcgatatctcttgcagtcaattcattttcaataccgatggaaccatgtgtttcgacttttacctcggcgccaactgctttccccgctttctctaagttttctgctgccatgtatgtatgggcaataccaactggacaggatgtgattgcaataatttttttcattttcctaccgcctttctacatttatagtatataaaaacggtttctttttattaagcacaaaatgattccgtaataactgaaattcttggaataaatagaaatttcgctaaaaaaattgatatacgatttattatgttgaataaaataatattggaaaatcttacatttctgtacttctgcttacgtacatctaaattattatctacattaacaatttccgtaattaattataaaaagcttattccatttaatttcattctggaataagcttcttattttctaatgagttagtgaataattttttttaccatgcttaatagtatctttacgtctcctatacgcgtatctcctgtttctttatctataattgaactataaacatgaggaatcactttttttacacctgcatcgattgcaattttcagaatttcttcaaagtttgaaagatcaattcctcctgttggctctaaatagaattcatattttgcgcaagcttccgcaactgctttaaattcttccctatgtgctaagcctttcatcgggaaatacttgattgaagtacctcccatgtcttgcagcatttgaatggcagtttcaataggcacttcagctgctggcgcttgtgaacttaacggacctgtagcaatattgacatagccgatcttacctgttggtgaaaccaatccattgatgactgtatcattttggcccaataaagcacgagaagtccccacgccagtaaatacttgattgacatgttgtggttgtaaaaccccagataaacgcgaaaccatctgactttggtttggatctccagcgcctaatccaactgacaacgcattattggttgcgtcttggtaccttttcatatcttcgattgctgcttcatcgctagcataatttttcgatagcacacctagtacgacatgcccttccgctgcttcatagcatgcttttgcattttcaactgaatgagctaatacatttaaacatacacgatttttataataatttgggataactgacaatttaaaagcctcctacatgatttctctcaatctttttataattttttccatttcgttttggctgacggaacgaatgtcgaactcaatgattccgttatttgcttgatattctcgggtgtagactgctggatttcgtgcttttaattcctgaatgacttctttcgcacttttatcgccattaatcgttacacttgctcgataaatatctctgccggcaccatcttgaactattttcgctgaaaggtcaggaagttgattgattgcgttaacaaaaggcgctaatcgttgcttcatggagtcaccggattcgctcccattttttaaataatcttctagtgcctgggtaaagcctaaaatattatctttaccgattttcattgctcggccaatacctttagactgtagccgaatccattgaatatacttcttttttcctatgaccagtccggcactcggaccttcgattgcttttgccccagagtaaattactaagtcaacgcccatttcgctatatttgaataaatcttcttccgcagctgcatcaacgatcaatggcaaacgatgagctttggcaacttctaccatttctgccaccgtcagcatacttttctgaactgcatgatgacttttaatatatagaagcgcagcagttttttccgtaatcatcatggaaacatgttccggtgtacacatatttgcatagccagcttctatgacttttcctccaccttgagcaaccattacttcaaccggtgtcccataatctacattatgtcccttaggtatgatgatttcccgtctagcgattttttctgtatagggatgatagacatggtacatgtcgccctgtccgattaaagcagcaacagattgagcaatccctgctgaagcagaagaaacgatttgcgcatcttccactttcagtaattgagaaagataagcgccggttttgatggcaagatcactcatctcaaaaaaatgctcgcctccaaatcgttgtgctgctaggacactttcagataccttagaaacccctaggatcgtcatttttcccgatgcattaatgacttcttttaaatcaaactttccatagctaattgtcatatatgacgcctccaataattgttttaatcggtaaaatttgttctttagctatacgtgtaaatccgttggaatctttcaattccttttcattttcaacaatctcaaatatcgtcaaatctgcatcataattgacagctaactggcccttattcttcaaatgaaaattccgtgcaggaactgctgtaactttttcaatgatttcttcccaagaatagccgactaccctcaatttttctaaagtagttgctagatcaaaaactgggccatttgtacgattgcggatgtagatatccgtactaatagaggtagctttcattcctgcttttagtgcggtttctgccacatggaaattaaagctatccgtcccatgtccaatatcaaagacgacaccattattgtaagcatcccagacaaagtttttaatttgatctgtctttggatctaaaataccgtttggttttccattaaaacaatgggtcaatacatcgcctctttccattcttgacaatacttcttctaactcaggaggtgcagaaccgatatgaaccatcaatggcagatcattgttttctgtctggatttttttagctaattctaatggcttaatgccattttcaccaacaactgtcttactcattctcgctttaatcccgacaataaattccggcagttctgctaacgcagtacttactagatcttcttgaatctttgttagatcagcaagttcatcttgtttgacaatgccccatttagagatattcattagcgcatacacatttgtcttgaccgatttcgtcaattgataaaattcacggatgttttctgctcccgtagttccagcatcaatgaccgtcgtcacacctttttcgacccctatctgatcaggatagtcataataaagattcatcttttcatagcagtggacatgatcatcgatccacccagcggataaataatactttccctccaagtcaactacttcttgcgccggctgatttatttctgctgcaactgctttaatcatgcctttttctatagcgacctctattttagatccatcaactaaccttccatttttaatcaaagtatcaaacatttaatgaccctctttctattaatttactgccgggaagattgctcctaaaatcattgctcctaaaatagcacctccagcaattggttttttccaagcatagaatcctagtgctcctaatgtagcgccaatgccgattggaatagatgctgcacacgcgcttaatataattaatggacccaaaaaacgtccagatgaatttcctgcccccatcatgacgtcagcaccaaaagtggaatttgattgattgatcgtaaatttacgaatcaagacaatgatgccaccaacaatcaaacctagaaccaaaccagtcaataaagagagtgcaaaattatcgattggtgccgctattttcatacttaagagaattgctggtaccccaattccgatcccagttaggatcgaaccgcctaagtccaagatcccaactaaagagccttctaaaattctggcaaataagaaactagcaccaaacgctgccgctgcgccataggatccgccatccagcccggcttttaacatcgccacgatcgaaacttcattgaatgcacccacaccatacatcacatacatgtgtgttcctgcaaatacagcagcggacataattcctacgattagcggaaaagaccagtctgcaaaccaaaagctcttttgccgctttgcttctaatacttttgcttgttcttctgttgtctccatgattctcctcctatttcacactaaagatgttgtgcaagttatcaagccaattaggcacttgaagctggaagctcttgatcatttccatatcaaatccacggaaaaatccactgaaaataaataataaaacaatagcgatcatcatgctcttcgtgacgcgattccaaccgctctcatcgacgcctttaccaatcaagattcctagaacaacaccaggtaccgcatttcccataatcaattgcgcgataccaccaaaaagagtgccccaaaaaccagttcgtttccctgcgtctaaagctgccaaccaaaaaataactggcattactgtattgatcagaatcgtcgctgctggtaccaaaacggaaaccgccgtcacttgtaacgcctctggaattgctgcagctgttgtgtttaagaaggctaccaccactgccccgataaccgctccaatgatccccatttttttcggatcatgcatggtctgggtgacatctttgttttttgctagaagtgctgccgctgcccaattgggaatgattcgatgcgtcacatcttgtgtgaatgcaccagcaccaactgaagaagcccatgcattaaagaaaaagcctaaaccaaatgaaaaatgagaagctggatcacccatgcaggcattcatttcgcctaatgttctaaaagctcctaaaccttgtgtattaggtgcatgaaacattcgagctgccccgacagatgctgcaaaaccaagtaatcccccgataatgaccgatttgactagaatgattacgaaatccacgttattctttcccccttatgattcaaaattagatttttttagttacaaatggaatggcaatcccatttggatcttcagtcatttgctggctgaacgatatgtctgccaattttatttctgttacagccacagtaacagagagttcgacttcatagctaatacgttgccgtgggaagaagaaaaatagaaagcgttctgtgtatttgttttcgaccgcctttaaaatatccacattgactggttcgattcgcaataatacgtttgattgttccattattttgttttgaatttctgctaacgctgatgcaaaagcatgttgctttgtttcccctttaccggagacgataactttttgctgaattgtcttttgaacgctcatttcatgtccctctttctattttccatgctttttgataaattcttctgtcagacgtttccctaattcctcttgatccataaagccgaaacctagaacagttttgccatccttgatagctgtgatcccttcttcaatcgaacgcataccatgtcgttctggatagccatattttgttgctgctgttaatgcacctgcaccaccactaccacaaaaagagatacccatatctgcatgctcttgttgcatcacatcgcccaaacgcatatctgcccccattcctggtacgacaactgcttttccaccagctgcttctacccctttggccacattttgtcctttacccatacggtctgcaataactactttaatcatgattgtttcctcctaaatattaattattttttgctgtttcaaaatgaatcgacaaaacatatatttcatcatcggttaaattaccgatacttctaactatttcatcagaaatagttatggcttctttggatacttctttgaacaaatcccgatcgactacgggaatcgtttcctttctttgagaacgtttcaacatctcattcaagtgattaattagaatggtccactgcaactcggttggtacaatagcatgttctactaatcgctcttcaattagatcaatcacttgttttaacttttcccgattttgactttcctcgataatttttaaagcctcgtctgacattttcactaacttgacgctccttcttttatatatgagaataatgcactgatttctgactgattgattcctaaattattttctgcaaaaactgcttcgatttttcctaccagtgttcctttgtctaaaataatctggtctacttgacgaccttctgccatatattgttgatcaaatgtgatacgatgaaccattaagaatacatgaagcaaaaaagcttctcgatattcttggatcaattctgcttccaaaatgacaagtaaacgttcataaatcgtataagctttcaaaatcaattccttgctaaagtcttctaaagtatctttattgatggacgtttctctaagattcaagttatgcctttcctgctgattggaagaagcaagtattttttttattatttgttgaatttttttcaagtcctgttcagtgggtaatggatggactttgatgaaaggacgatcgatgccattgattggaaaaatactaatcaccaaatcaggatctttggtagcaatcatttcttgcgcattcaatactgaagcaaatgccacgatagtgatattatttaattcttcattgatcttttgcttgatcagactagtcacacccaaccctgttgaacaaatgtagacggctctaacgcttcgtagatcttcttctctttcgtaggaaaccaaaaagtgtaaggcaatatatgccacgaaagaatcattgatcagaatattttgttcacttatttcttgtcgaactgcttgcttgatcgcatcaaataattccgggtatttctgcttgatatcttctttaaaaggattatattcattgacaaattttttctttctcgataatcgcatggataaatgagcatacagattcgtcaacaattgtggatcttgataaaaagaatggttgattgctttacttactttataaatcacattctcaactagtttcatgacgtcttgctggtgaatcgtgtcgaatgtatcactatagatataatgatattcatcctcgaacagtggcaactgataataatcaaagacctgctgcatgacgcgataagaaagatcgtttttgtctaattcttgttcagcaaccaattgataacgaccaatcgtagcctctttgcgtaagcgaacggtagcaattgtcactcgaatcagaatatttagtaattccgcgtaattcagtttctctagattttcaaattccagtaagtgtcgcattcgaatgattacttgattaaatacctcttggataggtgtagcagtagcagaatacatttcaaagtattcagtctcaccgccattcaataacaatgacattaatttataaatgtcataatccgtgaactctttttgaagaatctcttcaatcgttaatcgaactagacgttcttctcctgtgatccaaaaaccctttcgcgcctgacgattcaaggtcaatccttccttaagaaaattattttccagcacatctaaatcattcatgatcgtatctttgctgacatctaatgcgttggccattttcattccagtaatagcttcttttgttactaaaagcataattagtaaacgtttgattcggagactttgatctgcaaatatttcaaaacgattaacatccatcaattcgctttttaatttgattcgatcagagctactaatattcatccaaattccctgactacgtttgctatataggacttgcttccgctcattcagccactctcttatatcatctagatcgtattttatcgtccgaacactaacattttctttttcagccaactttttgattgttaccggttcagacatttccaccaagtaaatcaaaagctgcctttctctttttgttagctgctgcattatcatctctccttacattgctaatataagcgttttctaaactaacgacaatatgaaatgtttgcacttaactaagtgcaacttatagctttttaactaatattacagagtttatctattataaagacgactacatgtactgttaaaaagcgttttttattgcactaagtcgtaatataaataatcaaacgctttttcaaattttttaaattaaaaaattgagaacagctttcaatatcttaaaccgtatattctctaaaaatatcatggcttacacgttctatcctaaataaagtttgactggatcaccatacaaaaattaaactccatgtagaataatacgcggctgacgaattcctacatgaagcttatctatgactataaatatttaaaagtaatgaataaaagaaaactaatcaatgatacacgtttagtggtattgatcatactcaaataaaaaatattcaaacagacggattcatactctatttaaaattagagaacatgttcacgcatatattgttaatcatctgaagatagtagtaaaaaagatcagggaggatcatcatgaaaaaagtattggtgacaggatgtttaggacaaattggttcagagttgatcacacggctacgtcaagaactaggcagtgaaaatgtcattgcgacagatatacgcatgcctgaagtcattgagaaaaacgatatctttgagatcctagatgtaatggattacgaaaaaatgcgcagcatagcagaacaatatcaagtggacacattgattcatttggctgctcttttgtcagctgttgcagaagcaaaaccacaattagcctgggatttgaacgtgactgggctggtcaatgcattggaagtcgctagagaattccagctgaaattttttacgccaagttcaatcggcgcgtttggtccaaatactccaaaagatcataccccacaagatactcttcagcgtcctacaaccatgtatggggtaacgaaggtagctggagaactactatgtgattattattatgtgaaatatggcgtagatactcgtggtgtccgtttccctggattgatttcttatgcaaccttgccaggaggcggtacgacagactacgcagtcgatatttattattcagcaatcaaagaaggaaagtacactagtttcattgatcaaggtacatcaatggatatgatgtatatgccagatgcgatcgatgccattataaaactcatgaatgcagatcctgatcgattggttcatcgaaatgccttcaatatatcggcgatgtcttttgacccggaagagatcaaagcatctattcaaaaaatcataccagattttgaaatggattatgatgtggatcctgtacgtcagtcaatagcagaatcttggccaaattcactagatgtttcttgtgcgcaagaggaatggggcttttcgccgaaatacgacttagatgcgatgacaaaggatatgttggaaaaactgaaagaaaaattggtagagacggtataaaacaagaaccacttccaaaaagttttttatacttttgggattggctatggtatgaaaggggacaagggatggaagaatatcaagccacgccagtaaaagaagtaaaaatagaaaatgaattaaaacgtacgatgggattttttactgctttatcgactgttatgggcacagtgatcggtgcaggggtattttttaaagccgcaagcgtagcagaagttacaggatccgccagtttgcatatgttttcttggtttctcggtggtatgatttctgtctgtgcaggactaacaggagctgaactggcagctgctattccagaaacaggagggatgattaaatatatcgaacggatttacggaaatacagcagcttttttattgggctgggcgcaagtcgtgatttattttccagcaaatgtagcagccttgtcgatcattttcggtacacagttcgtcaatctatttggtctttcccagtcaatgattgttcccgtagctgttacagctgctgtatcgatcctgctgatcaattttttaggttctaaagctggaggggcttttcagtcgattacgcttgtctgcaagcttatccctttgtttgtgatcgtcattttcggtttgttccgacaagaaggagtagacttccaactgtttccgatccaagcaggagaaaatctttcatttttctcagccttgggagcgggcttgctagcaacgatgttcgcatacgacggttggatacacgtaggaaatatttcgggagaattgaaaaagccggcgaaagatttgccaaaagaaatttctttaggaatcatcggaatcatgatcgtttatttattagtaaatgcggtgttcttaagaaccgcatctatcgacggagtcgcaggaaacagcaatgcggcaagtgacgttgcaaaaatgatttttggcggcttcggtggaagactggtcacagttggtatcttgatttctgtttatggaaccatcaatggctatacccttactggaatgcgtctcccttatgttatggcaaaagaaaacaacctgccttttagcaagctctttgctaaacttcatgataaaactaaagttcctgtagccgcaggtatcttagagctagtcatcgctattggcatgatgatgatcggtggttttgatacactaacggatatgctgatctttgtcatttggattttttatacgatggtctttgttggtgtcattcttcttcgtaaaaaagaacctgatttgtttcgaccatacaaagttccaatgtatccgtttattccactagtagcaatcattggagggacttttatcgtatcaagcacgcttatcactcagacctttttagcttcgatggggatagtattgacacttgccggtatcccgatttgtctctatttaaaacgtagatagctaaaacattcgaattttattagaactgcactctctgccaaacaaaatattttatttaaatgaggagtacgtggaagaaatatcaaaagtactcgttaattttgatcacgtaaatgtcgttttgtctacgatgaaatagcaaagtaaaagacagaaatcgggctcaaccgatttctgccttttactttgatttgcgtaactgaactattcggcgtacgccgcgataaatatttaataaaaccaagcaaccagaaatgaaaatgggaagccaaatcagatagacagggtagccaagcactttagacaaagcttgtggagaaattttatccatttcaagaagtgcttgctgccaagtctgaagattgaagactagcatgaaacccgaaataatcaggagaataaatcctaaataatgaattgtagttctttttcttacataagcgatcgtagcataaaggaacagtaaaaaaataggtacgccaaaaacaaagtacatattcagcatctcgacaccccctttgtgtttatcttactttactttgaaagaaatgagaaataatagcctcgttacttgcttgaaacagcaaaggactgctaagataagagagatacaaagaatcaaggaggagtcatatggcaagttatatcgaaccgattcgttttgcgctgattgtttttccatttttagccttagcgatctcatctgttttttttatttatgaatatcgaaagtatggaacatttctagtaacaagggcagttattttgtattctttcgttttttatttattgtgtgcgtattttttggtgatcttaccacttccggcaaaggagacggttgcccaaatgacagggccaaagatggagctgcatttatttgcttcatggcaacatttcagagacaacacggtattggtcttgtctgaacctagtacctacctgccggcaatgaagcagagtgtatttttggaaccagcttttaatgttttattactcataccatttggcatttatttaagatattatttccggctttcttttatgaaaacgatgattgctagtttctgcctttctctattttttgaattgacgcagctaagtggactttattttatctacccaagaccataccgcttatttgatgtgaatgatttagtgacaaatacattgggtggaatcattggttttgtcgttacgccgttatttacatttatgcttcctacaagaagacgaatggatgaactttcttatgaaaaaggaaagactgtctcattgactcgacgcttggtcgcttatttgattgactggacatttttatctcttattaatttggtagcggcgattttctttaaacttgcgttcgattcagggacagttacttctcatatctggtggcttttattagaagtaggggtatactttatgattgtaccgtttataaccaatggatggacacttgggaaaaaaattgtgcgtatccgtttggtggaagaagaccgcgaacgaatttctttaaaagcattgatgatccgctacgggtatctgtactttcttttttatggtttaagctggttggggcagttgcttcagcaaatcatgaattcgacaacgaatacggtgttgcagatgagtgcagtattcatttctctcggtgtcttgttactgcaaggtatttttattttaaatatcttgctatcatttttgagaaaaaaacggattctgttttatgaaaaagctagtcacacatatactgttagcacgattggccaaacaaaggatgatgattctcgaaattagctaagcaaaaaccctttgtctgtgttataatgccaaagtcgtgataatttaaagagaagaggtgcacgaatgaataattttgatatattccgcttcaaaccgtttatcaatgaagcgttaaccgcaaagggcttcaaacagcccacggaggtccaggaacgtttgattcctttaattgtaaaaggaaaaaatatcattgggcaatctcaaactggtacaggaaaaacacatacgtttttgttgcctttgtttgaaaaaatcaatgcagaaaaagaggaagtacaagttgttattacagctccaagtagggaactagctgcacagatctatgaagcagctacacaaatcgctaaattttctacaccggagatccgtgtctcgaattttgtcggcggtacagacaaacagcgtcaattaaatcgtctgcatcaccaacagccacaggttgtagtaggcacgcctggtagaatattagacatgatgaatgaacaagcgctgaagattcacaccgcatttgcatttgttgtcgatgaagcggatatgacattggatatgggttttttaaatgaagtagaccaaattgcaagtcgattaccagaaaagctgcagtttttagttttttctgccactattccagaaaaacttcgtccattcttacgaaaatacatggaaaatccaatcattgaagaaatcaaaccaaaagcagttatttctgaagacattgaaaattggctgatttcaacaaaaggtaaagatgagaatcaaatgatttatcaactgctgacaattggtcatccttatttagcaatcgtatttgccaatacaaaacagcatgtggatgaaattgccgattacttgaaaaaccaaggcttgaaagtagcaaagattcatggagacatcaccccaagagagagaaaacgagtgatgcgacaagtacagaatctggagtatcaatatgttgtagcgactgatttagctgctagagggatcgatatcgaaggtgtttctcatgttatcaatgcagaaattccagaagatctagacttctttatccatcgtgtcggacgtactggacgtaatggcttaaaaggaacggccattacgttatattcgccaaatgatgagcaagccattgatgcgatagaaaaattgggcgtctcatttgaaccaaaagaaatcaaaaacggggaaatcgtcaaaacatacgatcgtaatagacgtgccaaacgagaaaaatcaaaagatgtattagatcccacgctgattggtcttgtgaagaagaaaaagaaaaagatcaagcctggttataagaaaaaaatcgattgggcaattgcagaaaaaaataaaaaagaacgcaaaatcgaacgcagacagcaaagccgtactgctcgtaaaaataagaaaaattcacataaataaaaaacaagaggttgtgacaaaaggcgtgtcacaatctcttgtttttaagctagacttttttccattccgatacaaagtacttcatcttcaataaaaggttctgtgcaagtatgatacccttgtttttcataaaaatctacagccgtcatttcagctactacataactagtctgacaaccttctgaaaccgcccgtttttcagcagcttcaagcaactgaccgcctaacccttttcctcggtattcttttgctacgcaaaatcgttccggcttgaagcaagtaggtgttttcttttcataacgcaaagtagctactggtcttttttgatcaagaaatagataataggtttgttgcgggatatcttttccgtcgaattctagttctgcaggaatcccttgttctaatacaaaaacttgatatctcaaaaagcagctagctgcgcgtatccattcatccgctccaactatttttttcatcatattcctccttgtcatgaatagcagagatgtattgattcctttattcttatcgtaccaaaaatcgtggagtatgaccaaaaggaaatgaaaataaaaattgagatattgacagtgatcaatagaatgcgtatactaattaagtacgaaaaggatatgatttgttttttaagactcacagaaaattctttcttggctgaaaaaagaatagtcactaatcaaattgctccctttttctattttggtagaaataccgacgcagctcagcgttatcgagtttaagaggtaatgattacacatcattgcaatcaaggtggtaccgcgagttttcgtccttggctgtgatggtgtttttttgtatttaatttatagaaagcaggtaatgacatgaaacaattaagtagtgcacaagttcgacaaatgtttcttgatttcttccaatctaaaggacatacgattgaacctagtgcgtctttgatccccgtgaacgatccaaccttattgtggatcaactctggtgttgcaacattgaaaaaatattttgatggttcagttgtgccagaaaatccaagaatcacaaatgcccaaaaatctattcgaacaaatgatatcgaaaatgtcggtaaaacagcacgtcaccatacgatgtttgagatgctgggtaatttttcgattggtgactatttcaaaaatgaagccatccactgggcatgggaatttttgactgatccaaaatggatggcattcgatccagaaaaactttatgtaacagtttatccaaaagatacagaagcaaaacgcatctggcatgaagaagttggcctgccactagatcacattattgatgtagaagacaacttctgggatatcggtgcaggcccatgtggtccggatacggaaattttctatgaccgtggagaagcttataacgatttagcagaagacgatcctgaaaactatccaggaggagaaaatgaacgttatttagaaatctggaacttagtattttcagaattcaaccataagcctgataacacatttgaaccacttcctcataaaaacattgatacggggatgggattggaacgcatggtctcaatcgttcaagatgcgccaacgaactttgagacagacttgtttatgcctattatccacgccgtagaaaagctaagcaaacaagtaaaatatggtgaaaacccagtaacagatatttcttacaaagtaatcgcagatcatattcgcgccctttcatttgctattggcgacggtgcattgccatcgaatgaagggagagggtatgtcttacgccgtttgcttcgtcgtgctgtcatgcatgggaaaaaattaggtattgaacaagcattcttatatcgtttagtccctgttgttggggaaatcatggtaagttattatcctgaagtacttcaacaaaaagaatttattgaaaaagttatccgtacagaagaagaacgtttcaatgaaacaatcaatgaaggtttggaaatcttaaatcaagtgatccaagaagtaaaaaacgaaaacgggacgactctagcaggaaaagacatcttcaaactatacgacacatatggcttcccagtagaattaacggaagaggtggcagaagatgaaggactgaaagttgatcatgctggttttgaaaaagaaatggatgcacaacgcgaacgtgctcgctctgcccgcagtactgaaaaatcaatgggggtacaatctgctttattgacagatatcaaagtagaaagtaaattcattggatacacagaacaagaatcagatagtcaattattggtcatcgttaaaggtgagtctcttttgaatgaagtcgcagaaggtgaagctcaaatgatctttgatcaaacacctttctatgcagaaatgggtgggcaagtagcggatcaaggatggatcatgaatgaagtaggcgaaatcgtagcagttgttacagatgttcaaaaagcgcctaatggtcaatttatgcacaccgtagaagtaaaagcaccaatgagtgaaggacaaacctatcatctattgattgatcaatcgatgcgcaatcggatcatcaaaaaccatacagcaacccatctactgcacaaggcattgaaagaagtacttggcgagcatgcaaatcaagctggttctttagtcgctcctggacatttacgattcgactttacccactttggtcaaatcacttcagatgaattagctgaaatggaaagaatcgtcaacgaaaaaatctgggaagctatcccagttgaaacaattgaaacagatatcgatacagccaaaaacatgggtgcaatggctttgtttggtgaaaaatacggacatgacgttcgagtagtaaatattggcggctggtcaatcgaactgtgcggaggcacacatgtagcaaatacagaaaacatcggaatcttcaaaatcgtttctgaatcaggaattggtgcaggcgtgcgacgaatcgaggctgtaacaagtaaagaagcgtacgaactacttgaagaagaagaaaaacaactaaaacaagtagcaacaattgttaaatcacctcaattgaaggaagttgtttcaaaagcggaacaattgcaacagcaagtaagagagctacaaaaggaaaatgaacaattagctagcaagttagcgaatcaacaagctggtgatgtattcaaagatccagaaacgatcaatggaaaaacaatcattgcagcacaagtaaaagtgaaagatatgaatcagctgcgtcaattagctgaccaatggaaacaaaaaaatatttcagatattcttgttttagcaaacgaacaagaaggaaaagtcagtctgctagcggcaatgacgaaagaatcaaatgaagctggactaaaagctggcgacttgattaaagcaatcgcaccgaaagtaggcggtggcggtggtggacgtccagacatggcacaagctggcgggaaaaatcctgctggtattccagatgcacttaaagctgcgaaagaatgggttgcgcaacaatagggcgtttacgtttgacagaaaaacaaaagttcaaacattgaacgaaacatgattatgggggcgaagacaaacaagtcttgccctcatacttttttcaattggctggcgcatctaatcaaatggtcggattcggatgttctttagttgacgaaagtgacagaaatttttacgattagtataaataaaaaggggtgaaaaaatgaatagtagaaataagacctttcgactagtcttacgtgcgatcttgttagcaatcatcatcgtacaagcgatggttccttggctggggtttattccattaggattcattagtttaacaattatccatatcacagtaattattgctgcagtagtattaggcccaaaagatggcatggtgattggcttgttttggggaatcgctacaattgttcgtgcctatgccatgccaacaacgccatttgatacattagtgttcacgaatccgattatctcggtagttcccagagtacttgttggcttagtagcaggcttggttttccactggatttatcaaaaaaataaatcaataacgatcagctcagcctttgcaggggtactgggttcattggtcaatacagtcttagtgttaggattcatgggattattttatacaggtgcaacggcagatgcctatggtgtagattctgctcttttatttaaaaccttagcaggggttgcagcaatcaatgggataccagaagcaataggtgcgggaatcataacaccattactagcaaaagcgttatttgcagcaacaccgttgaaaccagaataatgaccatcttttaatagtaataggacgcacgatagatagaaaaaggaagagaggagaggaaaacaatcgtcctctccatctttttacctgagcaacaagcaaactagaaggggtaaaaaacttggctaagaaacaagaagaaaaaaagaaacaaataccgcaacagcggacaaaaaaaggagtactagcgggtatcttaggattggttacgaatctgatcttgtttgtctctaagctaatgatcgggcttttttcaggaagtgtctccattatggctgatgcagtgaacagtctatcagatactgcttcatccatattgactttgatcggatttaaaattgctgcaaagccagcagatcaggaacatccttatggacacgaacgcttcgaatatatcagtgggttatttgtttcgatcatcattacttatgtaggatttcaatttttagagtcttctgctgaaaaaatcatccatccagaaaatgtctctttaacacccatcgtcttttttgtcctaatcatttccatctttttgaaatttgcacaaggcaaaatgtatcaggttattgcgcaatccattgattctgaaacattgagagctacagcaacagatagttataatgatgtctttactacactggctgtattgctttcagcagcaatcgaatgggtaactggatggcgtatcgatggatatataggttttgctttagcattatatatcctttatagtggattgacgatgcttcgaaattttgtatacgaactattaggaagtcgcccaacgccagcagagattgaagaaatggaagagcatttaaatgcttgcgatgatatacttggctatcatgatttattggtgcataactatggacccaataaacgctttgcatcagtccacatcgaagtagatgaatcaatgaatttgaatgtggctcataagattattgatctgatagaaaaagactttaaaaagtctttggatgtggaacttgtctgtcacttggatccaatgcctgttgataacgaaaaatactataatatcttgcggcagttaaagcaaattcttcttgaaacaggtacagggcttaatattcatgattttagagtaattcatcaaggaaaaacgctgcaatttgatgtagtggtccctgagaaattccagtttgatgatacagaactagaaagaatcttacgtagtcaaatagaagaaaaaatcggagattaccaattggaaattacgtttgatcacaattatcttttatattaaatgagaaactataaaaagactccttaaagtttttgatttaaagagtctttttttcttttaattgtttatggagagcctgacgtgcaagattatctgctcctttatttttgttttcgggcaaccattgcaggatcaataaagaaaattcggatagaagttcttggattctttgaaggtagggaaggaagagctcgttcttcgttgcgtttttgtcgaccgtagaaactagtgttttgctgtctgaaaaacagaaaatcgtttcattctgtaagtcgtttttctttagaaattctaaagtttttaaaaagacttcgaactctgcttgatggtttgtccctatagaaagcgggatagatagctgttcttgtttatcttgatagacaatcaagattccgcctccactaggaccagggttgccttttgtagaggcatcaatgtatacttttaacataaaaagagattctcctttttgttcaaactaatgttatggtaagattatatcattactgaatcggtgagaggttagagaatgaaaaaaaatattcgatggcagcctgaactggcacatacgatcatctattggtcattgaccttgatcattctgttttttagtctgattctttctttagaaaacacaggtccttattggaaaagcaattttgttttaggtatttttcttgtttttctatttctaggtttgcgacgttcttttattttaaaatcaaactctgtgattatacgttatgctgctttttggaaagaccgagaaatatctgtcggacagattcgatctttgacgccaactaatactggggtgcaaatgatgttgcaagatgagaaagccccatctgttttcatgatgcgaaaaaaagatcaagtagtcctttttgatcattttgaaaaaaacggacccaaatcagaatcaattccttatccttatacgaaaaaaagaaaaagctaattttaaaaatcagaacctaaaaaaacgaatttttacaggaaaagaaaagagtgagacggacggttcatcccgtttagcgtctcactctatttgtttatctattcatgcatactagtatcggtagtctgaacgttgcctttcttgacatgggcagcttgtgttcctcgattcccttcgatgatctcaaattcgaccacttgattttcttccaaagttttgaatccctcttcttcaatcgcagtaaaatgtacaaaaatttcttctgtgtcatcataactgataaagccgtatccttttttgttgtcaaaccattttacaattcctgtggtcaaagcactcacgacctttctaaagtctgatcatagccttcattataaagagtatttataagtacgtcaaataaattaaaaacctgtaattttatgttttttttctgaataaaaaaaggtataattggcatatcttaacaaagaagatattttgttgaataaagttcgtgaaaaggggtaatcaaatgaagaatgatctgcaaatttcacaagaaacagagctagaaccgattgttgaagtggctagtaaattagatcttaaggaagacgatttggaactgtatgggaaatataaggcgaaaatcaatttttctggaatcaatcgatcaaaggataacgctgaggggcatttgatcttagttacttccatcaatccaacaccagctggcgaaggaaagtcaacgatcactgtagggttaggagacgcgctcaataaaatcaataaaaaatctgttattgcattgcgagaaccctcacttggtcctgtgatgggaatcaaaggcggtgctgcaggcggaggatatgcacaggtattgcctatggaagatatcaacttgcattttactggtgacatgcatgctatcacaacagctaataatgcattatctgctcttttagataatcatattcatcaaggaaatgaattgaacatcgatgcccgccgagtgatttggaaacgggtagtcgatctcaatgatcgtgaactgcgtaaagtaattgttggcttgggtgggccaatccaaggtgttccaagagaagatgggtttgatatcacagttgccagcgaaatcatggctatcttgtgtcttgcggcagaccttgaagatttaaaggctcgtcttgcaaggatcgttgtcggctatacatttgaccgtcagcctgtgactgctggagacttgaaagcagaaggcgctctggcattactgctgaaagatgcaatcaagccgaatcttgtacaaacaatttacggaacaccagcttttgtccacgggggaccgtttgccaatatcgctcatggctgcaatagtattttagctaccaagacagcattgagattagcagattacgttgtcacagaggcaggatttggtgcagatcttggcggagagaaatttttagatatcaaagtacctaacttgaaaaaagcgccggatgctgtggtgattgtcgccactgtccgtgcattgaaaatgcatggcggaatgaaaaaagatgaacttaaaaatgagaatcttgatgctttgaaagtaggttttgcaaatttaaagcgccatatacgtaatatggaacaatatcagctacctgtgatcgtcgcaatcaatgaattcgtaacagatacagacaatgaactcacactgttggagcacttgtgtgaaaatcaggggattcttgccaagagagcgagtgtatgggcagatggagcagaaggcggcgttgatttagcaaaagctgtagtacgattgattgatagaaaagaagctaattacaagccattataccgcctagaagaaacgatacaagaaaagacagaaacaatcgtcaagaaaatttacggaggaaatggtgttgttttcagcaaaaaagcgcaaaaacaaatagaagagtttacgaagaatggatgggacaaactgccgatttgtatggcaaaaacacagtattcattttctgatgatccttcactgctaggtgcaccggaagatttcaccatcacgatccgcgaaatcatcccaaaattaggggcaggatttttagtagccttgactggagatgttatgacgatgcctggtttgcctaaaaaacctgctgcattgaatatggacgtgacaaatgacggagaagtgttgggattgttttaagcttgattataatctaccatcgaaggagctgtattttgactacagcttctttttttagacgatagggaattaattttgtttacactaggatcattctttttctttattgtattttgagctatactaaagcataataggagggtatgatgaaaacgacatttataagaaaaaccggtttttacggtatgggtagctcgattcaattaagaatcaacaatgaaaaacgcagtgttctcagtcatgaacaaaagataacgcttgatctggaagtgccctttacgatgcaggtcaccttttattggctaaaaagccccgtttatacagtgaaagaagcaaagcctgcttatgtgatcacaatgaattacttgattcttcaaatctatccgtttttatttctagcaactgggttgggggccgttttcctacaaaatttatttttcagtttttttgcagttattgtgttgattgcgttctttttctatataaaaaaccgggcatatttgatcaaggaggaaaattatggcaaactctgatctttttttaatcagtttcaatcgaatcgaaaaatggatgagagacgagatgggaaatgcacgaaatatgggatttaccgaacttgtcagacgcctagctcaaagaaaacaattaatgatcagaaaatacgaagatgatcttttacagcttgctcagttaaggaatgcgatcgtccatgatcggattgcagtcgattttgtcattgcagagccaaatgattggacagtcaagcgaatccagctgatcgaacaagaactgattcagcctgaaaccgtgctgcctcgatttgcaaaacgtgtaacaggttttgaacaagatcttccgttacttgaactgttaaagatagtagcagaaaaaaggtattcacaatttccgttatacaataaaggaaaatttgtagcattgattactttacgtaatatcgggttttggctagcaaaagaaagccaaaaaggtccggttgatttaacaaataaacgagcgttggatttgatcatccaaaacggaaagtacacaaattatcattttgttccagctaaaacacatatttacgaggttgaagcgatgtttcgtgagcaagggactttggaagccgtacttatcactaaagatgggaatcccgatggtaatctgctcgggatcgtacgacctcgtgatatttataaacaaatagaaaaggattgattttttgttaattatttattggatattcagcgctttgctagtaggagtggatcagttggtcaaatggtggatcactgataatctagcgcttggagagacgaaaaatcttataccaggtattttgtcactgaatcatattcgaaacactggagccgcatggagtatgctagaagggaagatgtggttctttactatagtgacactcattgcagtcgttgtgattctcacattgatgattaaaaatcgtgaaaaaggtaatcgctggttcatgattggattgagtttgattctagctggtgcgattggcaattttatcgaccgtattcgtcttggctatgtagtagatatgttccagacagattttatgagctttccgatttttaacgtagcagatgtgacacttgtatgtggagtgatttgtatattaatttatattattttagatgaaaaggatcaaagaaaaaaatgacagaacttaaaacgacgattcaccatgaatctggtaggatcgataaagtattgactaatttattcaccgattacagtcgttcgcaaattcagctgtggctgaaaaatggagcggtttctgtcaatggacagccagtcaaagcaaattacaaagtaaaacaaggagacgagattactgtcttgatccccgaaccagaaacattagatgtggtcccagaaaatatcccgttgacgatcgtttacgaagatgaagatgtagcggtgataaacaaacctcaaggaatggtcgttcatccttcagcaggtcatacgcatggcacaatggtcaatgcgctgatgtaccatatcaaggatctttctacgatcaacggcgttattcgtccaggtattgttcaccgaatcgacaaagatacttccggactgctaatggttgccaaaaatgaccaggcacacgaatcattagctcagcaattaaaagataagacctctttgcgcaaatatgttgctttagtccatggagagattcctcacgaaaaaggaaccatcaatgcgccaatcggccgttcgaaggaaaaccggaaaatgcaggcgataagagaagatgggaagccggctgtcacacattttactgtattggaacgtttcgaaggatttactctggttgaattaaaactagaaaccggaagaacacaccagatccgtgtgcatatgaagtatatcggttatccgttagctggagatccagtatacggaccgaagaaaactttgaaaggcaatggtcagtttctccatgcgcaaatgttaggttttacgcacccgactacaaacgaaaagatgatctttgaagcacctcttccagaagtttttgaaaaaactttagaaaaattaagaaaaaacattgcattttaatttagataacggtatagtaattaacaacgaaagcataaaacttaatagaattcctttaagtttagtcccgtgaggctaagaagggtgggagcaaggatgcgtatggtgcgccataagtagattgctcattgacatagtatagctatcagtgtatcagtatacgctcagtctaaacattcctcctgtcctcttagggcaggagtttttttatgcaaaaaagtagggggaatgaaaatgcaagcaaaagaagtagtagatcaggtaaccatgaagcgagcattgactcgaattacttatgagattatcgagagaaaccatagtatccaagatatcgtattggtaggtatcaaaacacgaggaatctacattgcatcaagaattgccgaacgcctgaagcagctagaagatatcgatattcctgtaggagaactggatatcactttataccgagatgacaaaaaagaaaatccagaagaaccggaacttcattcttctgacatcccagtttccttagaaggaaaagaagttattttgattgatgatgttttgtatacaggacgaacgattcgagcagcaatggacgcagtaatggattttggcagaccaagaaaaatttcattagcagtcctggtcgatcgtgggcatcgagaattgccaatccgtgcagattatgttgggaagaacattccaacatctcgggcggaagagattttagtagagatgcaagagcttgatggacaagatcgcatcatgattttgaaagaggaagattagaggagagagaaacatgtcggagaaaaaaggatttcataatgatgacgtggtgttagatatccacgatcgcccaaccccaggacattgggtaggattaagtttacaacacttgttcacgatgttcggagcaaccgtgttagtccccatcttagtaggtatcgatccaggtatcgcgctagtcagttcaggactaggtacattggtgtacttatttactactaaaggaaagataccggcgtacttaggaagcagtttcgctttcattgcggcgatgcagcttttgatgaaaacagatggttatccagcgattgcacaaggagcagtcacaactggattagtctacttgattgttgcgctgatcatcaaaaagatcggttcagcatggctggataaaatcttgcctccaatcgtcgtcggtccagtcatcatggttatcgggttgggacttgcggcaaatgcagcaacaaatgctatgtataatcaaggcacatatgatttcaagtatattgccgtagcactgatcacattaggattgaccattttcttcaacatgtggctaagaggttttctcggattgattccgattttactaggtattattagcgggtacatcgtagccttgctgtttggaatcgtggatactaagccaatcgtagacgctgcctggtttgctgttcctaactttgagattccctttgtacaatatgaaccaaagctatatcttggagcaatcacaacaatggcacccatcgcttttgtgacgatgacagagcatatcggccatcttatggtattgaataaactaactaaacgtaatttctttgaagaaccgggtcttcataagacgttgacaggtgatgggttagcacaaatcgtggcagcctttgtcggaggtcctcctgtaacaagttatggtgaaaacattggtgttctggctatcacacgtgtccatagcgtgtttgtgatcggtggagctgcagtatttgcagtcattttaggattcgtaggaaaattaagcgctttgattttaagtatccctggaccagtcatctcaggaatcagttttatcttatttggagtaattgcggcaagtggaatgaagattttaatcgagaacaaaatcgattttgataaaaagaaaaatctgttgattgcttcagttatcttagtagtaggaattggcggactcgtctttgaagtaggcacatttacattgtcggcaatggcattagcaactgtacttggcatcattttaaatcttatcttaccagaaacttcacgaagcgaagaaaactaaggaggaaacattatgatcatcaaatcagaacgtatcagcttaaagcatttattgaccgttgaggcacttactgatcaagaagttatgggcttgatccgcagagggcaggaattcaagcaaggtgctaattggactccgcaaaagcgccagtactttgctacaaacctctttttcgaaaatagtactcgcacacataaaagcttcgatgtagcggagaaaaaactagggctagaagtgattgaatttgaagcaagcacaagctctgtccaaaaaggggaaacactatacgatacagtactgacgatgtcagcattaggcgtagacgtagcggttatccgtcatggtgatgagaactattatgacgaactgatacaaagtaaaacaatccagtgttcgattatcaatggaggagacggaagcggacagcatccaacccaatgcttgcttgatttgatgaccatttacgaagaatttggtcattttgaaggtctgaaagttgccatcgtaggtgatatcactcactctcgcgtagctaaatccaatatgcagatgttaaaacgtctaggcgcacaagtattcttctcaggtcctagagaatggtacgacgatgaattcgaagtgtacggacattatatgccattggatgaactactagatcaagttgatgtcatgatgatgcttcgggtgcaacacgaacgccatgatggaaaagaaagtttctcaaaagaaggctaccatcaggaacatgggttaacagttgagcgtgcgaagaagttgcaaaaacatgcaatcattatgcacccagcaccagttaaccgcgatgtagaattagctgattcattagtggaaggattacagtcgcggatcgttcagcaaatgagcaatggagtattcgtcagaatggcaatcttagaagcagtgctaaatggaaaagcgtaattataggaggatgaaaaaatgaaaacactcattaaaaacggtcagatcaatacacgaaaaaatatgacgacaccagcagaaatttggatagaagatgggcgaatcaaagcaatcggtacaggattctcagaagccgaatttgatgaagtgtttgatgcaaagggacaattgatcacacctggtttagtggacgtccatgttcatttgagagagccaggatttacatacaaggagacgatcgaagctgggactcgctcagctgctcgtggtggtttcactactgtatgcgcgatgccgaatttaaatcctgtacctgatacggcagaaaagctgagacaagtatatgacatcattagaaaagatgcagttgtgaaggtattgcagtatgcgccaatcacagaaaatctgcgaagtgagaaattagttgatcaagaagcactgattgaagaaggtgcttttgctttcacaaatgacggtgtaggtgtccaaacagctgggacgatgtatctggctatgaaagaagctgcaaaaaacaataaagccctagtagcccatacagaagatgaatctttattatttggcggcgttatgcacgctggcaagaaggcagaagaacttggtcttcccgggatcttaagcgtaaccgagtcttctcaaattgctagagatctgttgctagctgaagcaactggtgttcattaccatgtttgccatgtttctactaaagaaagtgtccgtgtaatcagagacgcaaaaaaagcaggaatccacgtaacagcagaagtttcaccccatcatcttattttgatcgacgaagatattcccgaagatttcggcttttggaaaatgaacccgccgctaagaggacgggaggacagagaagctttgatcgaaggcttgcttgacggtacgatcgattgcatcgctacagaccatgccccccatggattagaagaaaaaagccaaagtttcatgaaatcaccatttggtatcgtaggaagcgaaacagcgtttcaactgatctatactcattttgtagaaactggtcgattcacgttggaacaagtgatcaattggttggcagttaaaccggctgagatttttggtttgaatgcaggaacgctaacggttggtgcccccgctgatgtggcagtttttgatattacacaaacttgcacgatcgataaagaagactttttatcaaaaggggagaatacaccttttatcggctggaaagtaaaaggcgaaacacaaatgacttttgtcaacggaaaacttgtgtggcagaagggagaataaaagtatggaacgtttgcttatattagaagatggaacagttttcgaaggaaaggcttttggtgcagatgctagtgtcttcggagaaatcgtttttacaacaagtatgactggttatcaagaaactatcactgatcaaagttttaacggtcaaatcattacatttacctatcctatggtgggtaattatggggtaaatagagatgattatgaatcgatttctccaacatgcaaaggagtagtagtaaaagaacatgcacgtgtagcttcaaactggcgaaaccaaatgacgctagattcatttttgaaacaaaaaggaattcctggaatatcaggtatcgatacgcgcgcccttactcgcaaaatccgtgaagtcggaacgatgaaagctagtatcgttgatgctggagattccttcgaacatgcatttgatcagctgaaagcaaccgttctagcaaccaatcaagtgcagcaagtctcaactaacaaaccttatccaagtccaggaacaggtcggaaagtcattgtcattgacttcggcttgaaacatagtattttacgagaattgagtaaaagaaactgtaacctcacagtacttccctataacacagatgccgagacgattttagcgctatcaccagacggagtcatgctgacgaatggacctggtgatccaaaagatgtgccagaagcaatcgaaatgatcaaaaaaatccaaggaaaagtaccgatttttggtatttgtctcggtcaccagttatttgctttagccaacggtgcagatacctataaaatgaaattcggacatcgaggattaaatcacccggtacgagaagtagcgaccggaagaattgattttacttctcaaaatcatggctatgcagtcgatgaagccacgattgatccagaaaaactcatcgtaactcatgtagaagtaaatgacggaacagtagaaggagtcaaacacagagattatcccgctttcagtgtgcagtttcatccagatgctgcccctggtccgcatgatgcactacatttatttgatgaatttatggaaatgatggacgcaggaaaggagcagtaaacagatgccgaaacgtacagatatcaagaaaattatggtgattggatctggtccgatcatcattggtcaagccgcagaatttgactacgcaggaacacaagcctgccttgccttaaaagaagaaggatatgaagtggttttagtaaattctaatcctgcgacgatcatgacggataaagaagtggcagatcaagtatatatcgaaccgatcacacttgaatttgtatcaaggattcttcgaaaagagcgtccagatgctctccttccaactttaggcggacagacaggcctcaatatggcaatggagctggcagcatcaggtattttagaagaattgaacatagaacttctaggaacaaagctttctgcgatcgatcaagcagaagatcgtgatctattcaaacagttgatgaaagaattgaatcagccaatccccgagtctgaaatcgtcaatacagtagaagaagctgtagattttgcaaataaaatcggctatcctgtcatcgttcgtccagcctttactttaggcggaactggtggaggtatgtgtgaaaatgaagaagaattacgtatcgtatcagaaaatggattaagtctttcccccgctacccaatgtttgattgaacgaagtattgcaggttttaaagaaattgaatatgaagtgatgagagattcggctgataatgcaatcgttgtctgcaatatggaaaattttgacccggtgggtatccatacaggtgattctatcgtatttgcccctagtcaaacattgtctgaccatgaatatcaaatgcttcgtgatgcttctctttcgattattcgagcacttaagatcgagggaggctgtaacgtccaactcgctcttgatccacatagttttaattattatgtgattgaagtcaatccgcgtgtttctcgttcatctgcgttagcaagtaaggcgactggctatccgatcgctaagctagctgctaaaatagcgcttggattaacattagacgaaatgaaaaatcctgttacaggaacgacttttgcagaatttgaacctgcattagattatgttgtagctaaaattcctcgctggccgtttgataagtttgaaaacggagaacggcttttaggcacgcagatgaaagcaactggtgaagtgatggctatcggtcggaatatcgaagagtctttattgaaagctgtgcgttctttagaaatcggtacacaccatatcgaacttcctgagttggcagacatcacggacgatgacctaatccaaaaagtggttcgagcacaagatgatcgcctgttttatgtagctgaagctattagaagagggtacaccatagaagaattagcggatttgacaaaaatcgatttattctttttagataaactgttgcatatcgtagaaatcgaacagcagttgaaacagcagccgttggatgacaagatattgaaaacagcgaaacaaaacggttttacagacaaaaaagtggcggagctgtgggaaataaacgaagaagccgttcgccagatgagaaaagaaaatgatttgattcctgtatataagatggttgacacttgtgcagcggaattcgaatcaaaaacaccttatttttatagttcctatgaatatgaaaatgaaagttcacgatcagaaaagccctcaattctagtactgggatctggtcctatccgtatcggacaaggggttgaatttgactatgcgactgtgcattctgtcaaagcaatccagcaggcaggatacgaagcaatcatcatgaacagcaatcctgaaacagtttcgactgacttttctatttcggataaattatattttgagccattgaccttcgaagatgtgatgaatgtgatcgagctagaacagccgataggagtaatcgttcaatttggtggtcagacagcaatcaacttagccgaacctttgactgctgctggtgtaaaaatcttagggacaacgatcgaagacttggatcgtgcggaaaatcgtgatttattcgagcaagcgctgaaagagttggatattcctcaacctttaggggatactgctacaagtaaagaagaagccgtggttatcgcttcgagaattggttatccagttcttgttcgtccaagctatgtattaggcggacgtgcgatggaaatcgttgaaaaccagcgagatttagaagattacatggaacatgctgtgaaagcatctccagaacatccagtactagtggaccgttacttgcttggtggtgaatgcgaagtggatgcgatttgtgacggtgaaacagtactcatcccagggatcatggagcatattgagcgtgctggtgtccattcaggggattcaatggctgtgtatccacctcaaacattatctgaatcgatcaagaaaacgatcgaagattacacgatccgcttagcattaggtttgaattgtgtcgggatgatgaatatccagtttgtcatccatgaaaatgaggtttatgtgatcgaagtcaatcctcgagcaagtcggactgttccattcttaagtaaggtgacaggaattccaatggcacaaattgcgacgaaagctattttgggagagaaactaaagacacttggttatgaaaacggactttatccagaaacaaaagaagttcatgttaaagcacctgtcttttcttttacgaaattgcagaaagttgatacttacttagggcctgaaatgaaatcgactggagaagtaatgggatctgacagacaattagacaaagctttgtacaaggcattcgaagcttctggattacacttgcctgaatatggagccgtattatttacgattgcggacgaaacaaaagaagaagcactagaattagctaaacgttttacagaaattggctatagtctgataggaacgaaacatacagctgcttatttcgaaaaaaatggtctggtcgttgaaacagtagcgaaaatttctgaggaagcagcagaaaaaaatgtagtcgacttaataagagatggtaaaacacaagtggttgtcaatacgattgataaagatcggggaaatgcttctaaagacggtttcatcatccgaagagaagcagttgaacatggtattccattgtttacttctttagacacagcagatgcgatcgttcgagtgatggaatcccgtgctttttcaactaaccctatttaacggcgagcacatgttaagacaaaaagacgaaaaaccgttgcaggaggggacagatgaaacaagaaatgatggaaatcgttcagcaaaaacagctggcaccaaagatttttgaaatgacattgaaaggtgatctagtaaaagaaatgcagcaaccaggacagttcttgcatattctcgtgccgcgtgcagacttgctattacgccgaccgattagcttgaatcatatcgaccacgaaacaaatacttgccgtatcatttatcgggtggaaggtgaggggactagagtcttctctactctttctgccggagaccatttagatgtcatgggtcctttaggcaatggttttgatttgtccaatcttcatacaggagacgaagtatttataatcggtggaggaatcggtgtccctcctctatatgagttatcaaaacagttagtcgaaaaaggaattaagccaacgcattttttaggttttgccacacatgaagtcgtttattatgaaaaagaatttaatcgtctaggagaaacaagaatcgctactgacgatggaacatacggtatgcacggaaatgtcggtaatttattgttaggaacgaagacggaacctacagctgtttttgcatgtggttcaaacgggttattgaagacagtggaacagctgttttcttcgcatcaaaatgtccagttatcattagaatcccgcatggcatgtgggataggggcttgctatgcttgcgtttgtcatacgccggaagatgaaacaggaacaaaaagtgtgaaagtttgtgacgaaggaccgatttttaaaataggagaggtaattatatgaatgagaatcctttagcggtcaaacttcctggcctagaattaaaaaatcctatcatgccggcaagcggctgtttcggttttggcaaagaatacggaaaatactatgatttgaatcagcttggatcgatcatggtcaaggcaacgactccaaatgcccgctttggcaatcccacgccaagagtggcggaaacaccatctggcatgttgaatgcaattggtttgcaaaatcctggtctagacgttgttatgcataaacttcttccagaattagaggagtacaatgagttacccatcatcgcaaatgttgctggtgcttgtgaagaagactatgtagaagtttgtagcaaaattggcgaagcaccaaatgtgaaagcaatcgagctgaacatttcttgcccaaatgtcaaacatggcggaattgcttttggaacagattctgatgttgcttttcaattaacacaagcagtaaagaaagtttcttctgttcctgtctatgtcaaattgtccccaaatgtaacagacatcgttccaatcgctcaggcaatcgaagctggaggggcagatgggtttacgatgatcaatactcttcttggtatgcggattgaccttaagacaagaaaaccgattttagccaatcaaacaggtggactctccggaccagcaatcaagcctgtcgctattcgtttgattcaccaagtagcaagtatatccagccttccaatcattgggatgggcggcgtgcagacagtggatgatgttcttgagatgtttatggctggagcaagtgctgtagctatagggaccgcgaatttcaccgatccgtatatctgtcctaaactaattaaagagctccctgtgcgaatgagcgaactaggcatcgaatcgctggaaagattaatcaaagaagtgagagaggaacgtgaacgatgaatcaactagaccaacgaccaattattgcattagatttttcaactaggcaagaggtagaagactttcttcgatttttcccgaaagaagaaaaattgtttgtgaaaatcggaatggaattgttctaccaagaaggacctgaaatcgtacgttatctaaaagaggctggtcataatgtatttttagatctgaaacttcacgatattccgaatacggtcgaaaaagcaatgcggggattggcaaagcttggtgttgatctcacctgtgttcatgccgctggcggtattcgtatgatggaggcggcaatgcgaggattagaagagggcactccagaaggtggaaaacgtccgctacttctagctatcactcagcttacttctacaagtgaagaagaaatgcatgccgatcaactaatcgaagtttctttagaaaaaagtgtgatccattatgctagctgtgccaaaaaagcaggattagatggtgtggtttcttctgcttgggaagtagaagcgatcaaagaaatggcaggagacgaatttgtttgcttaactccgggtataagaccagaaggaacagtcgcaggagatcagacaagagtagtcacaccttctcaggcaaaaaagatcggctcaacttttatcgttataggtcgaccaatcactcagtcaactaatccttataaagcatatcaaacgattcaaacagaatggagctaacctaaaatgaatgttgaacaaagtatcgcaaaagacttattagaaattgaagcagtatttttaaatccaagtaatccttttacatgggcaagtggaatcaaaagcccaatttactgtgataaccgaatcacaatgagctatccaaaagtccgaaaagagattgcaaaaggattagcaagcaaaatcaaagaagcttaccctgaagtacaagtgattgctggaactgcaacagcaggaatccctcatgccgcatgggtagcggaaatactggatttgccaatggtctatattcgaagtaaggcgaaagatcatgggaaaggtaataaaatcgaaggacgtatatttgaaggtcagaagatggttgtgatcgaggatttgatttctacaggcggaagtgtcttggaagcagctgaagcagcaaaaagagaaggtgcggatatccttggtgttgcggctatctttacgtatgagttgccaaaaggaaaagcaaatttcgaaaaagccgaaatccctcttatgacgttgaccaattattctgtattgattgaagcagctttagaagatcgttatatcgatgagcaagaattaactctgctaaaagaatggaaaaaagatcctgaaaattggcagtcttaagtataaaaatacttagatagttgaagaaataaagctatgttattttgaatatttctaaattaccatttctctacaccgttatattttttaaggatacagttacataaactgtatccttatttttttcataatcctgcatggatgatttggatgaggaaatatatccataagatacatatgcatgatcttcaatagcgttgattacacaaagtatgaacgacttcaacgagtcaaaatagcccctcaactgtgttcctatcccacagtcgaggggctatctttgttttacatatgtaggaaagcagctcaacacttttacaaaatcgattgaacacttatcagtaaaggataaaagtgttggcaaatagttgtaactatagcttttacaggctgaacagaagttggcacggtatttgctttatataaaattgtcagcaaggaggaaataaaaatgaatacgattattctagctagtcacggcgcattatctcaaggtctaaaacaaacagctgaaatgatcttgggacctgccactaatatttatgcattatcagcttatcgcgatgaagatgagccgatagaacaacaaatacaaagtatagttacaaaattaggaaaagaaaatctatttattctcacagatatcttaggaggaagtgtcaataatgaaatgataggactgttaaagaaagagccagcaatacgattgatcactggaatgaatctacccttggtgatttcaatcgccacgcaagttaacccaattgctgctgcagatttagaattgattattgaagaaagtcggcagtcattgattgattgcaatcgattactaaaaaaatcaaatgaaggaggagatgatctatgatcaagttcattcgtatcgatcatcgattgttacatggacaagtggtgttttcttggagtaaatctttgcaaatcaaccgacttatagtggtgaatgatgaagcagccaatgatgaatttaaaaaaatgtctttagaactatcaaaacctcaaggaatcaaactcaatatacttaccgttgaaaatacattgacaaaaatatctaaaatagaagcattgagcgaaaacatcatgatgatctttggcaataccaaggatgttcgtcagttttgcgaaagttactcaaatgttaaggaaatcaattacggaggcatcataaaaaaagaaggatcaaaacaattcagtaatgctatcttcttgactgaaaacgagatagacgatgcgaaagtactaaaatcaatgggcatcaaacagttcatgcaacaggttccaacctcaaaaaaagaggatttgaatacaatgatttaaaaactatagattacaaatagtatcgtatttcgcaatcttaaaattatcttcttactgtgaataagataataaaatttgtatttgtcctttttaggtaacttattttaatctatatacctttctggatcaacgaaagtatactttatatagtcataacgccgatggtaactatgcactgtaacgataatgctgctaaaatatctttttacgaaaaacatcacaaggaaaaacttaactatggtattatctaaacataattttttcggtatttaatatttaattaggaggtaatattttgcttttttatagtaattttatcttaatagtagcgatattattacttctgaatatatggatttttgataggagtagaaatgcaagtataggttttagaactaaacgaagtctgtcttctaaaaaaaattgggtatactcacaaactattttttatggaggaattgttttaattagtttactttcttcaacactttattctttgaatattatagatgtttccacctcaaattcaatatctattattggaatcattattgctgcaattattacacaactgtttttagtgtttggagagaagaaaagaagtaaaaaatagaaaaactagtgatagttttggtgatagtgatattaaaaatcagaaaagatagaaaaagcaggagatagataaaatgctgatatttcagcatttttaagagtataaaagagaaaaaaagtaataaatgtatacatgatataagaaaaacatatatgtataaaaagaagaaagtagcttctctttgtacatatatggtttgtttttatggatgccgagcttttttataagataaggctaccgcccataacgacccaaggatttgtggaactaagtaaatacctgcaagaagcaagatcagctgggtcggttttaaaggatgatagaagtaacgccattcagtaaaattggcgcaaaataaataggaagtgacagtagatataatattggcaatgaataaagatataatacgcctgttcctttgaaaataatatccagcaaaaagagataaaaatatcaatgtgatgaacccgcttacggaatgataacgaaaatcaagcagtaaggcgaaatgcacataaggaacaaaagataaaagcaacggaaggtttttccagcaagtttttatcatctttcatcaccacctaacaagtgttattattttgttagttttattgtaaattgaatcctgcaataatcaattactttttcattatttctagattaaatgaataaactctcatgccattatctctaaaaaaaaagtttttccccctaatttttttagatagaaaattgtatagtatgatgagagaaaaagtagtttgggggaacgttaatgagaagaaaagcagtaatcgatcggctttatttatttttttggttttttcctatcgttttgctaccttttacatgggtaaatgctgttgtacaaggtgcggagatattaggcctgatccaaggaagcggatttgtggtttctaggaattttccagctttgactgttttctatttagtgataagtgtaggtctcttattaccaaaatctctgatcaatcactacaattggcagctgctttacttttcttgcttattagtatttacatctatgttttctttgctgcctcgcttgattatcggccctaatggtttgagcgagagtggattgaaggattcagcttattcctccatgtatttcttgacgatcaaaccatggttctatttagtaattgcctcatttattcttgcaacatttttttacttctggacagaaatcaggataaaaagtgaacgatctgtatctataaaaaataactattgatggtggatcatcagtaaaaaagcatatgagctgcgtaaaatgcatgtttctcatatgctttttttattattatgtaaagaatgcgaaaaacgtttacatgatttttacataacttaactatatttttacagcaaccatacgagggatttacagtcgactgataaactttagttgtaaataagaaaggagcaataaaatgaaaaaagtattgtttactctaggtatgatgggaattcttttagccggatgcggctcaggatcaggaaatacagatggctctgccacacaaaataattcaagtgactcaaatgaacaagtaaaaatcgttgcggtaggttcgacagcattacagccgttagtcgatgcagcacaagaaagctttgtacaagaaaatccaaattatcaaatctctgtacaaggaggaggaagcggaactggtttgagccaagtcgaagctggagcagttactatcggaaactctgatgtatttgcagaagaaagagacggagttgatgcttcaaaattagtggatcataaagtagcagtggtcgggatggcaccaatcgtcaataaagatacagatgtcaaagatatcaccaaacaggaattgattgatatctttacaggaaaaatcactaactggaaggaagttggcgggaaagatcaaaaaatcaacgtcgtgaaccgtgcaaacggcagcggtacccgcgcgacattcgaaaaatggggactggatggtgctacccctgtgcagtcccaagaacaagattcatcaggaacagttcggcagctggtaagtcaaacaccaggagcaatcagctatttagctttctcatatctcgatgattccacacaagcactaagtatcgacggtgtagaaccaaaagaagagaatgtagcagataacagctggggaatctggtcatatgaacatatgtacacgaacggaaaaccttcccctgaagtccaaaaattcttagactacatgatgacagaagaaatccaagaaggacctgtcaaagaattgggctatttaccaatcacaatgatggaagtagaacgtgatcacgaaggaaatatcaaataactagcagataaacatgccacggtagtcgttactattaaggaaaaatcaactatgtttccccacatatacatttttcctttaattgtgaaaaatagttcctcatattttgccgttttttgagctaataccgagggtcagctgattgaacaccgtttattcgaaaaaaagagctacgacatagaactgtcgtagctttttttttgctatatgacaggaatgaaaggtgtttgcaagcttaatgtgaggaacactttccatatctgttctatactggataggagaagtttggaaatatccagaaaacgaaatcaatcgaggtagccacatgaagaataaatggataaatcgaagtaaaaaaaagaaagtaacacaaagatcatcagataaagtcatccgtctttttccatcgtataaagaaggattaacggcagatcaagtcaaggaacgaatagaaaaaggtgcagcaaataattcagtcgatcccacattcaaaacaaatcagcaaatcgtattggaaaacatatttacgtatttcaatttgatctttcttatcttagccattttgctttgtttagtagaatcctataagaacttgacttttttaccagttatcatagccaatacaggaatcgccatttttcaggaaattcgatccaaaaagatcttggacgaactaaatgttttaaatacagcaaaagtcaatgtcatacgagacgggatagaacaaacaatagatatagaagaccttgtaatagatgacattgttattttagagactggacatcaaattccagcagatgcagaggtcgtggaagggaaactgcaagttaatgaggctttattgacaggcgaagcagatgaaataaccaaagaaataggcgatccattaatgtccggcagtttcattgtttccggaaaagcttacgcccgattagacaaagttggagcagattcgtatatttcccagctgacagtcaaagccaagacaatgggagaaggagaacagtcggagatgattgcttctcttaatcaattgatcaaatggattgggatcatcattattcctatcggtatcctgcttttttctcaaagttacttttttaatggaaacacgatcaaagaaagtgtcgttgcaatggaagcagcattgatcggtatgatacctgaaggactgtacttgctgacgacgattgcattagcattaagtgcgactaaactagcaaagcaaagagttcttttacacaatatgaaaagcattgagacattggcaagggtaaatgtcctttgtgtagataaaacaggaacgatcacagaaaataaaatgtctgttcaaaaagtgatcgtctctaaaaaacaagaaataatcagtcagtcagatcaattggaagcatgcattgctgactatgcaaaagcgatggcaggagacaatgcaacaatggaagctgttaaagcatattttacaaaaaccactgatcaatcctatcaccatgttattcctttttcttctgtccaaaaattcagcagtgtagcgttggcagacaaggtgtatgttttaggagcgcccgaaatggttttgcgcgatcaattgccggaatatgcggaagagtttgtttctttcgctgaaaaaggctatcgcgtgttggtctttggtgtgtacgatgggattcttgaagaaccagtattgacagaagcagtcacaccattaggctatattctgattgctaatcctatcagaaaagaagcaagagccacatttgattacttcaaaaaacagcaagtagccatcaaagtgatttctggagataatccgctcaccgtatccaatgtagctgtccaagcagggatttcacatgctgatcagtacgttgatgcatctaaattatcagaagaagaatatgaagcagctgtcgaaaaatatacagtttttggacgcgtcaagccagaacaaaagaaaatcttcgttcaattgctaaagcgtcgtaacaatacagtagctatgacaggtgatggcgtgaatgatattctagccatgaaagaagcagactgcagtatagcgatggcttccggaaatgaagccgccatgcaggcctcacaagtggtcttacttgattctgacttttcacgcatgccagaagttgttgcagaaggacggcgcgttgtgaacaatattgagcgatcagccagcttgtttttagtgaagaatattttctcctttttgctctcactgttttcagtgatctttgctctgacctatcctttagaaccatcacaaatcacattgattagtttgtttactatcggacttccatctttcttgcttgctctagaagaaaacaaaaagcgaatcagagggaaattcgtcatgaatgtgatggaaaaagctgtgccaggtggactaacagatatgatcgtagtcggtgcgttggtgatctgcggggtgactttgaatctaaataaaacagatgtttctacagcatctaccatgcttttgattgcagtagggttcctcgttctctataaaatctgttcaccgctgaataaattcagaagtcagatcattcttttctgtgctagcggtaactttttttcggtcatctttttgcataagctgttttcaatcaccggtatctcagctgtatcacttttgctgttgagcattctatttttctcggcagattcgatttttaggcatttgaccacattggtagaatatttgtttgaacgtaaaaatgaaaaagagcaaaagccgtttagtcgcgtagttaaaaaatttctatcgatatttaaacgagaaaattgacgaaaagtatctcaaaaaagagtaaaaaagaacaaccactcgtgtatctttcgaagcaggatgagtcatccaactttaaaacgcacgagcagttgctcttttttacattttcggaatggtaacggtgaaagtcgaacctgttccaagatgactgtctacagtaatcgtaccatgaaggagttgcacgtagtcttttacaatcgctaaccctaatccggtcccgcctgaatgccggcttcgcgccttgtctacgcggtaaaaacgctcaaagatccgttcctgatcctcaatgtcgatacctataccaaagtcttggacagaaaacgatagatcatctgttgcctgatagcggataataatctcgctgtcgctttttgaatattggacagcattttcaatcagatttttgataattggataaaggatatctgttttagtagtaaatggttcgttctttccaatcaatcgaatcgtcaaccgtttcttttcgatgattggctgataattttgaacgatttgctggaaataaggttctgtataaattgtctggatctcgtaagaattctcgccatcttttgacagctggatgatttcccgaatcagtttatctaaccggatcgcatctttttgcatgatctcaagaaaagaagtcagagtttgcgggtcatcttttgcaccatccagtaaagtctcggtaaaaccaatcagtgaagtcacaggagtttttaattcgtgagagacgttgccaacgaaatccttttgtagcttttctaaacgtcgcactttcgttaagtcatacgccacccctagaatctgtccggtaccttctgaattagtaaagtagcgcaaactcaagtctaatgtctgccgaccttctgtaagggtgatctcctgatggatcagcggatgctcaggagtcacttgatgaatcagctgaatgagttttggctcttgaatgacttctgtgtaccgctgttcaggttgatagcttaccacgtttaaatgtagctgcatctttggattaagcagtagtaaacgagaatcagcatcatcaatcaggaatacgccaatcatcagttcgttcagtaacgtatataattgctcttctgtggtagtatacgcccgatacatcttactcatttgttcgctcaacgcattgatcgtctgatacaattcttcccattgatcgggtgtttgcatgattacttccgcctgattaggattttgcaccattttttttagtacgggcagcacggttttcaatggctggtttttttgatagatcagataatagatcattcctgcaagaacaaggaagaaagacagaaagaagaaaaagacccaacggcgaaaactctcagttctcggtaaaaaaccgcttgtcggttctgcgatacgtaaaatggcttctaactggccactttttttgactggtaatgcgacatataaaagatccccattcaaagtagtacttttgcgcaaagcgctacctaggttcccaccattcaatacggctttgatttcgggacgggagtttcgctgttcattcaatgtttcattgtttgtgtcaaataagatctttccagtagcatccattaaagtaatccgttcgttcgactgatggacgaattcttccaaagcagttttgttttgcgctgcttggaggttttcgacatctaattgccggatcagcagttgtgctttttttgtcaggtagctttcttgctgttccacgatctgctgttgaaaataattggaaatcaattgccagccaccaaaaaacaaactaactaaaagaataagaaagaagagacgttcataaatttttttccatttcatcgttttggttcctgaaacttatagccaaatcctctaatagtcaccaagtactttggatgttttggatctcgctcgattttttctcgcaaatgactaacgtgtacatctacgattcggctttgtcctgcgaagtcaaaattccaaatgcggtctagcaatgtgtctcggtcgatcacacggtcttttcgtttcatgaaataaacaagtaattcaaattctttcggtgttagttcaatcagatggtcgtctacggtcacttgataattggtcaaatcagcagtgatttgtccaatcgatagatattcaggctcagcttcatcttttgattgcttacgaggttcaatccgtctgaatattgctttcatacgggctaatacttcgcgaggactaaatggtttggtcaaatagtcgtcagcacctatttctaggccaatgatccgatccacttggtcatctttagccgtcagcatcaaaatcggtgtttcatttttttcttgacgcagccgctgagtgatctccatgccatccatcgttggaagcatcacatctaaaatgatgaaatcaaatgattgttctaatgctaattctaatccttcgcctccatctgtggcactggttaccttgtagccttctttttccaaattgaacatcaagagcgttacaatagaaggttcatcatcaacaactagtatttttttcattcaaatctcctttaaataggtttcattctgtttatattttagcatagaatcagtacaaagggctattttacaaaagaaataaatggtataataggaaggcactttgctgaatagaaaggaagaacagtcaatgattggaatcagtgcatgtttaggcggtctggcctgtcgctatgatggacagaaaaaagaagtaccagaattgatggaactagttgaaactggagaagctgtcatggtctgtccagaagtgatcggcggattaccaattcctagagatcccgctgaaatcattggtggaaatggattcgatgtgtggaaagatcaagcaaaagtatggacgacaagcggcgaagatgtaacggaagcgtacaaaaatggcgcgatcaaagcctatcaaaaattgcaggaaaaacacattgatctagtcatcatgaaggaaaaaagcccttcatgcggaacccattcgatttatgacgggagtttttccggaataaaaaaaaatggtgccggagtggctactgcttattttattcagcaaaaaatgactgtgctctctgatgaagaatggctgaaaactagaggtgagcagaatggaaatcgaaaagaccaatcgaatgaacgcgctctttgaattttattcgaccttattgacagaaaaacaaatgaactacatggaattatattatgcagatgatttttcattaggtgagatcgcggaagaatacgaagtaagccgacaagcagtatatgacaatatcaagcggacaagcaagatcttggaggattatgaaaaaaaactccatcttttttctaattatattgttcgagaacaggtattggaaaatatgactgcatatattacagataagtacccggaagataaaaaactacttgaatatgtacagcaaattcaagcaatcgaagaataaacaaaaggaatgaagaaaatatggcatttgaaagcttaactgaacgtctccagcaggcgatgggaaaaataagaaaaaaaggaaaagtatcagaagctgacgtaaaagaaatgatgcgggaaatccgccttgccttactagaagccgatgttaacttgcaagtagtcaaagattttactaagcgcgtacgcgaacgtgcggtaggggcagaagtgctggaaagtttatcacctgcacaacaaatcgtaaaaatcgttgatgaagaattgacgatcacacttggttctgaaacagcagagttaaataaatcaccaaaaataccaactgttatcatgatggctggtcttcaaggggcaggtaaaacgacctttactggtaaattagccaattatttaaagaaaaatgaaaatgctcgtccgctcctaatcgcaggggacgtatatcgaccagctgcgatcgaccaattgaaagtattaggtcaacagctagacgttcctgtatttgatatgggaactgaagtcagcccggtagagatcgtccgtcaagggatggagttagcaaaagaaaagaaaaacgactatgtattgatcgatacggcaggacgtctgcatatcgatgaaacattgatggatgagttgaaacaaatcaaagaattgacgcaaccaaatgagattttgcttgttgtcgatgccatgactggtcaagatgccgtcaacgtagctgatagcttcaaccagcaattaggtattacaggggtcgtcatcactaaacttgatggggatactcgaggcggggcagcactatcgatccgctcagtgacaggcgcaccaatcaaattcatcggttctggtgaaaaattgactgacttagaagtattccacccagatcgtatggctagccgtatccttggtatgggggatatgctgacattgattgaaaaagcgcagcaagactatgacgagaaaaaagcggaagaacttgcacagaaaatgcgggaaaattcattcgatttcaatgactttattgaacagcttgatcaagtgatgggtatgggcccactggaagatctaatcaaaatgatcccaggaatgaatcaagtccctggaatcgaaaacgtcaaggtagatccaaaagatgttgaacgcaaaaaagcgatggtttattctatgacgccagcagaaagagcaaatcctgatctgttgaacccaagccgtcgtcgccgaattgctgccggttctggaaacagtgttgttgaagtgaatcgaatgatcaaacaattcaaggaatcaagaaaaatgatgcagcaaatgtccaaaggggatatgaacatcccaggtatggaccaaatgtttggttcaggcgtcaaaggaaaactaggcaaaatggcgatgaatcgaatgatcaagaaaaataagaagaaaaagaaaaaacggaaataagatgaaaaaaacagcttcggtacagactgaaaatgtctactgccggagcttttctatcagcaatttttattctttactaatacaattactctaaacgaagaggtggcacagatgagatgtccgtggagtgaacaaacagaaagtatgcggcaatatcatgatactgtctggggtgttcctgaatatgatgaccaaaagctgttccgaaaattgatgcttgatattaatcaagccggattgagctggcagacgattttaaataaaagtgaagcattcgatgaagcatatgatcgattcgatattaaaaaagtcgcaaattatggagaaacaaaaatcagtgaactaatggaaaacaaaggaattattcgtaaccgaagaaaaatcgaagcagccgtccaaaacgccaaagcagtcttgaaaattcaagaagaaatcggcagtttttcagagtatctttggtcgttttctaatggaaaaatcgttgattcttcttatcattcacaagaagaagtcccaacaacaagtcctctttcagatgaattagcaaaagatctaaagaaaagaggatttaaatttatcggaagcacaacaatctatgcttttttagaagctgtcgggatcatcaatgatcaccttgacagttgtttccgcaaagaagaggtcgtacgtatcggcagaaagggcgaataaagcatgcgaaaatcatattttatggtgctataagtttagatggctatttggcaacgaaaacggatgatcttcaatggctttttgacactccaacaggtaagcaaaccacttatgaagctttttatgaaacaatcgatacgaccatcatgggcagaaaaacttatcaggaagcaaaaaaatatttggagaccgaagcaatttatccagagaaaaagaatttcgttttttccacccacgcacaattacaattgccagatgctgaggtcgtaaacgaagatcctgttgcttttctaaaaaatctacaaatgacagaaggaaaagatatctgggttgtgggtggcggtcgattgatcaaaccgctattggaacatcaaatgattgatgaatggtatatccagattacccctgtattattaggggacgggattcctttattccaaaaaggaacatatgaagcgcgttttgaaatgctagacacgacacgattcggtgaatttatcgaattgcattatgtacgaaagtagaagtaaataaaataaaaaaggcaactatatgcagaaatgtcctgtacatagttgccttttttattaccgttatgctttttactctgttaatttgttagaaaaatctagatacgcatctaaaatcgtttggaagaaacttaatgttccttcaacgatattaccattttcatcaattagattcgcaacgtttccgatatatgcttccggttgctgcaaggttggcacattcaaaaagacaagtgattgtcgtagatggtggtttgcgccaaagccgccgatcccacctggtgatgcagtaacgactaaacctagtttatgatcccaaacactgtgtccataaggtcttgagcctacatctaaagcatttttcaatactgctggcacagaacggttgtattcaggagtaacgaaaacgacaccgtctagtcccctcacttcctcacgaaaacgagtccattcagcaggagcctgttctggagtttcaagatcctcattgtaaaatggcagatcatcgatttttacaaatacactttcgtacccttcaggaagcaatttcgcaaaagcttctgctacttttttgttgtaagaatcttttcttaaactaccaataaaaaatccaattttttttgtcatacgatttttcctccttcaaactatctataacaatcttacaaaaaataagtaactggagcaaataaaaacacttactgacaaaagctacatagaagatagattacttatttttaacaaaaaagaagtctaaaatcttctatttcctaaaaaaaatcgaatttaatcaagctgtaaagaaaaaaagctttacagggtaaaaaaaaactgttacactacatcttgtgaataaaacaatggaggtggaaataaataatggcagttaaaatccgtttaaaacgtatgggttctaaaaagagtccgttttaccgtatcgtcgtagctgattcacgttctcctcgtgatggacgtttcatcgaaactgtaggtacttacaatcctttgaaagaccctgcagaagtagttttaaaagaagacttagttcttgactggttatcaaaaggtgcacaaccttctgacactgtacgtaacatcctttcaaaagaaggcgttatgcaaaaacaccacgaagctaaattctcaaagaaataaggtgaccggatatgaaagatttaagcgacttagtcttaacaatcgttcgtccgctagtcacttatcctgatcaagtcaagttagacgtcgtagagtcgaaagacttttacgagtacaatctaacagtggctcctgaagatattggccgtatcattggaaaacaagggcgtgttgctaaagcaatccgcacaatcgtttacggtgttcggatcaatgcaccgaaaaaagtgcatttgaatatcatcgatgataaggaaaagtaaataaacgtgctgtactcgaattttcgagtgcagcttttttgtttttttattaattgaagaaatgattatttggcaaaacaagcaagaaagcgtatccttataggaggagggagtgaacagccaatgagaaagaaaatgttatttattccatttgctctattgttaagcgcttgtagttcggttactcaagaatcagacaatacacatctatcaagcagtatatctgaaactgttaccagtccagaaaaaagtagtaccaaaacggctaccaccactgaacaaacaatggctacctcaaataatgagaaaaagactgctttagaccagttgaaagaacaacagccaaatgttcccatgcctctagatgtaccagtctcttcaggctatctcaatatcgcagcgacacatacaaagcaaggttattctattttatattacagaacagatcgtcccctcgggttgaatgctgacgaattgaatcaagaaacgcctattgcaacctatctatatcaatatgggtttgcttctagtcaagaaacaatccaagttttgcagccctttgagatcgacacaaatggtcagcaagtggacttaggttctcgaatcacagggtatcagcaaggtgcagcagattcaagttttcttgaatggcaagaaggaaactggcgtattcgaatccgtgggaataatatagaaggccaagatcccttactattagctaaagaaatcgtagcttatttggaagaaaacagtctaccagcacctgaacaatttggtaaaattactgttgatatgggtgatacgacgaatcgagccgtagaagtaagctggcaagaaccgaaaaatgcctatacgatcactcatcaagatcctatgtctgcgttgaagatggcagtttctatgaagaggttgtgaaatcagcgcgctgatctgagcccatcatttaactccaagtcacaggaagtaatcaaaaatagcacgccgcatttttgcataattttggcttaataccttaaaagaaaactagaattgcctcttcacacatgctaaaataaaacagacaaaaaagaaatggggatataagttgactgaatacttgaatgtaggaaaaatcgtaaacacacaaggtatcaaaggcgaagtccgtgttatctcaacaacggatttcccagaagaacgttacaaaaaaggaacggtgttaacactattccaagacggaaaagcacctgtggaattaacagtcaaaagtcatcgcaaacataaaaattttgacttattgagttttgaaggacatccttctatcaatgatgtggaaaaatatcgggatggcatattaaaagtgtcaaaagacaactctgtagatctagctgaaaatgaattctattaccatgagatcatcggtctgcatgtattagaagatggaactgagttaggtaaagtaaaagaaatcttgtcaccaggtgccaatgatgtttgggtcgttcaacgtccgaaaaaagctgatatattgcttccatatatcgcttctgtcgtcaaagaagtcgatttagaagctggagtggtccgtgtagaaattccagaaggactgattgacgatgaagattgatgtattgactttatttccaagaatgtttgaaggtcctatgggggaatccatcatcggtaaggctgtagataaaggattattagatatcaatatctctaacttccgcgattattcagataacaaacatcagacagtagatgattatccatacggcggtggagcaggtatgctgctcaaagtccagcccatctatgataacatccaagccattgaaaaagctgcaccggatgtcaaaaaaagagtaattcttcttgacccagctggtaaacgattcgatcagaaaatggcagaagaattttcacaagaagaacacttagtattcatttgtggtcattatgagggatatgatgaacgtatccgcacattagtgacagatgaagtttccttaggagattatgtccttactgggggagaattaggtgcgatggtcatgatcgatgcaacagttcggcttttgccagatgtgttagggaatcagacttcagctcaaacggattcttattcaaccggtttattggaacatccccaatatactcgcccggcagaatataaagggatgaaagtaccagaagtattgacaaatggaaatcataaattgattgaagaatggcaattaaaagaatcactaagaaggacctatcaacgtcggcctgatcttttggaaacacttgaatggacacctcaaatgacgaaatttttagaagaaatcaagaaagaagaacaagaaaaaacagcagatgaagccaagtgactttttctaaaatattctttacagtaggttgataatatgttagtattttatggtgagtgcaaaagcacttaactattacgatattccgctgtgagaaaagctcataagaatatttggaataaggagaagaaaaccatgaatccattaatcgaagaattaacaaaagaacaattacgttctgacatcccagcgttccgccctggtgacactgtgcgtgttcacgcaaaagttgttgaaggtactcgtgaacgtatccagttatttgaaggtgttgttatcaaacgccgcggtgctggaatcagcgaaacttatacagtacgtaaagtttctaacggagtgggcgttgaacgtacattcccattgcatacaccacgtgttgcaaaaatcgaagtagttcgctacggtaaagtacgtcgtgcaaaattgtactacctacgtgcattacacggaaaagctgctcgcatcaaagaaatccgtcgttaatcatcgttatcagactgagaaagaacccttggtattcaagggttctttttttgttatctgtttttttatattaacgatttcgatttggtacatttttgattaataaaaaggggcaaaaaaggggcaaaaaaggggcaacaagttacagtttttctatatcttctttcaatttttcttttactccttttgtcacatgcaaataaatcttttctgtgatatcactattttcgtgaccaacgcgatcctgaatagcatacagaggagtttctagttccgctaattttgaaatatgggtatgtctaaaaatatgtgaactaagttttttatcaatcttcatgtcagctttatgatttctcaaataggtgttaattgctgttagttggaaaggagttcctttcgttgtttgaaatagaaattggccattcggatttaattctagaagctcatggtaaatagctatcgctttttttggtaaatcaatttctcgcattccagcagcagtttttgtagaatcagattttttcatatcagctattgaacgttctctatacatcatcgtcccatttataactactgatgcgttattattggtaatgtgtacatcgtctttgcttaatgcgattgcttcaccaggcctcatcccagtcaaatatagccactggaaaaggagagaatatcgtttattgtgtgaagttgtgaaatctactagtctattatattcatcatcttctaaaaatttatctttaatttttatcgtttttgactctcttttataatcaataactacttcgtcgataggatttttttctacataaccttttttcatagcatatgaaaaaagaagattcaatttggatttaattacactgacgtacttatttgacaagtcatctttatatatcatgtcttcaaaaatattattcaaatctattgtattaataccagaaacgatgtaagtctcaggtatcttcttctttatagtgtttaatatattattcgtaggataatatgtagattccttaacttgtcttttgtatataactaaccattcttcaacaagctcatgaaatgttagatcaggcttctgaagtgttttttcgtttaattttatatcaatttttttatttaactctagcaatgccactttctgagtttctcgagatttatttttataagtaatgctcactttttttctttttctagtttttggatcaatatatcgctcattatatttatatactttttttccgtttttatcagttttagtttcgatccacattgttttcatctcctatttgttgctataataggaatagataagtaagccgattatagcaggtttatttttcatcacgtccacaaactttggcgagggagggggcgtgtttttatttatgaattattattcgctccaagttgctggaccgtatgcgattgtataaggtgcatttccttttgctccaaaatacataactactgtagctttttttccacccgctatttcattagggatgttgttagaataagtatttgcatctagtcttcctaattcatcgtttccatcatatatgtcaaatgtatgtgcgttaaaagaaataggtgagttagtcttattttcaataatagctgttacaacaacagggtgttcaccgtctactggatccatcaaactaatactgtcatctgcttttacttctgtaactgttattgattctcctgaggtaaactcaactgcctgtcccatttttacatttccgcttgctgaatcagaattattctcggaactatcctgtgttgaagaattttcaattaaattttttaactctgttactcttttgtttaattcttcattttcggacttaagatccgaaacttcttttcttaaactagattctgtagtgctgttagctttagcagatgtggcctctttatttgttgaacaggcccccaaaagtacgctagtaaataccaaacctaaaatcacttttttcattttttattctccgtttctatgatattatttttatgtaggatcttagaaacgagattttagtccgtgttgcagcacgggcttttttctttataacttttttagagattataggcaaaatagtagggcataaaaatatattattgaattccgtatttagaaaatcctaattgaacttcaccggaagtcttttgctgtgttgtacgcaatgcttcttcttcagacattccattctgtactttccatgcaacaggcgacatcccgtatttgttaacaaaatcagtaagtgataaagtgtcagcgtcttgttgagcgcttgtttgttgggcttctggattttgttgagatgcagcttgttgttctttctgatcttgactgataatattgccagcatcatctgtagtcaatccattttcataaaggaccacgccgaaagcttcccactctttgttggaccaatttgcacgatcagctggagttgactgtaaagtgcgttgtttcatctgttcatatgtttcttcttgaggtgcggtttggattgtatcctgactggagcttataactgttgggctaggttccgccgtagcttggttggagcttgtaactgttgaactagaatctgtcttagatgtagatttgctagtagaggaactggtttcagttgcttcttttgttttacttacttttgtttcttggttagaagtggcatctgttgattcagcttttttattatttgaacaagctgaaagtagcagagcagtacttaacaacaacataacgctaacttttttcattttataattcctctttctcgttgtaatatgtgtgctaacacgggcttttttatataagaaaacgataagcgctttctggaagcccgtaaagattctttaattcctcgatttttttaggatattgatcattatcttctttataaagagaaacaatgagattagcagcaaagcaattagcttcgctttcagatttgcttctagatgttcttgttgatacataatagctggataagccacgatgaaaaatagcgtgacctaattcgtgagcgcaaatgtagaatctttcctcagagtctcgcagttcatcatttaaaaagattatcgcacgatctctaatttcttgaaactgccccttgggattctcgataaaaggaacgtattgaattttaatgaccatcttttcacaaatataaaaaggattagcggactggtatttccgcttcaactcctcgactaaattaatcgtatccatctccataagctcacatctttttgcctttttctttgtcttctttcacaatatcccagaaagtcgctatcaggatatcttttacgcgctgtatttgttcgggtgtcaatgtttccccaccataagacatattaacatttgagtctagtagtttatcaagttcaaccacttcctcttttgtagcccatttgggaacattattatttcccaataagtaatcagttgtgacaccaaaataatcagcaactttctttaagttctcagattttggcgaggctttatcccatcttcttatttgtccattagagatgcccacctgtctttctacttctgctatagtcacatgcttttcgtctgctaattctttaatcttagtaactaaactcattattatcaacctttcaaagctgaaaagaaaataaatagcttaaaagttatatttttggttgaaaattagtttttaagctagtatatttaattcgtaagctaaattgttagctaaataagagcaacaaaaaactctactaatttaaaacattctctcggtcgccaaacttagaaatgttattttagaggctttttataagtcttatttaactatgtattcataatagcttaaaagctaatgggtgtcaacgatttagctaattttttagcttacaaattatttgtttagaaaggagctatttttatgtctgagaatttagacttaaaaattcgagcggagatgagaaaaagaagaatgactttcaaagaactagctgcgcttatcggtatttcaggagcttatttatcagatattctaaacggcaatcgtgatggaaagaaagcacaacagcatatcgaaacagtgaaaaaaatattggacatctgataggggggtaggcgatgacaaaactaaaaaaacaagattttgtaaaaaaatacaattattctccatctacttatcaacgtcgcatgtcggaactaaaaaatacagcaattttctcagcggcgtatgaacgggtcacaggacaagaagtttggatcaatacagaattatacgataaatttttgtctttcaaatcctataacaggttacgcacaagaaaggtaacgcctaaagaatttatcgagaagcatttagttgatttataaaaaacagaacattttgagaggtgaaggttaatgggtaaattcaacagagcattagtattcagcgcaccgctaatcgtctatgctttaggtctttggggaagcagacaagcgttgataggaacgattgtttacatggtctggatttttatggtgcttgatgaagctgggtacagagcaaaaaaaaccagtcgggagggactgactaaaaatgaatagaaaagagaaactagaattagtgaatggatatttagttttaatagataaaataaataactataaaatattataactattaaaaataactattttcattataattacacacaaaaaagagcgtgggacaaaagtaaagaacacttttgtctcacgctctaaacacgtataaacggcggaagcagaagcaactccttcggaaataagctgaaattcacaaaaatttgaaaagcaattttcgtgaatttcttcttatttcttggagttaaacgcttctgttccagcctctttttatctgtctttcactaatgatcagttgtagataagcaagttgctttttcttacatcataccgcccatcattgatggatccattgcaggagctgctggcgctgctggttctggtttatctgcaacgactgcttctgtcgttaataacaaggcagaaacggaagcggcattttgcaaggcagaacgtgttactttagttgggtctacgatacctgcttcaaccatgtttacccattctccagtagcagcattgaaaccagtgcctagttccacgttcttcaatttatcaacaatcactgatccttcataaccagcgttttcagcgatttgacgaattggttcttctaaagcacgaacaacgatcttgatacctgttgccacgtctccttctgcttctacagcagaaactttgctgataacgttcactagagctgtaccaccacctgagaccattccttcttctactgcggcacgtgtagcattcaatgcatcttcaatgcgtaattttaattctttcaattctgtttcagtagctgcaccaactttaacaacagctacaccacctgctaatttagctaagcgttcttgtaatttttcgcggtcaaaatcagaagttgtttcagcaatttggtttttgatcaattgcacacgagcttcgattgcttctttttctccagaaccttctacgatcgttgtattgtctttatctacaacaactttagaagcatttcctaagttttcgattgttgcatctttcaattctaaacctagatcgtcagtaattactgtaccacctgtcaaaatagcgatatcttcaagcattgctttacgacgatcgccgaaaccaggagcttttacagctactacgttgaatgttccacggattttgttcaatacaagagttggcaatgcttcaccatctacatcgtcagcaataattaacaatggacgtgattgttgcaagatttgttctaacaatggcagaatatcttggatgttagagatttttttgtctgtgatcaagatatatggattttctagaacagcttccattttgtcgttatctgttaccatatattgtgataagtaaccacgatcaaactgcataccttctacaacatctagttctgtttcgatcccttttgattcttcgattgtgatgacaccgtcgtttccaactttttccattgcatcagcaatcaaatgtccaactttatcagaacccgaagaaacagctgctacttgtgcaatggcttcttttgaatcaacaacagttgagatattatgcaattcttcgactgctgcttttgttgccaattcgatcccgcgacgaatgcctagaggattagcacctgcagttacgttttttaaaccttcgcgaacgattgcttgtgtcagaacagttgctgtcgttgtaccgtctcctgcaatatcatttgtttttgatgctacttctgatacaagttttgcacccatgttttcaaaatgatcttctaattcgatttcttttgcgatcgtcacaccatcatttgtgatcaatggagagccgtaagatttttctagtacgacatttcggcctttaggtcctaatgttactttcactgtatctgctaatttatctaccccgcgtaacatagctgcgcgtgcgtcttctgcaaatttcaattcttttgccatgattgattcacctcattgattatttttgattatttttttatcttcaaaatttactcaacaatcgccatgatatcttttcctgcgacgatcagatattcttttccttcgtattttacttctgtaccggcgtatttttcgaacataacttggtcgcctgcttttacagcggcaggaactttttcaccgttttctaacaaacggccttcaccgactgcaacaactgtcccagtttggggtttctctttagcagcagaagctaaaacgattcctccgacagttttttcttcttcttttgcgacttcgataatgacgcgatcacctaatggttttaacacgataaatccctccgataactctttttttaatctgttagcactcttaaccttcgagtgctaacctacatttttaataatactcattctccctcttttttgcaagcttttaaatcaaagaaaagaaattttattctgacagctgcttattgaaattatgatataattgaaatcaatcgatataagcttgccttgcatgcttgttatcccttaaaaggaggaattacatgtctttaaaaaaatatagcttcctcagcattttttgctatggtttaatttttatctcacccttgatcctagcttcgataggacttgtaaaatctacgtctgaattgatcacagcaactgcagtcatgtatatactaggcgccgttgtcctagctattttttattttaagcaacgtgaacccttagcgatcgaatcagcggtaaaaaaagcttctgctccaaagattgttatttatggattggttggaatctttgtcgcattgattctgcaaagcatcgctgtcatgttagaatctgtattgttttgcgaagcaaccccttccgagaatacacaaaatatcatccagatgatcatggaagcacccgcttttattttggcgacaactgttgctggacccatcatggaagagttcgtattccgccgcagtatactggggatcatcagtcgatattcaaatttttgggtcggagcagtgatcagctctttgctgtttgcgtttgctcataatgatggtcatctgctaatctactttttcctaggtttcttcttcagcctagagtacaaagcaactggtcggatctggacatcgatgatcacacacgtaggaatgaacacattagttgttcttgttcaattagctgtccaaaaagggctagtataaacatgactataaatactcctgtcatcctagattggtgattttcccaatctaaagcgacaggagtatttttgttttttagtcgttcatcttttctgctgctccatcattttttgtctgtctttcctttttgcagtttgcagaatctatttttttcaaaaatgggaaataaatgaaaaaactaattgacaacacgataccttgtaaaatcgctgcaggcactccgcctactaagaaacccgagaggatcggcggtgttgtccaagggacttggactgctgtaaataaaggaacgaatccaaaatataaagcggaataggtaatcaatcctgaaacgaccggtgcgaaaataaaaggaacagccatcatcgggttcatcacgatcggtgtggaaaaaataatcgattcattgatgttgaaaaaggctggtaaaagagcaatatttcctaattctctgtatttcttcgatttcgcaaaaaccgtcataaaaaatacagcccctaacgtcaacccagcacccgtaaccgtcatgaactgatcgagaaattgctgagtaacgatatgtccgccatttgccaccgtcaactcttgtcctgaggctaagatttctgcatttgctaatgaattcgcttgcaagatgggactaaccaacccattgaccatcgcagatccatgaagaccaaataaccataaaaacggaacaaaaaaacctaataaaagcacaccaaacaacgtgtctatcgacgattgaatgggaagctggacatatgtccatattccttgaacaacagtcattctgaacaactgttgaaaaaccgctgaaccgataagcgtaaaagtgactataacaatgattggaatcaatgaagtaaaagactgccaaacattttcaggtatcttctctctttgcttccaccctttcgcaagtcttactaaacgtgcatagccccatccgatgatgagcccagttgtaactgctcctagtatcccttcagcacctgtccagacagtatctatctgagtatttagtggctgaataagcagtagataagcagataaggctgttatgccgactggtaagcgatcgatatcttcttcttttgcataagcgtatgcaatggcaaaaacgatccaaaaggctatcacatcaaatgtagcctggtatacttgtgtaaaatacatagaaaatcctgctttgtctatccactgagcgatgtaatccacaggaaaatgagcaaataagaaaaacagcgagccaacaataattattgggatcgtgtaagtcattccattacgcaaagcagttaagggtctaagattcacaacagatgttatcattggtaaaaaggcacgatctaaccactctttcatttcttatctccttcaacttctatttttatcaatcagttttcttaatttaactatacccaatgatcacgaaccatgaaaggaatgcgcactgagcttttcaaaaatcggattctttgacgaatattcagcaactgcttacaatggacaggaataaaaaaggaggttttttatgaaaattgcactcattggagctactggtcatgcaggttcatttattttagacgaagcattgtccagagatttagacgtgacggcaatcgtgcgtcatccagaaaaattgccatcagatgttccgtttatacaaaaggatttatttgagttgacaactactgatcttgcatcttttgatgttgtcgttgatgctttcaacgctcccaaaggaaaagaagaaatgcatcaaacttctttgtcccatttgattgagatgcttgaaggaaccgatacacgcttaattgtcgttgggggtgcctcttcgttattcttagatacagaaaagacgactcgtatgattgaccaagtacctaaaaatgcacccttctatccaacagctttcaatatgtacgaaggattgttaaaattgaaacaatctaaaaatctacattggacttatatcagtccagcttctttatttgatccacatggcaaacgtacaggtacttatttgttaagtgatgattatttacaaagaaacgctgctggcgacagtacgatcagcatggcagattacgcgattgcattagtagatgagatactggatgagaaacatgaaaagcagcacatcagtgtagtcagtcgataatacggttatttttttaatatgctaaaaaaataaaaatagaagataaaaccaaccctgattgattttatcttctgctttttatatttttattgattgaactgtttaaatcgaaaatagctcagttgcttcatctggatctgtatcatagatttcaaaatcatgtccaacgccaaaatctttttctttcaaaacattttccattgttaaatgagcaagttctttcatattgttttccttgctaagatggccaagatagattcgtttggtccgattaccgatcacatcagtcatgacaagtgcaccgtcttcgttggaaagatgtcctctatctcctaaaatacgctgttttaaattccacggataaggtcccatgcgtaacatctcaagatcatgattactttccatcaaataaccatcggcattttcaatgacacctcgcatataatcactgcaatatccggtgtccgtcaacatgacgaatgaccgattttctttatggaaacgataaaattgcggagccgctgcgtcatgggagacgccgaaactctcaatatcgatatcgccgaatgttctgactttccccatctcaaatagatgtttttgttccactggtacatttccaatcagtggttccatcgcttcccaagtctgctgattggcaaaaacatccaaatgatacttacgagccaagacacccacgccatgtatatgatctcgatgttcatgcgtcacaagtattccatctaattggtccggtgtccgatcaatttgagccatcaaggaagtgatttttttaccgctaagtcctgcatcgaccaaaagccgttttttttcactttcgatataaagtgaattacccgaacttccacttgctaggatactgattttaaaagctggtttttcttcagccatttgactcctacttcccttcttactttgtaaacttttttcattatactcgcttttttattgatcttccacttttggtacagtattgtttgtcacgatcgtattgctgaaagcgttgacgctctcgatttggaccactttatcgcttgtttcgatcgctacatgccaaacaggaacatacacatttttttcccggactttcagaatacaggaataagctagttgacgccataaaatttttgatcctcttggtattttgttattgatgtacaatgtattgattgcttcctcttccgtatacagttccgtcttttcgcgcagctgctcgatatcagataaatgcgtctgcatgtatttcgtgatgctataatcattatcgtttttttctaaagaaagaacgatttttgctgtatcatcattgaatgggatgccttcatactcttggcttgcttggatttctagtggttcttcttctaaatgagaaaagtttttcatgtacacataatcattaccgaataaaatattgtctttgttagataaaaaatcttccaaggaactactaattttatctggatcgatcacgttcttttcagcatctgaactggataaagatttcgtcaaaacatcaccgtctaaaaacacaccacttgccagcaagccgcttttaccagccttgcgataattcgctaatgaagtgctaagattggtctgctccgcgctaagataatagccttgcttgttctcagacgaaatcttccccgtgtaagtgatatcgtcgctagccagacgttgttggattgattcagtctgattagagcgaatgacattgttttcttggtataccgcgtcatgataactgctgaataaaaacacattcaaccctaaaaaagcgacgaaaaatatccattcgatttttttgaaatccaattaattcgcctccaatccaggtaatttttccagaaggtcgttagctgaataccagttatctttatatttcacataccattcaggtaagagatcaacgacacgattcgtttctttgacattttgccatgtatatccaacgatcactgaaccaatcttgttgctatctgctcccttagcttttaactgctggatgatttcattcgtacttgcaagttctacttcttcgtctgaaggtatcggcacttgaatcgtattcaaactggtttggatattcacttgcacagaaccattcgtttcaccgccaacttccacaccaatctgtcctctgctgtctgtcccaaaaaccgggaagccttccacgaatatccgataatcgatcgtattgtcactgcggtcaaaatatctgaggttccctaaagaactgcctaatttgctaatataggggaaactttcagaaaatacactagcattttcttttttctctggcagctctccacgaaaatcaactacttgcgtttccgaatggatagacattgtttcattcccaccgtaaaaaatcaattcattgctttcatcattattcttcacgctatctggtttctggaaaaaagcatttctaaaaagtgtatagggttgctgtgacaggatataactatactttttcagtttgatcgaatgtttcgtagcatattgcgtgtcgatcgtcgatggttctgttgtcatttctgtccattttgtgtcttttgctgttaattctttattgatatctgtccaattcaacgaaatattcgcttcatatacgagatggttcgaataattcaaaaatcggatttttttatttccttgatcgaattgtattctagtaaaatacatattttcgctttcttttgccaagttcgacacatctaaatctaaatcaaatgcttccttgtattctcttagcaaaaaaggcgcattataggccaactcaaaaccagagttcagattttccacctgttcaaactgtgatttgtctcctgaaactacttcagaaagctttccaaatcttgctttatcgatgatcaattgcaatcggtacacgagattttcactgttggtttcttggatcgttcccgaatggtgccatgtaacatgaagcggaagaaagacttcggaagtttttcgattgctttgagactcgatcatttgagtgtttgtctcatctacgttgattgaactttttcctgctgggctcagccagattgcataagagaagtatatgcttaacgcaaccatcaaaatgagtcctatacgaacgactttttcagagattctcattcccaccattcctcctcataaggttcatatggcagcgagatataaaaagtcgacccttttccttccttgctctctgcccaaatagcgcctcgatgcgccttaatcacttctctagaaatagctaatccaagtcctgtcccaccttgtgctcttgcacgtgctttatctactcgatagaaccgctcgaacactcggttcagatcttttttaggaatccccaatccttgatcggtgatacttaaaatcacgttattatgcgtttctaataagcgacaagtaatcgttcccccatctggtgaatacttgattgcgttattcatgatattatcgactacttggatgattttatctgtatctacttcgacccaaagatctctttgcgtgaattcacgacggatcttataatttttttcctgatttcctaccatcatatcaaaccggtcaagaacaaaattcactaactcgttgaaattgacatattctaattgaagctgggtattacctgtatccatgcgagacagatttaagaggtcattaatcattcgaatcattcggtctgtttcatctagcgttaccttcaaaaaatttggtgctacttcctcgtctttccacgcaccttcgctcaatgcttcgatataactacgcatacttgtcaacggtgtacgaagttcatgggaaacattagagacgaattcacgacgttcccgttctgttttttcttgttctgtcacatcatgcaagacagctactaatccgctgataaaacctgattcgcgacggatcatagaaaagtctactcgcaagatcatctgatcactttccaatgtactggttgaacggtcaagtaccatttcgtttggatcttctaataatttccgcaacgtatattcttcttcgatatctaaaagtgtcaaaatcgattgtccgattgcttcctcgtttttgatatctagcaaggaaacagccatatcattgatcgtaatgactttacccctgcgatctgtcgcaatgacgccgtctgtcatatgggatagcacgctatccaaacgattgcgttcagcttccattgtatcttgagcttcttcaatacgttcagctaactgattgaaggtatcagccagctgtccaagttcatcttgtccatgcactttgactttccgactgtagtctcctctagcgattcgaatggcttgttctctcatttcaccgatcggctgtgtaatcgaacgagcaactaaaacagatacgatcattgaaataaatgccgcaattagtgaggcagtaaagaaaatgactgctgtgttattgatttccgaatatttttgttcgatattacttttgacgtaaagagccccgataacggcatcgccggtcggggacaggatcggttgaacattgatattcactcgcttatcgtcgttatctaaagcaacataacgtttagtcgtgaaatcattgatatcaacataatcatttttctttcccacagcgctttgttcattgacgtcggttgttcctcggatgatccctttttcgtcaacgacccgtatttcgatgatatcgctagtcgcactgttttcaataaatcttttgatattcgcatttacctcttcatcatctacattatcttttcgattcaattccgggctgattgttgttgctaatgattccaccgtttgattcatatctttaataaatgtattgatcgtggaacgttctaaaccacgtataaagtaggcaccaataatttcgatcgagatcaataaaatcagaataaaggtaatagcgatcttaaaattgactgatcgaaaaaagcggacttttcttttcatccaattactcctgttctgggttacgcaaatagtaaccgacaccacgacgtgtcactaaataatttggatggcttggattatcttcgatcttttcacgcaaacgacgtacagttacatccactgttcgtacatctccaaaataatcataaccccaaaccgtttgtaataaatgttctcttgtcatcacttgtccaaggtgcttcgccaagtaaaagagtagttcgaattcacgatgtgttaactcgattgtttctcctcgtttcgtcaccatgtaagcttctggatggatcgtcaaatcaccaatcgtcaattccgcaggtgctgcctcttctggttccttcgcagccgtggcaccgcgacgaagatttgctttgacacgtgcaactaattctcggttggaaaatggcttggtcacgtaatcatcggcgcctaactctaagcctaggactttatcaatttcagaatctttggctgttaccataatgatcggcatatcataagttttgcgtacctcacgagcaacttctaagccgtccattttaggtagcatcaaatcaagtaaaatcaaatcaggttctacctcagcaactttttccaaggcttcttccccatcatatgcagtataaacatcatagccttctttggctaaattgaatttgacgatatccgaaatcggcttctcatcatcgacaactaaaacttttttcataaagagccacctcttatatattattgtcataccttctcattataccgtatttctgcttttgtttcatctttgcctataaaacaaaagagaaaattaaaatgaaagtgcaaaatactttattattttttgttctaacttcaataaaaaaggaaaacactgattttcacctcagtgtttccttttttttgatttatccttctaaaacttgtacaccgacacccaataatcccggaccagtgtggactactaatgccggagaaatctggccaaagtagatttggtttgcttgtgggaactctcttttaagtctcgcttccatttcaattgcttcttctttcgcatccccatgggcaacagctaagttgaagacctttgcattaccgattttttctttgacgtaagcaaccgttttatccaaactttttttacgtcccctagcttttcctactgtgtaataaattccttcttcattacatgagatgattgggttaagctttaaagcggttcctacaatagaagcaactaaaccgatccgtccacctttttgaagatattccaatgtcgcaacattaaagaaaacttttgttctttcgactaactcattcagattactgatcagttgatcccattctactccttcttccagccattttgctgcttggatcgcagaaaaacctgcaccaataccaatatttttcgtatctagtacatatgcttccaattcttcttgctgttgtgcaattaaacgaaccacattatatgtcccgctcaatccactggaaattgttaccgcaagtaccttttcataaccgtcttttttgatttgctcaaagatttctgtgatcgactcaccatccggcaaagatgtaccagggatttcctctggcaaacgttgatagatctcttcaggggtaatgtcaattttatctgtatatacctgatctttataaataattttcaatgggatcatatacatctcgtatttttttatcaattcttctggcacatccgtacctgaatctactaaaattgcgattttattgtttttcatttgttttctcctcttttaaatattcggtttctagaacaatcgttttttccgcaagaagtttcattgcaaacgataaagttgccgctcttacagcaatatattctacaggggttgcctggtcgaatttttgcggatgagatttaccttgtgctaattggctgaccatccacacagctgcttcttgttcatcgcaaaatagattataggcttcacgaattcctactgtttttccttggaacaatatcccttctttgatttcaggaatagtcaatacttgtttcaacgtagtgattgcaagtaaaaatgctacgtgttctttgttatatctttttttaactggtgctggtatcaaacctagtttaacgtaattgtttaccatagaagaggtaagcaatggatgcttttctccttgtatcacaggtgaaagataacgatcaactaacgttctgacttggtccatataaagttctaagtcagggagttcttcccagtgaggcagacggaatgtttctagttccttcccccactccattaattgctgacgcattttttccatcataaccgctccttttttcatttcataaacatgatatcagacttatgataaacattcaatctagtttctttaactaggtgatttaattagcgggatttcatgaaaacaaaaaacaagaaggctaagccttcttgtcttttatcgttaagaacaggagacccgccggggagacggcgggaaaggagtaaaaaatgaaaaaagtgttagggtttgttctcttgcaagaactttgtttgttggtatgcttatataatagcgagcaaatgtgaataatctatgaatgatttcctataaggaagtaaagatttttctgattttctttaaatgtagtcttgcattttaaaattcttagtgctactattattaagtactttttgtacgggccgttagctcagttggtagagcagctgactcttaatcagcgggtcgcgggttcgatcccctcacggcccattgggtgccaaacccacgtcaccagtacattcttggctacttaggtagtttcgaaaagagtgtacgtggtggcattttttataccttcgggtatgaaattcgggtatgcattttagtattttattttttaataacattcgaaccaatcaataaacctttgggttatcacaatatgtacgcccctcaaaattgaggggatattttttaccatttaggaatcgtcaatacgtattcaggaaaatctattttaaggtttacaaaaagaacattcgttcgtatactctttttgaggtgaatattatgttaatggaaggaaaaacacaattatggtttaaatttgatccttcgaatagatttgtcaaggatttttataaggtgtgggattcagaagttttctttttggcaatcgaagatagcttattaatcaatctctactattctaataagaactatttcaaaattcctgctgcgaaaactagaatgaagaaggatgtatactttttgtttgatatcgtgactgacgtgccagacgcacgaagcgatcatcggcgttatgactatataaagtatactttcgttgatccagaaagatacaaagattaaagtaggctacctaaaaaggtagcccggaacggattttatcaccatacttatgaaaggagatatttttaagttggtattaagattgtgtaatatgatgatatctatattttatagtatcagtgctataaaatcaaaaataagtcactaattaactaccactccaattgtaagccttttttcttactttttttcaaaaatatggtatgctttttaatggcttcaaatataaaagagtttaaagcgtaacacacttatgggggagtggtttttggggaacgctttaaactcttctttattattatctcacaatttaacctaaatgtctttccatttaaaaatcaaagtaaaacttttcaaatatacagaagtataactatgtgaaatatcctttcattaatccataaaagaatacataaaaaagccactcatttgagtggcaatgaagaaaagctttagcttgtataatactcttcaaaaaaattctaacacataacgattcaaatggctacattaaggtaccctttaggactcgaacctacgaccggacggttatgagccgtctgctctaaccaactgagctaagagtacgagaagccaccacaactcctgctaacaaaaagaatggacatagactagataataatgggtttattcttcatgttgtgatgaccaatttattattgcataaataatagtaaaaatataaaaaaactttacgtggattgcactaaatggtaatattttagttggttagaatactttgtaataatggcatgaaatttaatattataaaaatcaaaacatcatcgaacgaaagttccctattgattaatttttaaagcaatgaaataataaaattaacaacaaggagaataaatcttgttaagttacaatgaatgttatcatggaactacggtagacaactataatcttatacaaacacaaaaaaaattcacttataccaaacgagaaaaccactggcttggacagggtgtatatttttttatagaagataaagaaaaagctaggtggtttacatcagtggatcgaagaaataaggacaaaaataaatgtatcatacagattagtgttaatatagaaactgataaacttttaaacttggacatagaagaagatagaaagcttctaaatgattttgctagagatctaaaaaaagaaggtcttcaagtaaaaaaaattaacggaacttctgatagtagagaattaagatgtttattaatagatgtgtatgtaaaatatttcagtaaacaagcagttaaatatacatttacagacgataaaatacagtataagaatttaaataaagatgatacttatccagataaaatccaaaataatgggatacaattaaacattatagatcaatctattattaattttgataatttaagtgtagaatatatttagaaagggcgtgatatgtatgtcattaaatagagaattactaaaaaatattttcaatgatatgggatacgaagttgaatttgattcaaccactccgggcttatgtgtagaagaattagtcgtagaatggacatccaatttatatttaaatgatattgaagaatctaaagtaaccaaagttaaaacttcatctataaaaaaattgccaatcacagaaagtttatcagcaagaagttatacttctaattacaaatcaaaatcaagtcaaagtattctttattctgattctcgggggttagttgcttaatgactagtatcagatttgaagattattctatcaataaattaaagtatgaactaaatccacactttaatccagaaacaactaaaattgatattacacctaccttggattttggaattaaaatttctaaaatttcatctgagatttatactaagttaggaattacattaggaaatttagaatctgaagatgctggatttatactttctattgaaatagtaggtacatttacgtacgatgaagatgaaatcaatagttatggaattgaatttgaaacttttataaaggagagtactatatctatcctgtggtcatttatacggcctacagtatctgatataatttcccgcggaaataagtttcctaactatatccttcctgtagtaaatgttgcgaaattagttaaagaaaataatattcaaattgaatatgaaaatgaagagtaagatcatttcactaaaaatgatcttatttttttattatacgttatattatatgtactgcccctcatcgaggggcttttttatcgttgtggaatatttaaataccaacgcttgtcatgaaaatcttgtgctccgccttgcgtgttacctttcggatcattcgtcgcacgcatcatgacatagactttcttattaggaaaattacgcatgttgaacgatacatgataaccaacgtttccataagtactataagattggtttacatctggacgtgaaacgccattagcatttactcgtgctagttctttcccagtattgtaatccatgatgaagatatactcatattggtagtcagcaatgtgccatccagccacatgcaagtttgcgttttcgatttctccgaactgatcaatgtgggcgtaattcgttccatctgtcagcgtagaatttgccgcacctgctctagttggatcaatgacaggcttgttttcagaagtcgttggattttcatcggtaaatccatgcgcaatatcataagctagtttctctttgctaactcccatttttgacagatatccataagggtcggtgtgatctccaccataagtgttcgttacccataaatgtgatttaacacctttatttggatatggagtatctaacgtcattggaatattaaactgtttacagtagtcacgaatcaaatcaacgtaagctcgataattcttttcaaacaagccacgatcgtaggtatgctgtaattcaatttgtgccggagcatatggattcgcattcagtgcaccccaagaaacatagcctggttctcctactcggtaaacaatccctccgtctccaacaacatcagttgtataaggcctaataccattataattattcttcatattagctgctacattacgcgcaggagcaagtgtcgcagtttcatggatgagaatataattttgataagctaatcgagaatcgccctggttagatgctaagttaaactcattattaatcgtgtaggcaaatccatttactggcaacaaaaaaagagccgttaacaggctcatcacagtaatagtaattttctttttcatttgtttcctcctatttttttaaattataagccgacacaccagtgataacgcctaaaaatgttgctactgcattgatagtgagtactgtcatatctgttccattccatccatatgctttgcctaacatggctactaaagcagatgcagctggtaatactgttaaaaccgtccatttaatgacttgataatacttatcgggtaaaatcatttcttctcacctcctttacaatttagtcaagaaatagccaatgattgtaatgcctaagccaatcatatagccccaagcccatttattattgttcttcatttccttgatgtcttctgcattgtttagtgctactgaataggctttatctgccaaatcttttgcactatcagccttttctctaagtgattcgtagttgtctaattttgtttcaattcttactaatctctccacaacgtcttggagcgcttcttctttcatgttccaccaactttccaacaaaaaaacgcatcacttaagatgcgctctcttctttgctaataattttatctgcttcttcgtctgtaatacatagtggaacgaatagacgaacttgatcgtcagtaaaacagccccaatcatacatcattttcacatcgctaaaactaaacatactactcacctccctttgaagctggatttaattgctctttaatttctgcaatatccttgctgttttgaatcgaagcaagcatcatttttgaattgatttgtgctaaaccatccgctttttctttcaatgcagtattttcctgtttaattgctacatcgcttagcatgagtttggcgttgagctgttttaaatcgccgttctcgtgttccagtgcctcgtacatcgctttgagattgtttaaatcgttgtgatccagtgtgttcgctaaaacaatccattggttcagtttaggatcaaacatctgatcagcaatcgttagcggttcgccatcagcacgaatcccttcaagcggcggctgatccgtgtaaggaacggatacaagcatatcgtccaacacttttcctgcatactctccgccagtacgtccatatttccaaatgtttttcatttatttccctcctactttgtttctggataactatcggctgttcgccattctcctgaaatataatgattccctactcgattagttgcaaatttaaccacttgtttaccagttgaatcagtgattaccaaagcgctgatttctccttgtggcgtagtccactgtacaaccgacaacggaacccctacaattgtccatccaataggaaactgaaatcctaaaggaatttctagtagattcacatgtgaagctacggctgttgtcgagtttgtttttactcgtgcgtgaaagaataccctatcaccaatacgttcgaattcgtatgaaaattcatcaaatgcgctttgcttatctgattgaatagtagtcaaaccagatccactctgtaacacactacctaagtttttaactgttgccacatctactccgtcgatctggaccccatctttgaaattttttagtcctaaaacggtttcgggttcagttagactaaccgtattattcaagcctttttcagtatattcaggtgtgacatcccagctgtaatcattgggattgttgctgtctttcaatccttcaccaaagtatttaaactgactaatattcggtgttcgggtgtttcctttttcaatcttgagccagtcaatttgaacagcgccaacggtttcctttggttgctggtaaatagtcaaacttgatggatacggttcatgaattttagagactgtgaatgttaattgccagacatcagttaatccttctacaggtgtcatgtcaccgtattcaatcattccgtagttatatactctaaatgattgtgttgatggtttagttgctttcattgtaagtgtatatgtttcacctataataaatggttcttccatgtcgcccatataaatttgattgctactagttttaattggaaaagtttttgcaggatcggcaatattttcattaggatactcgcggcacatgttgtaaggctctgccaataagtttggctggtacggtgtggctgtatcacttggtgagttcactttctcaatcttaatatcgtaaccaatgtagattttgccgttgccttccataggctgccaaagttgtaagtaagtgctatcaaatttaagattgcttggtacagtgaacacttttgtcacgttttgccatgtccctacattttcacgtggcggatttagtgttactaaaggagttccatctccggtttttatgataaaagccgttctgaagacgtcagaatcttcgtttatcataattgggactgtcataatatacacattattaggaagcaacgctgagaactttggcacgtatatatttctgtttatgttgactgccgaaggatcactactgtctagttctaaatatgtttcgtgatctttgaaacaagctaatggttttgttattgttgttccattaccactaaacttgctaaaatctaggttaggtgctaagttagctcttccagaataatcatagcccccgaagtcgatgctattggagtacatcctcttcaacttgccgagggagccgatttgctgattggtttgatcaatacgatcatttgctttatcaatattagtattgagagttgcgacatcttgattggctttcgtgattttgtcgtttgtatcttttaatttcgcatcaatctgcgtttcagattccgtaattttctgttcaatctcttgctttccatcagctagaattttttctattttatcaatggtctgactgaaaccattgaaataataatcttccaattctggcgtactatcatcgattggactgcgtttgatgtcaaaagtaaaacgaccagctgtatctaacgagcggtcgtttggaaaatcaatatatacgctaccttctacggtgcctacgtatcccagtatattatcctctaacacaatagaaacaataccattcacaggatcttctaccgtagctagatagtcatgtttaccataaccaccttctgctgttgcagaacggaacatcagatcgttttagctgcttattaaagccttcaatcaggttcgttgaataaattgttcgtctgatagcgtaagggaaattataaaaggttaatagggcaggattcaagagtaggttcacgactcttcgatcctgctttttccatttcctaatcataaaatcgatgtaattcaatgcctcttcttttgaattcgcatggtaaatcaatttgaactcctcacagatttcttttcgacctcgaacacgcactctatgagcgatatttctagttgactatatacatcagtattctctttttgtacccatttttttgagttcatctaagagtgtcgataagagagatagtgagaattcagtcatttccagatagttatatttttgtcggtagctctctttcagcaaaatataaagtaattggtaatgctgttctaccaaaacttgcaaaagtaattggtgattctatagttaaacaactttctgaatcaaacttttagctgaacacgctttttttagatgcttttttattaagagttaaattgctttacagatccaggttatgttaataatgattaaaattttattgccaattttataaactcgtggtgctagttaattattgaatctaggaacaagagcataatatcactatttttacttttgaaattttactcagaaattctgtttttagtcgtttttataaaatgaaaatgttggtttataataagctgaaattaactagcaccacgagtctatatccatataagataagtatcacacatagtttacaagtattcagcaaattattcttttctaaatagtatgaatttactaaaaaataacagttattatcttttagtaaatccatataccattctccaatttttccaattgatattacaaacatttcacgttaaaaatttatgatacagttcatctgataatatcattataactcaatgttattctgcttgaacttgaccagaattacttacaaaatatttatacatctgatcagttccatcggccatataataaaaataatatccgtctgctgtagtttctcttccggcatcagttgcattaggtctacctaactcattgtgtttagctattgcaagttgagcagcttctaactctgaaatagctgcttgactaagtgtagagacattattgtttgttgcttcattgggtacagttttgaaataatcatcttggataatctcaccattattattcactgtaatgatattccaagtgataccttctggacctccatgtagttgataatgaaaagtaaacgagccatcagaattttgttgcccattttcaaatgcatctgaaccgcccgattgtggaagtttttgtcccagatattgagctgcttcttcaatagaatttaataaattcgtgtggaccacttgtggttcttcggaaacattttcttgtaaagtagctacctcactactttctgttgtagtctctgttgatgtagcctcctgattatcaatttttattttctctagttggtttttatatgtggtaattgtatcgtcaatttttttgattaatgaatctacttccgcttggctatatacatcagtactctctttttgtacccattttttgagttcatctaatgtatttactttttgagaaagatcattttcagttgcttcttcaagattatctagtgtattctcttttaaatctttatcgtcttgttctttaaaattttttttgatcttcttaatagattctgtataggtattagtaatttttttctccgttttatctgacttagagtaagcactggattcagtaacaaattttttgtactccgacagttttgtatctttatctttttcggctaaaattttctctacatttttttctatttgtttcattttactttttactacttcagcagtttttgtttctgaagtagccgttttacttttgtctgtcgaagctgaacaacctgcaaaaacaaaaatagaccctaccataacacccatcactaacttttttttccaattctttgagtacatgtgttttctccctattattttttagttaattataacatcttttcataaacttggtggcgtcaagaattatgtgtaaatggaaaatccattccgttaattatagttaaatcattgactctaatgtatcctaaatttctttaaatcctttgtgaatcctacctaaaaacttgtggttatattgattaaattgcgaaactaagaatctctctagagattcttcattagggaattgttcttttcttcgagtatatcgttttagctgcttattaaagccttcaatcaagttcgtcgaataaattgttcgcctgatggtgtgagggaaattataaaaggttaatagggcaggattcaagagtaaattgacgactcttggatactgctttttccatttcctagtcataaagtcgatgtgatccaatgcctcttcttttgaattcgcttggtaaaccaatttgaagtcctcacaaatttcttttcgatctcgaacacgaactttatgagcgatatttctagatacatgcacacaacattgttggaattgggcattcggatacacactatgtatactttcttcaataccgcttaatccgtctgtcacgactaataaaacttcttttaacccacggtttttaagatcttgaagaacttctttccaaatataagcagactcagttggggcaatagtaaacccaagaacctctttggttccatctaatcgaataccaatcgtaatgtacactgcttccttcgaaacagtctgtcgcttcactgggatatgcgtcgcatccataaatataacggaataacttgattctaacgttctttccttaaacgctaaaacatcttcagacacgagtttactcatgttggagatcgtttgtggtgtatagtggtgaccatacattttttcaattaattcggagattccagccatagtaatgcctttttgaaataatttgataatggtcgtttctaacgaatcattggttctcttatatgctgggagtgtttgttgagaaaattcgccattccgatctctaggaatggttaaattcaactctccatattctgttttaaatgtacgtgaataattcccattacgggaatttcctgaattgaatccatttcgatcatatttttcgtaatctaaaaaagcagttagctctgcttgtagtagtgaattaatcgctcgttctaaataatctcgaaataattcatctagatcccctttattgaggagtgtttgcataatttctatagtaaaattagtcatgagaaagtcctcctataaaatttctgtgtggtaactttaattttacagaatggactttctttttttctactcaaaaattctatttacacaaaatattttacgctatctaatttaaacaaagagaatgatatcttatatatttaagtcttttctgttcatttttgggttatcttcaaaattgtttaatcattagaactagttctatcaatcttgtcctttctttacccctattgccatctcaaaaacaaacacttttatgtccgatttttcagacatttttttgttgtttttattataaaaagtttgtttttttcattatgatagttagaaaaaaataccattctcttgcataaatgaaatgaagcaaagagaatgatcaattaaaaaatgattaactattctattattaggctatttgtattattcttctgtcacttttctatcaaaaaagccagaaataactagatataggtatttcttgcttataatataatatttacgccacagcctcccaatgattctttttggaatcataatctatgatgatttgcagtaacataaataaataggatcatcgctggtagtttatccaagagcactcaagaaaatacaaaatgtattgttcaagcgcctatcgtaatgataaaatgaaacaaataaacgatacaaggaggaagagaccttgagtaatggcaaaaaatttttttcattgtaaaaatcgttcagttgctaatctatggggtttcggtagcgtgggcatttttttatagaggaatcacaccaaactggccattttatctcttgttagtgggaatattagtaggaaattttgtcccccttcactatcgtaccaactttttttcaactggttctggtctttttcttaaaacaaagacgcgaaaattagaaaacattattgaaatgacaattacctgtatggtcattttcttagtaatattcctaaacgtcttctaataagaatctcttaaaattagattgttacagttagttaactagtttgtatttttcctaatttaaataacacagtaattttatcttcctcattaacatcttttgccacctctttgtcttaaatttgaaacatacaagtagagctacggacactaagaatgttttggctctgtttttttgcatcaaaattactctgatatagctagctgatagcttcgtccatttgaatgaaattattttcatttcaccttattacgaaaggaggtgtgacaaaaatcttgtcacacctcctttttccgaataaacggtgttccagaagtagcttcttcggaaataagccgaaatttcacaaaaatttgagaagcaattttcgtaaattccttcttatttcttgaagctgcccacttctgtcacaacctctatatttaagtattaccccacagacccttccatatagatttttaaattacacactagtttaaactaaaacaaacaaggaaaaacttaccatttaatcaaaaaattagctcatatgaatatattagaatgtaaaatagactggtcaaaatctggtcaaaaaagaggactaatacaggtagtcctctcagactgtagacaaaagctgttccaaactcgtaactcgagcttggaacagctttttatctacttcgtttcgaatttttgaacaaaaaaataaaggctccttgcctttccatagccaggtggctaatttctttaaattcattgcagcaaacactagcatcgtatgcgtcgcgactttttccaagcctcgatacttggtccaacgcatcccatgcttttcttttgcatccgcaaatattcgttcaatcgtttgtttccgttttttgtaaattgatttattcagatctgttaggcgaagatgttccacttcatccatcagatctccccaaacatgtctcgtgatgactcgttgatgatttttacttatggtacattggtttagcagaggacagttcacacattcttttggattggatttgtattctcggtacccttctcgagtaaccgttgaaaaagcgagcatttgatcttgcggacaaatataacaatcaaaatactcgtcatagagaaactcattttttgataatagcccctttttccctttgggccttgaataaggcaaacaaggtcgaaggttcaaatgagtcaaaaagtgagcaaacttaggtgtcttatacccagcatcagcgacaacacaattgatttcaggaaaaagtctcttcgattgtttgacgagctgaaaggcgacttaactgtcatgaatatttccaggagtgatgattgtgctaagaataaatccattgtcgtcgcatgaagtatgggcagaataagcaaattgtttttctcgttcgcctttgacgttgtagccgctttccggatcagctttacttatttttctttctttcagcttcacttccttttctaagtccaaagtaaaagggcgttttccagcctctattcgttgacgattgatctcatcttttaattcatcctgataggctttcgcttcatcatgggtcatttctttcgtaaacttatgtttattggcgttagctttgatgtgggtagaatccagatacaaattatcctctgttacaaaacctgctttaactgcttgttctaaaatataggcaaaaatatcctcaaacaccgtcgtttctctaaatcggcgaacataattctttccaaaagttgagaaatggggtattttctcctcgaaggagtagcctaaaaaccagcggtaagcgacattggtatcgacttccttaatggtttgtcgcatggaacggataccgaataaatactgaataaacaccaatttgatcagaatcactggatcgatacttgggcgacctaaatcggagtaagtggcttcgacgattggataaataaattcaaaatcaagcgcggcatcaatctttcgaacgagatgatcttgaggaactagatcatcaatcgtaagcatcgcaaattgatttctaccattcgtattgtttttagacatcatagctatcactccttgcattcgttttcataaatctattataaaagaaaagactgtagacatcatccataaaatggactttgtctacagtctgaaatcaccactgatgattttctcttttgcgtctgaaactgcctgataggcttcctctgataattgtccttttgtcagatctaccccttcttctttcaaaccaaaggtcaaatgcttgccgccaggaaatttatcgttatgagaagtttctgcaaattctttgacttctgcaccgacatttttctttgtagaagtcaacgtgaaattccctgtctcgccgttctccattttataatccccttcatccgcttgatcgcgatctacaccaatcacccatacttttctgctatagtcgttttcattgcgggcttttgcttcttggaacaccccagctccagtacttcctgccgcctgataaagaatatcgactccctctttgtacatagaagcagcaatagcttttcctttatctagcgaatcataggatgcggcatattgtacgttaacagtaatttccttgttcagtgctgtggcccctgccttaacgccagcttcaaatccgctttggaaacgttggatcacgggcccttccattccaccaataaagcctacttgatcactttttgtcgtatatgcggcagctagtcctgctaaatacgcactttcttgatctttaaaggttgctgatgagatattctttttcccagtaatctcaccatctaccaaggcaaatttcaactttggattatctttagcagcattttccagttcctctgcttgcaagtagctcaagctaataatggtggtaaagccgtttctgattgcctgatcgatattggtactgttatcctctggattgttcgtttctatatacgtaaaatctttttttgctgtcagctttttctcttttccccaagcctctaatccttcccagccagcttgattgaaggagcggtcatcaaccccgccaaatccaagaaccaaagcgattttacttttctctttttcactttgcttctccccctgagactgactacagccgactaacgttactaatgacaccaaaaacaacaatgaaacaagtattttcttcaaaatttttctcccctttttatgtgtcttgacacattgaacttttaaaagtatagcataccaatatatagaacactactcttcaacgaagattttccgtttcccaatttctccactatcaaaaaaccagcaatcacttctgactgctgtttttttatagctgttattctgcttttactggactacttatattctcagctaagtcctctaaagcttcgatatcatgaatcaagtaataattctttttcttttcgataatattctcctcacgaaaattcgtgattgttcgtaaaagatgtcgataactgacatttaagattgaggcgcaggtggttaaccgaaatgagaaacgttcgttttcgtgatgggtcaaaataaactttgctaaacgagtttcaacaggttctgtcagtgagttcgccaaatttatcccggaatttaaacgataacttagtaactggcaaatattctgcaaaaagcgaacatctttttgaagctgtgttcgatattgatttagcggaatgctgatacagatgcacttagtcactgctttaacgctgcttttcggcgataattcccacaatgaagaggcttcgccgagtggtgtagcgggctttgcgtaatcgatgcaaatattttgtgtatcagaagaatacgagtacaccattaccgtcccatccactaaaaaatacaaataatctgaggttgttcccgtttgaatgaggtgctcttccttttcaaaaaaaagtaaagaagccattgccaatatatctgaatccatataatcctgcaggttgtgcttctcaacgtaagcagttaattgcttcgtatcatggatttttttcatgaaatcgtcacctctaagaagtttttctttattatagcttagattgtttttcggctcaatacgaataattatttataattgtttgtaaattgtatgtaaaagttgtgtaaaataagacgtgcgtcacttcattgattttgattccctgctatgatttagacgtattagaaattatatccaacaggaggagaaaaatgcagttcaaacagttagcaaaagggttcatcggagtcatgttattgaccactttggcggcctgcggttctgggaatacaagtagcagctcagaaaaagagagcaaagaaaaattagttgttcaattcgttccaacaaacaatgatggtagtatggaggcaaaagcaaaaccatttgctaagtatttatcgaaaaagttagatcgtgaggtagaagtgacgttagctactgattattcaacgatcgtcgaagcgatgtcttctggtcaagtcgatgtcggaattatgccgcctgcagcctatgttcaagcaaaggatgctggagctgcagatgcaatcctgacttctcagctcggcgattatgatcaagaaactggcttgccattaaaggacaaacttacgaacacctttaaaggagaagtattggttcgtgccgatagcggattgaataagttaactgatttaaaaggaaaaaatatcgcaaccttaagtcctaactctgctagcggctacatctatcctgtcgctgaattgaaagatgctgggattgatcctactgcagatacaaagatgaccactgtgaatgatattccgagtgagattaccgcagtgttgaacaagcaaatggatgcggcgtttgtttttgaaggcgcgcgaaatgtttttgcttcgaatttcccagataatgatttatttaaggatttaaaagtcctgtacctgacaaaaggcgatattccgaatgacgcaatcgctgtacagcctgacatgtcaaaagatttaaaagcgaaaattaaagagaccttcttaaatatgaaggatgataaagatggcaaagaagcaatggctttgtgggggcatcagggctatgaagaagctgctgattctgcctatgacacgatcagagactacacgaaaaaagcagcagaataaaacatcagtaagtgtcagcaagcttttttttgcttacacttaaaaaaatggagaaggataatgattatttttgacaatgtttcgaaggtctatcccaatggcgttgttggcttgaaggatattgacttaacaattgaagatggagaatttgtttccatcatagggttgagtggtgctggaaagagcactctgctgcgcagtatcaatcgcttggcagaaaccaccaaaggagatattcgcattaatggaacctctattacaaaagcgaataaaaaagagctgcgacagattcgccgccagattggtctaatctcgcaaagcttcaatctggtaaagcgtagtacggttcagaaaaatgtgctatctggacgtttgggctattactccacttggaaaagtattttaggtctttttacgaaggaagactaccagcagacaaaggaagcactggaaaaagttggtttgtctgataaattgcagacacgcagtgatgagctcagtggtgggcaacaacagcgagtatccattgcgcgagcactcgtgcagcaagcccccattattttagcggatgaacccgttgcatcattagatccaatcacgactcaaaaggttatgatggacctaaaaaatatcaatcaaacgatggataaaacagtcattgtcaatctgcattcagtccctctggctcgtgagttttctacgcgtgtgctcgcgttaaaagctgctcaggttgtctttgatggtcgtccagacgacttaaccgatgaacgcttagagcaaatttatggcaatgcaatctttgaagaaaaggcaggcgaaatcgatgagcttgaaagaaaccgttcactttaaatggtataaacacctgcttattcttctgttcttaattgtttgttatcaaggaagtgcctggatcacgtcagctgatttttctcaggtttttcaaaactccaatcaaatgactgtctttttatcacgcttcattcatccagactttagctatttacctaaattagtcgagcctatggtgaaaacacttcaaatgtctttgcttggaacggtcattggcttaattttagcgatccctgttagttttttagcgaccactgtagtgacagaaaaccgtcttctttctaccatctttcgttttcttttaggtttagtacggaccatccctaccctgcttttagccgcgctttttgttgctgtgtttggaattggtgaagcgactggcgtgttgactatcgctgtctttacttttggtatggtgtcacaattaatgtttcaagcaattgaaaccattgactttggcccgattgaagccgctgcggctgttggagcaaataaaatgcaaatcgctatttggtcgatcgctccacaagttttgagtcagtttgcgagctatgctttttacgcgtttgaggtgaatgttcgtgcttctactgtccttggatatgtcggagctggtggtattggcgttattctaaattcctcacttgcgcttttgaattatgaacgagtttcaatcattattctaacgatcctagtaactgtcgcgatcgttgataaattaagtgaacgtgtcaggaggtccctgttatgatgcttcgtgaaatgaacagaagaacccttttatcattagttgctttagtgattctcgttattttgtcggccgctactctggattactctggattaagcaccttctctccttccatgggaatggacgttttgagagggttaggtcagcctgattggcagtttctatatgatggcagcggcgaggatttgattagtttgctattattaaccattggaatcgcctgtttagggacaatgatcgctacggtattagcgattcccattaccttgatcagtgcggttaacctctggcaagcacatccatgggtaacaaaaaatggcaagcttatctgtaatgttttacgagcttttcctgaactagtttttgcaattatttttgtgaaagtcgtcggacctggcccctttgctggtgttatggcgattggcgtccatcagatcggaatgcttggcaaactttttacagaagaaatggaagcgatggatgagcgacttgttgaagaaatgcatgcggtaggagcaaatttttggcaaacgattttctttgttcgcatcccctatttgatgccgatttattgttctttagcattaaatcattttgaaatagcggttcgtagtgcggctaccttaggcttagttggcgctggcggaatcggtgctccattgatattcgcgattcaaactcggtcttggagcaaagtgagtattattttgattggcgtagtcgtaaccgtgtttattttagatcaaataaccggaattataagaaagaaattgagataagaatgaatatattgcatatatcagatatacactttcgcagagagtatgaggcttgtgaagaaggctataagggaatgctggctacgatgcagaatccccttatccctctggagcaatgcattcatcatctcctgcagcaaacacccttggaccttgtgattatcagcggagatttaaccgaagatggcgaaatagacgattatcgatacttgaagacttggctggaaaatgcgctaggagaaacgacgattcttgttactctaggcaatcacgatatcaaagaacatttttgggtaggctggtgcgatgaagccgcctcttctgccccgtacaaccagatagtcaaatatcctgagtttacagtgatttcctttgataattcaagctatggatacgcagatggtatagtggacgatcagcaatttcaatggctgaaaaaagccttagagcaagaaaaagaccaaccgattttcttggtcacccatcatcatctactgtctcaccaaagcagtataccaaaatggcctggtaccgaacgtttcttgaagctaatcgcaccttacgatattcgctgtatcctaaacggtcatacccatcacacatttactgatgaaattaatgggatcccctattttactgtatcgagtatgtcctttgttggtgaagatgaaggcgatggcttcgtacgctttgaagaacgtcatgggtataacctttatcatctcgatcaaggaaggattgttcgccagacaacagaaaactttattccaggcaacattttaaaaacacttcaaatgaaggattaaggcattataaatcaaaaaaagagaccgaacagctgaatacgcttcggtttttctattttgagtcagctaaaggagcacgcagaatgaacattacgtttttagagacaagtgatatgcatggctatgtttcaccaacagactattccggcagaaccgatctggccttaggaacggctaaagtatcgtcgaaactgaaggaattacgggcaaaagcagatggaccggtaattacgatcgaaaatggtgatttcatccaagggtctcctttgagttattatcttgctaaagaatatggttcagccaaagagcttacagacttgattaaccaaatgagctatgatgttcaagtgttgggaaatcatgagtttaactatggtgtggattatctcgaggaagcgattaagaattatcaagcgcctatattaggagccaatatggtgaacaaaaatgaccaaccatactttggaaacgcctataagattatcgaaaaggtgggtgtaaaaattgctatcttgggattaacgacacaatacattcctcactgggaaaagccagaaaccttagcaggaattacgtttaagagtatcgtcgaaacagcaaaagaatatgttcctctattaaggaaacaagcagacttggtaatcgttagttaccacggcggatttgaaaaagacttgttaaccggtgaggacacagaagcgctaactggagagaatgaaggctacgagctattgcagcaggttgaaggcattgacgcccttttcaccggtcatcagcaccggaaaattgctgaaacggttcatggtgttcccgttgttcaaccaggctatcgtggcgagttcatcggtgaaattcgtcttaccgtcgagaaaaaagaggggcaagtggttgttacagatcaccaggttgctttacactcagttgaaaaatcagagcctgatccagaaattcttgcagcgatcgtaccggtagaagaaaaactagagaaatggttggatcaacccttaggtaaagtgaacggaaatatgcgtattaatgatccgatgcaggctcgtcttgaggaacatccctatgtagagtttattaatcgtgtacaattatttgccagcggctcagagatttctggaactgcgttattcaataatgaaggaaaaggctttggtgagacgatcacgatgcgggacgtcatcaccaactatatttatccgaatactctggcagtgattcaaataaatggtgcagatttgagagcggcgttggagcagaccgcaaattatttagctgtagaaaataaccaaatcgtattcaatccagcctttattcagcctaagccccagtactacaattatgacatgtatgaagggattcagtacactattgatatgaaacagcctgttggacaacggattaccgaacttcgttttaaaggtcaccccgttcttccgcaacaaatgctggaagtggtgacaaatcaatatcgggcaatcggcggaggaaattatgcgatgtttggtgcggagaaaattgtccgagaaatccaaatcgacatgaccgaattaattgccgactatttgaatattcacccacgcatcgaagcaaaagtgaatcataattttcaagtgattttgtagtatataaataaaaaattcaaaaaggtgtgagcagttttttgcccacacctttgttatgccaaattgttaggctgtctgatttccatccagccattctttagccagcgatctacctcatcaaaacaaaaaattttcctctgatggttccttaaataagactattttgatcctttttccatgaataagattttgcatcagacaatacttcatttctgaaaaagttgcggcaccaatatagcctaatacccctttccgatcttgattaaatacaaaaaataaatccgctgctgcgatatttaaaaaaaagtcgtcaagatttctggatactctttgtctaggatcggacatgagcgaggataatcaattaattcaatgccttttttactgaaatctttttccatatctcgatattcttcttggaaaacaatacttccagaaataacagctttcacaaaattggcctccatttttttatttttcagacactccaccataccggatacctctcaaagaaaagacatagcaaaaatcaatagcagctatctctccacggttttttactggtaattttatttttcttttggaaattgtatcaggaaggtcgttccttcattttttcggctggtcacttcaattgaaccgtggtgcaggcgcactagttccttcacgattgataatccaagacctgactcgcctatctttgtatttttacttgacggatcggctttataatagcgatcccaaatgtttttttgttcctcttcaatcatgccgatgccattgtcctcgacagtaataaatacaggctctttgtcaaatgatgttggtaaagagaaatcttagaataatttggacagaacagaaagaagaaactctctttctgttctgtttatttggttaaaaatgttttgccatgacgaatcatgatccgtagtttgaaattgtaaaagctgcgaaagccgtacgcattgcgttttaatactttgatgtggttgtttaaacattccaaaggtccgtttgaatagctgtagtgaagcgcattttgaatctgtggcagaaactttttaaacgttcgtaaagtggttgtataggtttcaggaagaccgctgactactctgtttaaacagtcctcaaataatgactgatctcttttctttaccgcataaagaacgtcttggtataactgatagccttggcgcaggttgggacaagcagctaacagtcgatcgacaatctcactttcagtcaaataatctttaaaactggcacgccaaatccgtttttcgtagtttaactttacttcttctttttgtaggagtttccaatagcgtttcaattttttccctagtcctcgttgagagtgggaagttcctttaagtcgtgcagttgtttctttcactcgatgattcaagaaagttctgccaatatgttggacgatgtggaaacgatcgatgaacaactgagcattcgggaaaagctttttcaccaacgaaacataaggcgcatacatatcaataacaatcaattgaacggcttcacgagtcgctaatgaaaaccgagaaaaatagcattctaaataaggcaagcgtcgattttcgacaatatccaataatgcatggctttgtccgtccatcatgataaaactcattgcactggcaacacttcgaaccgatttgaattcatcaaagcataagacctttggcaaagcctgtttgaaaggattcaatgggcggtagaatcgcttcatgacacgatagaccgaagaagtggaaatatttttctgacgagcgatttccgtcatggaagtattctcttttaagcgagcaatgacagaccaacgaactttttgactaatgaaacagtgtttttcagcaacagaggtatccgctacgaatgttctttggcaagacttacatttaaatcgttgtttcttcaactccagataagtgcgatactcagacgcatcattcagtaacaaccgaacggttgtcgtcccccaacgaatgatcctagaggggacgacacaaagacaatgggaacactcttctggcttgtacagaagagttcctttgtaaatcaagcaaatttgccctttgtatttttctttagttaaacaattttcctcgaaatagatatttaggtctagaatatttagggtatctttgataagctgagtatgagacatcttgaatcctcctatgaattggtagccaaattaattctaaaggatttcagggtgtcttttctatattttttttatacaaaaaagatgttggtgaagttcaccaacatcaaaaagtatagagcctaaatacatcagaatccgtttctttgattgctatttttatctcgccgttttcggtaaattgaatggcattttgaataatattcaccataatttgaatgaaacgatcgtgatccgcatatacttcaacagaatctggagttgataggatcaattgatcattcattgactcggcttttttattcagttgcatcagaatattgttgatggcttctgatattttcataatctaaattctgcttcactaaacggatgagtcgatcggtctcattttacatcaacgagacggcttttcccttttggttttctgggatcgcaccatattcaagcccctccagcagtcccttgattgttgttagcggagtcctcatttcatgagaagtatttgccataaactgcttacgtaattcctcttggcgaatgatttctttttcgttttcctgtaaggacaccgccattttattgaaatcatgagccagttcattaaattcatctttattgtttttttcctcgatttctatttcataattctcattagcgatttgattaaccgctcgtttcagatcatttatttttttcacctgtcttgctgctaggccaaaactgatcgcgccaccaaacagggaggaaataatgaagcccttcagtagattgtcagaaatctttttttcactttcttctaggtctctagcagattttgaagcaattaagacaccagaaaactcattggaaacataccgattagaaagaacataggacgtttgattaggctcaccagttaaatcatatttgattgttttatagatactttcaccgtttcttagttttttccattctgaatcgtttaataaggactctttgatttcggttcgcgttgaaggatagaccacattctttttactatcaatcaagacgaacttaattccctgttgggctagcatttgttcagcgttagctaaatagtaaggtagaatctcctctctagttaggttaccgtagggatttgcataaggatttgatagatcacttttcaacgaatcattgacggactcaatgtattctctaatctggttgtagttttgattgactaatatccgcttattgatgctggtaaaagatatgccgatcaatacgactgtcaaaagaataagggaccaaaaagctaataattgctgatataaatatttcattgttttcctcttctgcttgaattctgaatacctttacaatagcttatttttagctttaagtcctatgattcattaaaaattcaaataataatcttattttcatcaggctggattctgattttttatattaaaaggtgaaaaagtatttagatttagtcgaacgtctcctctttcgcctcttgtgtcgaaatgctacactaaaaagtattattgaagggattgataaaatgacaaacgacttgaagttagattctgctttaaaattgaaaaaaatggttagaaacaaacagttgcttgagttatcagaaatcgagaacttattagaaaactctgaggtcgttaccaaaatattagctgaacctttccgtacagatacatttaccgggttacgaaaactagagttcttattaacggagctttcagaaattccttatttcgaaaggctggatcagatccagatgatgctggaaactttgtacactcatgtgtcatttgaagaaggattttcactaactggaaaacaagaaggaattttagcctgtcacaacgcactctgtactttgctatttttgcgtgctggtaaaaagaactgggcggaaaaaggaattcaatggattatttcttactttccgtttactaagaatgaaccttccggttggcatggcaaggatctttttcatcgctttggcggttgtgtcggaaattctccctgttacgatggtttagttaagtcaattaaagctctctccgagtacgccgctaaatacggtgattttccaggacttcaggcaaaattggataaaggaattgcttctctattgaagtatcgagttattttccatgaaatgaataatgaatatctgtacgatgacttgctcactctgttttatccctatccttatcgaacaaatatcatcgaagcattaactgttttgaaagcagaggatcagctagatcgcgttgagtgtcgccaagcgatcgactacctaaaagaaaaacaatccgtcaacggctattggcaaacagagaagatttgtatgaaaagctcttgggtaccatttgatcctataagaaaacctggcgcttggattacggatgaaattgaatagctgctttcagatcaataaaaaagatctccatgacaaaaaagtcatcgagatcttttcttctatattaaatcagtggctcagatgataatactcttcttccatcctttcccgttcctttttgttataccaaggagaaacggtaaatgcaaaaacgtcattgatcaggtaaacagagctattcacgaacattgccaagcttgcggagccatgtctgaaagaaatgtaccaaagaaccatttgggcaagccctgatgccaaccaccaaaagtattgttattgtaacgtaagaaactgataatgcctgcacttaagctaattgaaaaggcaattgcatcaatccaaggacgagggtcgtccgtaaagcgttgaatcagaaaaccggaaacaaagtacacaacgatcgtactgataattgccacaaaccaggtttttccagtaaactttcgaatcttagacgccatattatggttccactctttacttagtaatacgggaatatccagtgtgatcatatacgcgatttgttccccgatgcttaagtagtttttagggttctgttgcaaagttttaaataaagaataaaatcccttacggcctattacctattcattagaagaaaataaccaagattcaagtgcccaacaagaagaaatgaaaaaaattattgaggaatataatcagtattttgatactgcctggtcattagccgacattgaacgttataacggagatatcaataatcgtttggcacgaaaaagagcggaattcaaacaatttgggaaacaaatcgatttagtgattgtagtggatcgtctattaacaggttttgacgcacctacgattcaaaccctatttgtggatcgtaatctagagtatgcaggattgatccaagctttttcacgtacgaatcgtacgtatcctgataagacaaaaggattgattgtgacgtttcgtaagccagccacaatggagaagaatgtcgaggatgcgacaaaactgtattcagaagctaaagaagaatcgggtttgatttatccaagttatcaggaatccaaaaaaagattcaagcaggcatatggtaaattaaaagaggtttcgtcgatggaatccattgatgaacatacgccacttgaaatccgtatcgagtacgtcaaagcatttcaagaattgaatcgtgcgtatgaatcgttagtgacttatgacgattacaatgatgacatggtgaaatctccaactttgaacaatcaaattcaacttttggaagaacaaattggcgtgtacgagaccgtaaagggttcattaatagaggaagagccagaaaaagagggagaagatttttcaacgatcgaattttatagtgaaaataccacgaagttgtatgatattgattctacttatattgatcaattactaggaaattatgctgcgaatagttcagatgcacgagaagaaattgaaaaagctttggctaaattgaataaaacagaaggagtcaaagaagtttaccgacaaattttaaatgcatttgatgtggggactttagatagtaatgaagatatctttgtcattaaacatcgctattttacacaaacaagtgatgatttgattcatgtcttttccaatgagtggtttgtttctgagaaagaattacatgcttctaatctgcaatatctaccaggtgaagatccaattcctaatatgaaagcaattatcaacagtaaggattacgaaggatataaagccaaccatccagaagcgaagccatttaaatacccacaagaaatgaagcgagcatggcgtaaaatgttagatgatgagttgattcctcttgaaaatgaattgagatgaacgagaaaattgaagaaattgtatgataaacatgttaataaatgatgctcgaaataaaatttggttttatttttacattgatacggtaaataaaatttgaaagtagaagaaaatatgaacaacaatgaaacaaaaaaaacatatgaactaagaataactgctgatgagattaaatcaacagacccaacatttactatgaagaatctaagcttaggggataattatcaaccaaaagatgcttacttccgtacggcagaaggcgaaataactagaagaaactacggtaaaaatgaacggaaaatttcaaatcaaacattaccgcgattagctattcaaatgtttgaacgatcgattgtttctctaccagaaagcgaaagagcaacatttcctgtgtgtcgatatcactcaggagatgagataatacgagggatttttccagatgttgacagtttcaaaaaaaaaggaagtccattgaatttttgatttataaatataatgaagacaagcagatagtcatctattgttggagtattttttcaactttattatttgtacaagaatgtttgaaacgttttggaacatctggggatgaatttattcttgtttataaagggaaagagaaaaaggaaatacgagtaggagagactcagactatgaccaatcatttgctgaaatcatatgtttcacatttactcaaatctaaaaaccttattctacgtggcgctcctggaacagggaaaacattccttgcaaatgaaatggcagctgatgtcgtttcaaatggcagaactacacaaatcaatgaattgagcgaagatgaaaagagccgaattggatttgtccagtttcatcctagctatgattatactgattttgtcgaaggtttacgtccaaccacatccgatgatggcgttgttagtttcaccttgaaagatggaagctttaagagctttgttgaagaagcaaagaaaacaaagaaagtagatggacaagataattttgaagaagcttggactaaattttttgatgcggtaacggaagctagtatagagggagaaggctacaataaacttaaaacattgacaggtaaaccagtacgcaatcttctagcttatgaaagaaatgaaattcaaggcgtttatcctgcaaaaactactacttacatgaaccatgaccaaatttataatgtctatcgtggattacctggtacgccaaaaggtggatttgatgcttatcgaaaagcgattgtaaaacacttaaaagaagaattcggcttaaaaaactacacggcgtcaacggtagattctacgaataaccaaaactatgtgtttatcattgatgaaattaatcggggcgaaatttccaaaatttttggcgaattatttttctcaattgatccagggtatcgcgggcataaagaaggtgtttatacacaatatgcgaacctccatgaaaatccagaagaaaaattctatattcctaataatgtttatattattgggatgatgaacgacattgaccgttctgttgacacttttgattttgctatgcgccggcgatttactttcttagaaataaaggcagaagattcagcacaaaatatgctgactcaagagaaaacaaaagaacttatgacgcgtttaaatgaggcgatcgttgccaaagaaaaaggtggattgtcaactgattaccaaattggtgctagttactttttaagtatcgataatggtgaggagacaatggaacaattatgggatactaagttatatccattattgaaagactattttcgtggtgaacataaggcgaaagaaaaattagaaatactagaaaaggtatactctaatgacggtgatttagatgaagctgaaacctctacacgataatcaagaaatcaatgactcagttgtgcaacatccaatcattacgaacttagttaatcgtgacttaagtagtttagagaaagaaaattttattatctttccgcaacagttaaatcaatccaaggatctaagtgaagataacttgatatttcaatcaagaaatggaaaaatttggacttgtaatgtcgtaggtatccttagcgattcaacagatgaattaagaattcattctagattcgccaatcaaatgaagcatgaagatttctttttacgttatatgcttcagcgtgttttgaattacaacgtgattaatcatcattttagtgcatctaaaaagatgacatactacgatttgttggtatttctctttccttattatctgaatgaagcaatgtgtaaagggatatacaaagaatatgtcaaacgagaatacaataatgccaatatcaagggagctgttgatgttgcaaaacacatccgttcgaatgttcctttcgttggaaaagttgcttatcgaacacgagagtttagctataataatcacctaacccagcttattcgtcatactattgaaaaaatccaaaatgagtacgatttcttacttagtggagatgaggatacgaaagaaaacgtggttctaatcaaacaaacaacacctggttatgctagattaaatcaatttaatatccttcaagagaatatccttcatccagtcaaacatagttattacgaggagtattcggctcttcaacaaatctgtatccaaattttatcggaagaaaaatcaggatttggaagtgataaaaatcaaatacatggaatcattatcgatgtgtcttggctatgggaagaatacattgggaaagtcactggttggaaacattatggcagagataaagggttagcaacaatgcatttatttcaagagcccaaccggtccccacgatatccagattttacatttaataatataccaattgatacaaaatacaaaaaaacatcttgatactagaaatgactataatcagttagtcacatatattcatataatgaatttagaccaagcagatacaatgaaaggcggctttctgcaacctacttccgatccccttcctgcaaatcatgggtataaaaaaataggcatattaagcgggctaggaggagaaatattcacatatcattttttcattccgcaagctgcgtcaagttatttggaatttgtagaacagatgagagaggtagaagcagcactacaaactacttttcaataagtaggaattatagaaatgttactcaaaaaatcttcattaaaaaagctgactaaataagttgagaaaacagaatatacttcaatatccagtgatttataaatatcattcactcatgatacccagctccgtatcataaatgaggatttttttgacagtacaatgttgttgtaatgagagatgagtaataatgaaataacacaaaattaaaaatgccctttgtacccgtagcgttgcagtaacagaaaaaatcattcaaaaaaatggatttattgaaagtctacaagaacaagactactgatgaattccgcctagaatctaacctattctttatttcaaatcaataaatcatcatttcgttaattttttccccacgaacgtgggacaaaagtaagaaacacttttgactcattctttaaaaaagaataaacggtgggagcagaagcaactccttcttatttctcggatttaaacgcttctgtccgatcctctttaatagtttgaatttttagaaagtttatcttttatttctattttagagatgttaaaatgatggttaaactatataggggtgattatttgttagataagtttttggatatgtctttagttcaacgaattagttgcggtatcatagttggtattatagttggtatttttttaccctcatggacgtttatcaccatattggggactgtatttgtcagttgcttaaaagccattgctcctctcttggtattttttctgacggcagcttcgattgcaaaacataaagttgggaatgaaacctatgtcaaacctattttatttttatacttaggtggaacgttcttctctgcgttagttgcagtagtcgttagttcgatttttacgatcccaatcactttgcaagaacaggtctctgaaaaggcgccacaaaatatcggcagtgtcttatctacgatgttgactaacgtgacacaaaacccgatccaagcaatcattgaatcaaattatttaggcgttttgttctgggccgtcttgttagggctggctttgcgtagtcgtacggaaacaactaaagaagtcgtggatcaagtttctgtagccttgtcacacgtagtgcagctgatcattgcgtttgcaccgatcggtatcctaggattagtttatcaatcgatctcaacgacagggttgtctggcttagcagaatatcttcaactagttctggtattagtaggaaccatgttatttgtcgctttagttgtttatccgcttctgactttcttatttatcaaagaaaatccctatccattgattttcttttgcttaaaagaaagtgcggttcccgccttctttacacgtagttcagcagccaacattcctatcaatatgatgttagccgaacgattgaaattaacgaaggaatcctatgcgatctcgattccgttgggagcgaccatcaatatggggggcgctgctgtaacgattaccgtgatgacattgacgacggtacaaacattagggatcgaagcgtcctttgcttcaaaattgatccttagtctgttggcagccattgctgcttgtggagcttcaggcgttgcgggaggttcgttgctattgattcctttggcttgcagcttgtttggtatttcgaatgagattgcgatgcaagttgtagggataggatttattatcggtgtgatccaagattcggtagaaacagctttgaactcttctagtgatctgttattcacagcgattggggaattaagcgcgcggaaacgtaacggagaagcaatctccttaaaagattccttaagtgaatcaaactgattgcgaatgggtgatcatttttcgatgattggttttctgaagtgatgattgaccgaaaataaaaagcttttatcctaacttcaagtatagggtaaaggtttttttattttgaatttatgtagaatcaaaatgagcgtgggataaaagtaagaaacacttttgtctcattctttaaaaatgaataaacggcgggggtagaagcaactccttcttaaataagccgaaattcacaaaaatttgaaaaataattttcgtgaatttcggcttatttctcagagtgaagcacttctgccccagccttattttggttcgttttttcttttatagggaagaaaaaacgaactgttttttttttgagagaaggctatttttttatgggtcaaacgctcttggcacagaaaataagaataaattcccattagagcacgctttttgttttttcactataaaaaagtgaacccagtttatattgtcaagtaaggcggaggaacttatagtatagacgtgcacaagtaataaatgaaatagaggcgaaataagtgttaagtaaagtaatcaaagatgaatatattcaactagatgttcaggcaaataactttgaagaagcaataagaaaagctttgcaacctttcttagaagcagatgtagtaactgaaaaatatgtcgaaacaattttgaagatttacgaagagaccggtccatatatcgttattactgaaaatattgctttacctcatgcaacggtggaaagtggagcaaaagatgtagctattggatttatgcgattgaagaccccagttacttcaggtcatcgcaccaatgatccagttaaatatctttttccattaagcgtcaagaataaccaagcgcatattgaattgctatcagaattggcaaatttattaggaaatccagattttctaaaatttatcaaagtcgtttcatctagagaagaatttaaaaactatattgaaaaagcagaaggagagaataaacatgaatagtcataaagctttagtagcttgccgtgcaggagtaggatcaagtttgatgctaaagatcaaagtcaatgaagttgttaaagaaaataactttccgttagaagtagaacattcatctttagatggtgtgccaggttttcaaggagatatgatcattactttgcctgatgtagcgaatgaattaatagaaaaaaatttaccacagaagattgttggcattgcgaatattgtggataagaatgaaattaagataaaacttgaagaagcatttattgagttagaaaaacagtagttagaaaggaaggctgaaaatggattttattattagcttcttaagtacgcccgcagtactattagggcttgtggctatgataggcttattagcacaaaaaaagtctggaacagaagtcttgactggaacctctaagacaattattggcttttagatctttaatgcaggtggcacgatcatgacagggctttgcagaacttcaatacgttgttccaaaccggatttcatatcaagggagttgttgcttctcctgaagcagcgacagcattagcgcagacagaatttgcgtttgttacgagtagtacgctgattttgggatttatcatgaacttagtaattgctaggattactcctttcaaaaatatcttttttacgactggtcatagtttgttctttgcgtgtgtgttatctttgattttgaaagcgcataacttctcggatgtagccgcaattatcgttggtggattattacttggcttcttctccgcagcattgcctcaattatgtcagcccttcatgcgtaagattacaggaagtgatgcaactgctattggccattttaatatggttggctatgcactgtctggttatattggcaagctatttagtaaatataaagaccgcacaaccgaagacatcattggctgagtggcaaattggtcgatccttcccgcggcagcttgagccgctacgacatctgttcccaaactatttagagcagactgcaataccaccgctccaatagcaatgatggatgattggaaagccataggcaagcccgcatttaaatgagtgaaaatagtgtctttatctattttgaaatcacttttagagacttgcagcaacgggattttccgtttgatatagatgacacacatcaaacttgcggaaatttgcgcgataactgtcgcatacccagccccagcgatccccatgtggaaattgataataaacaccaaatccaaaatcacattgatgatcacagcgaaaatcaaaaagaacaaaggtgttcggctatctcctagcgctcgaatcatatttgaaagaagattgaacgccattgaggcaaacataccgcctaagatcacggagataaattcctgtgcttgttggataatatccggcggtgtctgcatcagcaataataacggacgtaaaaatactaaactcaaaacagtcaaaatagcagttactgtgaaactaattataatagcaacagcaaaacttttctttacaccgcgaaaatcctgagcgccgaaacgttgcgccgtgatgatagataatccagcggtcaaaccttgagcaaaaccaatgatcaaaaatgtgatacttcctgtcgcgccgactgctgccaatgcctctttaccgatcgtttgcccaacaatgatcatatctaccatattatagaactgttggaaaatattccccacgagtaatggaatggtaaataaaaaaatcaactttgctggggtgcctgtagttaggtctctcatgataactcctcaatttttttcagaatatttgcaaattacatattaccatagtttaatagaaccacaaatagctgatttatacaaaaaatacagcaaaaaaagagcaatttgttaatgcttacaaaaaagatgcttgatagcataaactcagttctttagattttttaaaatcaattggtacagctttaagaaaattttatgaaaaagatgaaaaagatgtcaactgcaaatgacatttctcaaagaaactgggataataaaggaagagaggtagaagacatataaatgtagtactgatgcggcacggggaaagtgaagcaaattttgaaaattattggacgggatggctggatgtttctctgacagaaaaaggacaggaacaggctcgtaaggcaggggaaaaaatcaaaaacgcgcagatcgagtttgacgctgcatttacgtcagtattgaagcgggcatcattgacttgccagatcatcttagaagaaagcgatcagttatggataccgacatttaaaacctggcgtctgaacgagcggcattatggcgctttagtagggaaaaataaggatgaaatggcacgagaattcggggcagatcaagtcaaacgctggcgtcgagattattatgaaatgcctccattagtagaagaaaaccattttgatcgccgttacgcacaattggcagatcaagacattcctcatggagaaaatctgcaaatgacggtccagcgggtcgcgccataatggcaagatgagatcgcgccgctgttgggttcgggtaagaatgttttgattaccggacatggcaatagtctgcgggcactggtgaaatatttggaggatgtaccggaagaccaaatggataccattgatattcccaatgcgcagccgatccactaccgctttgataagaacttgcagatcgtcaataaatcgatcctctaaagacgaatattggctgaaggaaatagccctttgtttcagaatttttcataaaactatcataaattatggtatactattgaaaaaattggaggaataagaataatgaaagctattttaacggtggtcgggaaggacaaggttgggatcattgccggtgtcagccagaagttggcagaattgaatatcaatattctagatgtatctcaaacgatcatggaagattattttaccatgatgatgatgttgcaaatgcaaccagaggctgatttagaagcgattaagcaagcattgagtcaagttgaaaacacgttgggcgtcaaaatcagcattcaaaatgaagagatcttcaatgcgatgcataaactataattcggagggaaatgatggaaacaaaacaaattcttgaaacgatccggatggtagaagaagaaaatcttgatatccggacgatcacaatgggtatttcattgttggactgtatcgatgccagcacagaaaagacttgtcaaaatatctataataaaatcaccagcaaagcgaaaaatcttgtaaaagtcggtgacgagatcgccagtgaatttgggatccccatcatcaacaagcggatctcggtaacgccgatcgcaatcgttgcttccgcaagcggcgggcaagactgtgttgcttttgcgcgagttttggacaaagccgcaaaagcggtggggatcaattttatcggcgggtatagcgcattagttgaaaaaggctatcaaggagcggacctgtccttgatccaatcgattccggaagccttggcagaaacagaatttgtctgttcttctgtcaatattggttcgacacgggcagggatcaatatggacgctgtcaaattgatgggtgaaaccatcaaacaaaccgccgaagcttcagatatgggctgtgcgaagttggtagtctttgcgaatgcggtggaagacaatcctttcatggcgggagcattccacggggtcggtgaagcagattgcgagatcaatgtcggtgtcagcggaccgggcgtagtaagacgcgctctggaaaaggtcaaaggcgaatctttcgatgtggttgctgaaacagttaagaagacggcatttaaaatcacgcggatgggacaattagtcggtcaaatcgcttctgagcgattgcacgtaccctttggtattgtggatctgtcattagctcctactccggcagttggtgatagtgtcgcgttgatcttggaagaaatgggcttggaatctgtcggcacacacggtacaactgccgcactggctttattgaacgatgctgtgaaaaaaggcggcgtgatggcctgcaaccatgtgggaggcttatcaggcgcattcattccggtttctgaagatgcaggtatgatcaaagccgtagaagaaggctatctgaatctggagaaattagaagcgatgaccgccatttgttcagtgggtctggacatgatcgcgatcccaggagatacaccagcggagacgattgcggcgatgatcgctgatgaagctgcgatcggtgtcatcaatcataaaacaacggcggtgcggatcatccccgctaaagataaaaaagtcggcgattctgtcgaattcggcggtttgctggggactgctccagtcatgcggacgaattcggcgaaatcgacggactttatccaacgaggcgggcggatcccggcaccaatccattcatttaaaaattaggaagatagtgagaaaataatgtttgattcatatataggggattttgacgggacgttgttcgatacgtatccgatcatgcttgacagcatgatgaaagctttagaagatcggcaagtagttgctgatccaaaagctgtttatcgattattgaaagaaaaatcttcaaaagcattgactgaaaaatatcatttggactttcgagaattctcagatgatttccatcaatacgaaacgcttgatacacgccaacctgtcacatttgatcatgtgtatgacacattgacgcaattgaaacaacaaggatctaaacattatatcttgactcatcgtacgatcgcttcgactcgcgaattgttagtaaaagaaggaatgttagaattttttgaagaaaacgctaggcgcctggcactcatcttcctccctccctacagccctcagttgaacctaatggaaggcgtttggaagtggctcaaggaatcggtcatcaacaatgttttttttgaccacgtccagaaaatcaaacagtcggtccgcggtttcttagccgatgtaaacgagcgtccccttgaggtgattgaccgactgtgcgtgcggatgtaaagtatttaattcaacctatatagctaaacgatcaaagattccttgatctggtttcctatgttagaaacggatcagggggtcttttgcttttgaaagaggtcttgttgaaaaaaaaacctctgtttaccttttgagtaacaaaagataaacagaggcacccaccttgtcaaaccagcacgtggtcgttaattgaaaaatataagttgtacgcttgtaactgaacagcagtcattaaactggtccctgccagaccccattggtgtacatataagcctgtacctgctttgtgctcgcttttgactcccacccagctgttttataaatcaacaagccaatttgtttgttgaatctgcccgtctaattcacgcaaggcttttgcggtgtgattcaaacggtcggtgatttgcttggtatcgatcgttcggatcatacgaatctcattacgtcccatccgtggagcaaccttggctgcttccaatgttgccgttagcatcgcatgcgaacgccttaaagcttcccgtttctctaatgcagcagcaatcgtttcttgttcaccgattttggcgaccgcatttcgctgattgattgcaatgaccaactgggcaaattcttggtttgttgtttcataatccagcagtaagtcgtcgatgctgcggtctaacgtatcgccttcttggatcacggcactactggcaatctcttctcgtaacagagtgagtttggattcaagatctcttcgtagtaataatgcttcagcaagtttcattgatttcatcctttcgagcaaggtttcttttctttatcttagaaaaaaaacactaagctggcaagtatttgccctccaaaaagtctcgaagccattattgaaaagattgaaaattctaaaaactgtttgacttgaaaaacgaggaaaggttaaaaaaaactaaaatagcaccatgaaaaaaaaagggcctgccagcggggactggcaggcaaggagtaaaatgaaaaagttagggtttgttggtatgaataaactataccgcccaaatgtgaaaaaagagtgactaaaaaggaacgtttttgttatgatccgtagaccaaatcaaggtttttttcattgaaggtgtctccatgctccaaatcaccatatttgaacccccggttgaaccattcaactcgttgttttgaagtcccatgagtaaaactatctggtacgacatatccttggtattccttttgtaacgtatcatcaccgatggcattagcagctgtgatagcctcttcgatatcaccagcttctaaaatcggttggccgttataagtttttccttgtagataattggcaaatgtaccggctaaataatccgcttgtagttccaaacgaacactatattgattgtattctttttcagaaacctgttggcggatcttatcgagttgctgtgtaataccaagttcgttttgtacgtgatgaccaacttcatgagcaatgacataggccatagcaaaatctccgctgaccccatacttttgagaaagttctgttgcaaagctgagatccagataaacattttgatcggcagggcaataaaagggaccaacttgagaagttgcattcccacaagccgattgaacacttcctgtaaataaaaccagtttaggatcttgatacgtagtctgttctgcttcaaaaacaccattccaataatcttccaaatggccgaagacgacagcggagaattctttttcctctgtatactcgtctgaagccacattttctgtttgataattagcggcttgtccgcctcccaaaatatctgtgacggagtttaaatcacctccactgaatagaaaaaagaggactgcgataacaatcgtaccgataccaccgccggccattatttttcctcctgaacctgcggaacgaccagagcggtcttccacattggaactttgtctacccccacgccatttcattttgtttcctcctcatttgactgtttacatttattataagagaaaacgaggaagatgagaaaagtttggcttgcttgaagcgattttgcggaacaaacgaccgatattgctatcaagggaaagggtgtgcacaccttttaatcattttttaatctaacaattggtcttcatatttgttaaggtatcactagaataaaggtagagggtgagcaaatgaaaaacaattattctttgatcgaagaccgacgcatgcaaatttttaagcggctgatcaatgaggagcacttgagttaccagcaactttctgatgagtattatgtttctaggagcagtatcgccaaggatatcgcttatctaaaaacactgtttgtcaaagaaaatttactgttgcgttttgataattcaggcacttattttcaaggaagcgagtcacaaatccaacgaatgttgaagcgattcattctccttactatggagcaatcgaaaagaaccaaatcagagaatcatccgaagaagactataattggttggtagtcaaacatggaaatgaagaagaaaaaaaagagctgctgacactttttgatttaccggaagatatttttattggctccgatgaaccagaggaagtttctcgattagaacatttacgagacactaaattaaacaatccgtttctttatacattgatcgatctttcttcaaatcatcaagaacgcattgaaaaacgccttgaacctgacacatttattctttccaaaggattgatgatcacctatgtctctagagaatcgaatctcgttgagcgattgatcgagaaacatggaagtgagcttcgacattttgaggatatcattgcttttgccacattaatgatctatacccactatatcaatgggttgaaagagattaaaaagcaaatcgaccaattggatgcggctgcccgtaaaacaaccgaaaataatgaactatttaatctggcagacacagaacgagatatggtttatttggatcacacgttgaaagatcagaatcttacagtgaatcacttgatggaacgaaaagagtttttagacaaattagataatgaatcgttagtttacgacattaaactgcgacagaaatttgccaacaagcttgtcacgatctatcgcgatttattggaaaccatcggtggtctattctcggatatgatggacaataatttgaaccatttgatgaaatatttagattcagcagcattagtggttgcagtgccatcattgattgctggactttgggggatcaacactggcggactgcctgggaaggataacacgataggaacgattctagtttttgggttagctgtcttagtaggcatccttactgctgtctatctttcaaagaaagacttttcaaaaacaaaataaaaaagcaactttgtctagcattgaacgctgggcaaagttgctttttttcgtgacttcacaatcgcgaagactgtccaataagcagaggggagaagcgagaaatgaaaaatattaagaagaaaggccggggtacaatccgaacaatttatattttactttactcgctattgcatacgctcacttctatcgttgctttttctcataatccttttacatagtgaggggaagcaggtttcaaatacaaaaggcagaatcaaaggaatgccaattgttttgatgtttcatcagaaggatgtagtgaatgaggtgtgtacgacaatcaggtttctttgattgcttttattcatagggaagatgacggttgaaagcagacaatgaaagaaaatcgtacatagtctaggtaccctttatcagaaaataactttttgctgatcgaaacgctttcaaagagctgcggcagtttttttgacctcttgcagtgagtgttaacgattctaaaaaagttgacttatccttaatataacaacgttttaaatttttttgtttttttaagagcaaaatttttgtgtatttttaagaagaagcgtaacataatatgtgtaataaatatttcacagaaagaaagagaaaattatgcattggttatgggcattaatcgtaggagctattatcggtttgattgccggagcaattacaaataaaggtggatcaatgggatggatcgctaacatcgttgcaggtttagttggttcagcaattggacaagcattgttaggtagctggggtcctcaattagcaggaatggctttgattccttctatcattggtgcgatcatcgttgttgctgtagtatcatttttcttgggacgttcaagaggttaatcgtcaaatatatcagcaattttacctattatcttaaggagcagcttttcgctgcttctttttttgtatagataaactgcttctatcactgatcatcgatgttgtctaactgatgtcgccgaatgcaagcattacctttgtcagattaaaaaatactcgttacacttaatatagaacgacgaaagaaaggatgatctcaatgaaaaaaatgtacgaaacagcaatgatcaatcgtggaggccgtgatggcgaggttgaggcaccaaacggaagtatgcacatgaagatcgaccgcccaggaatccatagtgaagggacaaatccggaacaactttttgcggctggatacgcatcttgcttcaacggcgcggttcaacacatgctggaagaaaataatcttgagtctgattctgaagtcaaagcacgggtatctttatttcaattagaagatgggggctaccaaatcggggttgttttagaagtttctttgccaggacttgagaaggaccaagcagagaaaatcgcagaagaagcccacgcattttgcccatactctaaagcaacaagaggcaatattgatgtggaagtgactatagtagaataagggattcttaatgttactataaatgagattatgaaagatcctataaagaaacgctagtaaaagaaacgctagtaaaagaaacatgtagttacggtaattaatagcggtatatgtacgattgatcgaatagaacaaggaggcaaaaaaatgacacagcgggtagcaataatgattttagtgttgctggtcattggcctccttgtttactatgtcctaaagtttaagcattggaagcagcaacggatacatcaggatattgaaaaaaagttaaaacggtatcctattgttcaagcagcttgggaaaaggctgaagcaaaacaatataacattcctggattaacagaaacaagaatggtggtgccggaaaccggcgaaaatgaggtttgtcaatggatgacgccgcaagggttggctttttctcaagattttgtgtttatttctgcctactgctatgaccatcagcatcattctattattcatgtactggatagagaaacaggacagccgatcaaactgctgattttacctaaacggccacatgtagggggcttagtatatgatacaaaacgggaacttttatggttgacaatcacaggatctgctactggacgagtagccgctttacgtttgatcgatatcttagcagatacatctgaagagacgggacagccaatcgcttattggctgacaactgatctctcagagattccacaagcatcgtatttgactcaaaacaatgatcaactggtatctggcaacttcacactaaaaggtgaaggacagttgactttctatctattgccgacgatagctgaaatgaaaacagcaattcgccgcaaagacaaaatccaaccaaccgtgacaatgagcagaaaaacatctgataagattcaaggtgtggctttttatggccattatctcttagccagtcgttcttatggtccttatacctcggaactcttagtgtccgagcgggactctcctagccggatcctaaaacgaatcaaatttccaccgtatttggaacaaatcgttgttgtagaagatcgtctagcagtattgtttgaaagtggcgccgcagcgtatcgcgagaaagccaatcctgtgttagccaatgttttattactagacttagcaacgttgcttcatgcaaataagcgtcccaaaaagattgctgcaactaaaaaatagtcggacaactcaagatgatcactgttgttcataaagaacgacaagaaaaatcatctagcgatgttcgactatgggtttatttaggaagtatttctactaagattcaatatggctatacagattcggcgaaaaaacaaggcaatgttaagtttttgagaatcacagatatacaagagggacgtgtaaattggtccagtgtgccttactgtgatattagtaattctaaactagttgatttaagattggaagaaaatgacattttgatagcaaggacaggaggaactatgggaaaaagtttcttggttaaggaaataagtgaggaatctgtttttgcttcttacttgattcgaattaggttagttgagaaattattatcagaatacgtagactgcttcttagactcgccattatattggaagttattagaaaaaatttcttacggaactgggcaaccaaatgtaaatggtacaaatttatctaaactacttataccattaccacctttagaagaacaacaacgcatgactactaaaatagaaatgataagaagatctattcgtagaatcaattttgagtaaatataacggacctagcatccattttataccagatgatgctaggtctattatttatattttatggaatttaattgatttgttctagtgttttaatattattacgacagtaaaaaaatagtttgattcttctaacatgaatgaccatctagaagtggaaatgtataaaagatttattttatgaagttttcctaatatcattcactcatgatacgcagctccataccacaaataatgatattttttaagagaaaaaattatccctattttaaataatagcaataggtagtggtagggagaaatttataaatctcattttgagaaagagtattgagcttctttcactctggagagttgtccgagaggccgaaggagcatgattggaaatcatgtagatggtgcaaactgtctcaagggttcgaatcccttactctccgtagcaaatttacctggcccgttggtcaagcggttaagacaccgccctttcacggcggtaacacgggttcgaatcccgtacgggtcattttaattgaatgttggaggtttagctcagctgggagagcatctgccttacaagcagagggtcagcggttcgatcccgttaacctccataatgaactggttccgtggtgtaggggttaacatgcctgcctgtcacgcaggagatcgcgggttcgattcccgtcggaaccgtcgttcttgttattcaattaataattttaaaatatggcgcggtagctcagttggtagagcaacggattgaagctccgtgtgtcggcagttcgattctgtcccgcgccaccatggaggagtagcgaagtggctaaacgcgacggactgtaaatccgttccttagggttcagtggttcgaatccactctcctccattttataggggcatagtttaaaggtagaacagcggtctccaaaaccgttagtgtgggttcaattcctgctgcccctgccatggcgaatgtggcgaagtggttaacgcaccggattgtggctccggcattcgtgggttcgattcccatcattcgccctttttattcttggggtatagccaagcggtaaggcaagggactttgactccctcatgcgttggttcgaatccagctaccccagtttctataatttattctttattttatagattgataatagtataatggcggtatagccaagtggtaaggcagaggtctgcaaaaccttcatcaccggttcaaatccggttaccgccttagtactaataaatcaacttgccggcgtggcggaattggcagacgcgctggactcaaaatccagtgcccgttgagggcgtgccggttcgaccccggccgccggtattgactaagatgtcttcatcttagttttttattgagaaattaaataacatcttttatgatggcgaatgtggcgaagtggttaacgcaccggattgtggctccggcattcgtgggttcgattcccatcattcgccctttattcttggggtatagccaagcggtaaggcaagggactttgactccctcatgcgttggttcgaatccagctaccccagttattatttttaaatttgccggcgtggcggaattggcagacgcgctggactcaaaatccagtgtccgttgaggacgtgccggttcgaccccggccgccggtataattatcaatatagcaactttcttatagagagttgctatattttttttgtttttatgtaattacctccaaatcaattcgatacaagtattatcataaaacgagtaaaaaagatattgataacgcttttattatgtgttaaactatttttgtaaattatgtagggtgctactattcaattaggcacgacctaagaaagggttctttcttaggtcgttttttgtctttaaaaattgtttggagacaaaaatatgtatgaaggagtctgcaagttgttttgttttatcatatagaggaggtgaattaacggtgtatgtgatgaaaaagctgaatcataatgctgtattgatcgatgacgatggaatagaaaaaattgcgatggggaaagggattggcttttctgctaaagtgagtaagccatttgatgttgaggatgctgacaaattatttgtattagattctaaagaaaagatcaaacgattcagtgagatagtctcgcagattccaatcgaatttatggattttgcggaagaagtgattgaactgataacagctaggatctcctctccattagattcaaatatctatattacattgacagatcatatttattttgctattcaacgaaaaagagaagatagagatgtcacagcaattatgttgccagaaatgagattcctttatccaaatgaatatgatatagcagtagaagtggtcgagcgaatcaatcatcgatatcaaaccgagttagggtcaaatgaagtaggattcatcactatgcatatcattaatgctgagctaggagagcctaatagtttaaagagcttaaaaatagtagaaatgacgaccacgattttgtcccatctagaaaaatcctattcaaacgtttatgataaagaatcactgacttatcatcgcttaatggttcatatcaaattcctggttaaacgcttgatttatcaggaagaaacgccagtagaaaatattggtttttttactgaaacatttaaacatagcaaagcgtattgtacagcactaaagattaaagatatcatcgaacagcaatttcaacttgccattcaagaaaatgaaatcatctatttggcaattcatctagcaagaatctattaaaataagggcgtaactatctataggcgcaaccaaatgacacatagtaaatggactatgattatttggttgcgcctattttagtagaaaaaagaaggagaatgaaatgggaaaagtgatttttaattcggatgattttggctatagccatggtgtgaattatgggattatggatgcttatcagcgaggaattttgccatcaactacattgatggcaaatatgccgggtttcgagcatgctgtgaaactaagaaaggaaatgcctaggctaggtgtaggagtccatttaacattgacgtgtggcaaaccactcctcaaaactgtcgatactcttatcgaaagcggagagttcagatccttatcttattatcagcatccatttaacattgacaaagatcaactgtatcaggaatggaatgctcagattcaaaaaatttatcatgcggggatcataccaactcatttagacagtcatcatcatactcatactttggatgaaaatcaggaggtagttgttacattagcaaaaaaatatgatttgccggttcggagcaactttgaacgaaaagatgaagttcgtcatgtcgattattttgagccttgtttcgatgtcgtaggagaaactgatgaaaaaaaacgacaaatcaatacgagtgtggaagaatatttggcaagtttactcatgatattgagagaagataaaacgatcgaagtcatgtgtcacgcagcgtatttggatcaggaattgttaaatggttcaagttttgtgtatcctcgtacccaccaagtcgaatttttaattcattcagcatttgctcaaaaagtgaaaaatgatcctttgattgagttagtaacatatgaggatatttaatagaggaggaataaaaatgaatgttaaatcaaatgtgcagaagcttggaagagcgatgctacttccagttgcagcgatgccattagcgggattgatcatgcgtttatcagctgatgatatgctgaacatcccagtaattggtgcagctggaaatgccgtttttggaaacttggatatcttatttgctataggagttgcaatcggttttgtcaaaaataaggacaaaggaatacctgcacttactggttttttagcgattgctaccttgaaaaaaggcttagaaatcatggacccagaagtgaatatggggatttttggtggaattatttccggtttagtagcggcatggacgtataatcgctttaaagaacaaaaattaccagtagttttttcttattttgcgggcgaaaaattcccattgactatggtgatgattctacaaacaatcgcagctgtttttttgggctttatctggccgctcatccaaattgggattgataattttgcaaaactgctcgttgatatgggggcattaggtgtggggatatttatgtttttgaatcgtttgctgatcccctttggactgcaccatgtgttgaatacgtatatttattacgatttaggaagctatacatctcctagcaaggaagttttcagaggagagatgacacgctttatcaacggagatcctcaggctggactgtttttatcaggtttttttgtagtaatgatgtttggtataccagctatatgtctagctatctataaagcagcttataaagaaaataaagagatggtcaaaggaatcatgggaagcggtgcaggaacttcatttattgcaaatatcactgagcctgttgaatttagtttcatgtttctttctcctatgttgtacgtgatccatgcactttttgccggtttagcagggattgtctgttacttattcaatatacgaattggttttacattcggagcatgtattgttgattatctcatcaattttcgaatcgctaccaatgctattttgattcttccaatcggaattttcttttttgccttgtattacgttactttttattatttgatcaataagagaaacattcagacattaggacgtgaagctaaggcagagtttggcaatgaagtaaccttagaagaaacagagttagggttagcaagtaaaaattatgaatatatggcaacaaaaatgctacaagcgtttggaggaaaagccaatatcctggatgtctatagttgtaatacacgcctacgggtagaggtagtggatcccaccatggtcgaggaacagcgaatcaagcaattagggataagcgggatcattaaaccaactgaaaaaaattatcaaattatcatcggcttagaagtgacttatgttatggcagaattcaataaattattagaagaatagaaaggaaaagatgatgatgaaaaaacagattatcactatagctggaggcgggagtacgtatacaccaggaatcgttcaagccattttgaacaatgaaaaacggttgccattatctgaaatacgtttatatgatattgatgaagaaagaaatatggatatgtacttgattgttaaatttatgctgaaaagaaaaggtttttcaaatattcgcattcgtgcaacggatgatccaaagcttgcttttacaggatgcgattttgttttctcacaaattcgtgttggaggattggagatgcgagaaaaggacgaaaagattccacttaaacatggattagtaggacaagaaacgtgtggactcggaggatttgcttatgggatgcgctcaatcaaaggtttattggaaattgtcgatcatatacaagactatgcccccaaagcatggattttgaattatacaaatccagagtcgatcgtttctgaagctgttcgtcgtaaatatccgaatgtaaaaatgattaatgcctgtgatatgactatttcaattgaagaaacgattgcagtgaattacggttatgatcgtaagaattggatcgttacgtattatggtttaaaccactttggctggtatacatcgatttatgataaagaattgcaacgagaaattatgccagagattattgaaaaactaataacaaaagaaatgcaagtcgccgattttaatataggagacaaaacttggcaaaaaacctttcaaatgatgtcagtcatcacgaaaaattttccaagtaatatcccgaataattacttagagtattacttatatcctgatatggtcgttgagcatactgacaaagagtatacacgtgctaatatggtcatggatggacgagagaaaaataccaaagaaatggctgataaaatacgccgcggtattgtggaagaagtattgaactttaattttggggagcatggacaatatatcgtcgatatagctatttccttgttgaatgatgatcgtcgtcgctttatgctaatcgttcctaatcaaggggcgattccgaatctacggtcagatgcagttgttgaaataccggcatatgttggtgcaactggtgtggagccaattacactaagaaaaccaatcagtgattttcataaaggattgatggaggcacaagttgcagcagagaagttactagtagatgcttactttgaaggttcttatcaaaaagctttacaagcatttacattgaatcaaaccgtaccaaatgccagagtcgcaaaaaaaatactagatgaaatgatcaaagtaaacaaaaaatattggccagcattaaagtagaggtgataaaaagtgcatttctttaaaacaagaaacattctaaaagctgtagctagtggtcaaattattccattaacagcagtaaaagacgaggtcttttcttcaaaaatgataggagttggatacgctataacgaatcatgatggatatatccatgcgccagttaaaggaataatcgataatatatttcctacccgacatgccataacgatcgaaagtgaatctggcagaaaaatactgatccatatgggtttagatacagttgaactcgaaggaagtccgtttcagatacgggttgaaagtaaccaggaggtaaaagaagggacactgttagctattatagatttgaagaagttggagcaagcacaaaaagatacggtgatcattgtagtttctccaggcatttttgaaggaaatttattaaaacaaaaccaagaagtaaagattaaagatagttgttttgaattttagtgtacgatgaaaaaagttaaatagggtgatatttatgggtgaatttacaaaatttttttaaaatgatatgtttcaatcactagatttaatcattttgatttttgttaattatcgaatttttttgttgctcctatgatttagaaaacttattttcaggattcttaaaaataaatttgattatttaagagaatatattgaaataaaatttcttaattatataattagttatgaacattctttgcgttgtcatgcaatgaatggttcatattttattgaaaaggagtggttttagtggaaaagctgatgaaatgggtcgaagagaaacttgtcccaccaatggcaaaaattggtacacagcgtcatttattagcaattcgtaatggggttgtttcaacattgtcattgattttgattgggacattttttatggtctttatcaatttaccgtttcctggatggaatgaatttattgccccttattcggcaacgattgttttaccctttaggatgacgatgggattgatggctatttatgcaacttttgttatgggttcggatctagctaaatcatatggattagatagtgtgacaggtggtatattatctttaggaacgttctttatgttacaagttcctgtaaacgttttaactcctgaagaggcacctcttggctgggtcttacctatgagttctttgggagcatctgggatgtttgcggggatcttatctatgatttttgcagtggaagtatatcgtttctttaaaaatcgaaatattactatcaaaatgccagaacaagtgccacctgctgttgcccgtagttttgaggcattgattccaggtgcagtcattttaacaattacttggctgattcgaagcgtcgcgggctttgatgtaaacgctgccttattatcgttattcgagcctttaaccaatattttagggaataatttgcttggtgttttactaccaatgtttttgatccatttgttgtggtcatttggtatccatggcatgagtattgtaggggctgttgttcgtccaatgtggctgatcatgttggatgagaatgcaaaggcattggcagatggtacagctgccacccaattaccctatatcgctcctgaacagttttatcaatggacggtaacaattggtggtgcaggagcaacgatcgtggtatctgttttgtttatattcttctgtaaatcaaaattcttgaaagaggttggtcgtttttctattattcctggtatcttcaatatcaatgagcccatgatttttggagctcctatgatgttgaatccttacatgttcatcccgttcaacttagttcctttagttttgactattatcagttattttgcagtcaaattagaaatggtcaatagatttactgttttgccaacatggacattaccagctccaatcggcggttatctttcagcaggaaatgactggcgtgttgttatcttgatcatgatcaacacattgatagcatttattatctattatccatttgtaaaagcttatgataaaaagatgctgtcagatgaacaaagtcgtggagaaaacgaagtccagactgtctaagtttggtttttagaaggtgggaaacaatgtattggctgattttattttttgtttttatctttttattaacggctagtcaccttatattgaatatgctagctacatatcatattcaaatcaatcgatggatttgggcactggcatcatttttgatcgtgattcttccaaagatcattgtaccgcatatgaatgttttgttttcatgggggacatatgtactttgtggaatttttgctatcaattttatgatcgagcagcatagatggtttgtcacatcgaagctttaaatgttctaaaagtggttgtaacagaagtggttagcttcaagaaataagaagaaatttacgaaaattgcttcttaaatttttgtgaaatgttggcttatttttcgtttggttgaacttattaccgcagatgcaagcttttgaccaccgtttattcggaatatgggactgtgacaaggcttttgtcacagcccttttttacataaagattattattgttttaactgttttggcagaaagaaggaggcaaaaatgaaaattttatcagcaatggatttagaattagtagatctactaccaaagtgatcaagtcaaatatagatttgggagcttacaaccatatagtaggggctgcagtatggtgtatgaatggtaatatgtatgatgagagtgtttattcaaatcatgaaacgtgtatagaaataattgcgctgggaatagcaatcagtcatggtgaacgtgacttttagtgtatcgttgctgacgacatagaacattctgacatgatctactcagcatgtggggattgctggcagtttatataggagtatgcatcggattgcgagatcattgtctcaacagaagagggaggttgattatcaaagataaagtggtaaatcctacatttgatttagtaattgttgaggggactagcagcacaaatctctacaaagcgatgcttctagatctatatgacacattttaagaaaatgtatttgcctaattattatggtctttcttttgaagaaacgttgagatgatccaaccagagaaaggtgtcaaagaatttgactaagaataaatggcagacgctacctatgctcatttggatagcgtcagatcttttattttaaggatgattttgtgttttttagacaccgtaatttaagtaactctaacttttcaatccactatttactttttttgtattttcactgtttgggtctcgaatagcgaaattactgatgagtctctattaaaaaagctttttctacttgaaactatattgggtggttgctcaggaaggtttcgatttcttgaattgcttgttgtggaccatttattggaaaaacggcttgcagcgtgcgtgcctgctgacgaatcttgggtgaagaaacttcgcgcagagcaatctgcagttttctttcagtcactggttttgtgagggcgattgcgtttccgtattttacacaatagtcaatattacagctttgctcaaattgcatccccacaccgataaacggtttgccggattcacaggcagtttggacggtcccttccccgccgtggataaaagaaaaatcaatgaattcatgcaaaagatgactagacagatattctgttattaaaagatcttctgagtcagattgaatgtcatcaagcagatagtcaataggtgcaataaccgctagatccggttgtttttgtaagaagaacaaaattttgcgtaacatacgcggattgcctgaactacccattgcgaaatagataatacgttttctttcttgttgctttcgctgtataaaagttagcacttcttcaggcaaggaagtactgagcttagcaaaaattggaccaacgattcgataattttccggcagctgttcttcttccaaaaatagtttaggcgttgtgatgagatttagatcagcatccatcatttgtaaacttgtttttggtaaaggaagcatttctttttgtgcagcgtgtttgaaggcattggggatccatcgggtatttactatacgcttttttgtccagtgccaaaggggattgcttaaagggccgaagaaacgtaactcgtggggcatcagcgcatgctctgattgaaaaaaagattcactcaaagcatagggtttaacatatactaaaggaatctttttactgcgggccgataaaaaaattgtcacattcgaacctgtcacaatcagtcgaggctcaaacttagcaatcagactctgttcactagtgatacgagaggcaaccatttctttggtaaaagggtttttaagtgtacgcaactggtcaaattttatgatttgttcttcttgttttttcgtaaggatcggcgctagtaaatgatactcaaagccactttctgtgatcaaaggagcaaaagttttagaaaagccaaagaatacacagtaataacggtctttcatagctttggcaacctcaatcattcgtgttgtctcagctaaattgaatactgcaggagcaaaaagaattgtcttcatgaaatcctacttattggaatgagtctatcccttcgtttcttactagtatactaaaaaacacagcgttcgagtagccaatgtatattttgaatattaaactgtctctcgctgttttcacaacttctaaatttaaattttgtaatcaagttgaaactccaattttcaaaaaaacacgcaacaattttttgatcgatttatatgttgtgccagataaatacgagaagttgtgtcattaaaaataaacatgatgattgagaacataaaaaaataaaataattatattaattgataggtgtgctgtcgtcattatacacacgtaagagagaaatagttatgtttaaaaatattcttagactttctcgccatgacaattttcactatgtgttataactgtaaacgataattattcagataacacaaaaagaaatcaaggagcagatacgccagttgtttaatttgaatattattttaaaattaaaatttttattctgttctaaacatttttggttgtttagaacttttttttgtgtatgatataaaggagaaataattttttaaagggaaggaaattgttttgattaaagtagatggagcattactaaaagaataccgaaagaaaaaggggttaacacaagtacaattagcagaaggcatttgtgaacaagcaactgtcagcaatatcgaaaacaagaatatgtcgccaggcatcaatatcttaagtgcgctttgcaaaaagctgaatgtcgagatctccgatatattagtagaaacagaagaagacaaaatcaggaaaaaaataaatgagattcaatcattgaattctgtatcaaaataccaagaatcttataaaattttacaaacgatcgatcaggaaaaagtaagtaattctgatcttttaaatcaaattttattttatcaaggactgcttgatcatctttatgcgaaaaaaccagatgcagcattattttattttaatcaagtgttggaacaaacgaccgaaacagatatccatcacttacaagctgctgcaaacgtggcaatgatctacttgtcaaaaggagaattagattttgcgaaagtttatgtggagcgtacacttaaaatattgagtgagactgattttgataatctgatggtctgcattgtatattatgatatcgccacctattaccgtaaaatcgaggattatgataaagcaatccaattatgtgagaagggtattgagtataataagaaacataaatcgacttatgcattggaatacttgctttatgaaattgcttcttgccataagcaattaggagaagacgattatttagaaagatatatggacgcaaaaaaaatagcgcgtttcaacggaaatgattacgcggtaaaggtaattgaaaacgacctgaaataaagtggttgtgaaatcagtgttctgatttgaataccgtttattcgaaaaaaggaggtgtgacttttgtcacacctccttttttcgatattgtttgattcctatttaggcaacatataacggttataaaagaagcaatagattatgatggtatcgattggatggatacatcttgggattcctttatcaatttgagcgtagcgtgtttttcatttatcgataaatttgttattcatttttttgataatcctatttacatatttacgtcctggttcttaaaatgaatctacttgaatggtttttatccccgtatttctgatctcctctaatactttttcagaacaaaatttatcagtgatcaaataatcaaagacagaaatatcagcaatcttgaattttgacgtcagtccgatttttcgatgatcagcgactaaaatcttacatttgattgtcttgttgaccatcatttcgttgatcgttgattcatttaatatctttgttgtgaccccatgtactacatcgactccgctacagccaatgatacaaatgtctgcattgactgaagaaatcgtatttaatgcgatgtcgcccactagtgcttcttttggaaagcgcatctctccaccagttaaaatataactacaattatctttgtgcggagagtaattgattttcacgttgtttgtaatgactgtcaaatggttagattgaagaaaatccagtgttttcaacgcagtcgagctagaattgataaacagcgtatcataatcgttaatgtatttactagcttctctggcaatcgcttgtttaatcctttcaggaccagattgatcaaaatcagtctggtttttgtaattataagaacaataaccgtaattgcgtatgatctcgtttttttcttctaataaatttaaatctcttcgtatcgtactaatagatacatcaagggattcagctaattcgaaagttgatagttgttcagtctgctgaagcagttccaaaatttctttttgacgtttttcaatattgacaagtgagtttttcatgacttttgcctcctgagggacatcttgatccatggatttatttgactagttgttcatttaaacattcatatctgtctttattatactgaaacaatcattgattactgaaagaaaatcatataaaaaacaaacggtcatataaaagggttttcatggatgctgatacacattaatatttacttgtaagttggaacaacgatatggggggagcaagcaaatgagtaaaactgtcaatgaagtaacaaaagaaaagtggttagtagaaacatttcctgagtggggcacatacttgaatgaagaaatcgaaacagaagtagtggatcctggaacttttgctatgtggtggctgggctgtacgggaatttggctgaaaagtcatgaaggaacgaatattttatgtgatctatggtgtgggacgggaaaacgtagtcatgggaatggcatgatgaaaaaaggccatcagatgatgcgtatgagtggcgttcaaaatatgcagcctaatttacgtactcagcctttcgtaatcgatccttttgcgataaaaaatgtagacgctttaatcgttacacatatccattccgatcatctagatatccatacagccgcagcagttcatcaaaattgtcctgaagcaacattcattgggccaaaagaagtggttcgcacgtggcaaaaatggggaattcctgaagaaaaaacgattacagtaaagccaggtgatgcagtcaaaatcaaagacatcaatgtagtagctttagaagcgtttgatcggacagcgttggtcacttgtgaagatccagaagaggtattaaaaggaaaaatgcctcaggagatggatcaaattgcagtaaactatttattcgaaacatcaggagggaatctttatcatgcaggagattcacattactccaatttatttgccaaacatggtaatgaacacaaaatcgatgtctgtttaggggcctatggtgaaaacccacgagggataacagacaaagttacttctgttgatatgctgcgcatggcggagtcattgaatgcaaaagtagtgattcctgtccactacgatatttggtctaattttatggctgatccaaaagagatcactgaaatttggaaattcaaaaaggatcgcctgaagtatggatttaaaccttatatctggcaagtaggcgggaaattcatctatccgacaaacaaagatgatcttgagtttaatttttatcgaggatttgaagatgtcttctcgattgaaaatgatacaccgtttccgtcgtttttataagaaagaaggggagtttcttgctgaaatacttttttgaccatcaattgattcattacccagataaagaaatcacggattggcgtgaagctatcgccgaaagctgtcttgtattgatcgataaggaaattattgatgaaacgtatgtggaggagatcatccattgtgtagaaaaatacggtccttatattgtgatcgcacctcaagtagcaatgccgcattcttcagaaaaaagtgatggtgtttttggaacagctatttcatttaccaagttgaaacagccaatccgttttgaaagtgaaggggagaatgaggagaaaacggctagtttgttttttacactcgcagcaaaagatccagaagaacatctagaaaatatccaaaaattatccgaattattaatgacagatggattggttgagcgtctcatctctacgaactccatcgatgattaccaagttgtgatggcagaatataattaattgatagaggagaaaaaagatgggggaatttttgttaagcatttggacgtattttgcaacaaatatcttgacgcagccagcatacctgattggttttatcgtgttattaggctatattttgctgaaacgcccgcttcatgaatgcatcgctggattcttaaaggcaacggtcggttactttattttgactgttggctctggtggtttggtcaataattttcggccaatcttggttggactaaaggaacggttcaatttggatgccatggttacagatccttattttggacaaaatgctgtggatgctggattaatggagacatttggccgtacctttggagatgtgatgattttattactgattgcatttgttttaaatatcttattagtccgttttcagaaatatacgaaactgcgttccgttttcactaccggaaacgttcaggttcaacaagcagctaccgctttttggattttactgttttgctttcctgatctaggtaggatacaagtattgatttttatgggactgattttaggttgttattgggcagtagcttctaacttaacagtaggaatcacgcaggaattgacagaaggtgccggatttgcagtggcacatcagcaaatgttcggaatctttatatttgcaaaattagctgagtggatgaaaaagcgggatgaaaagaaaaatagatcaatcaagcaagacaaaaaaattgaagatatcaaattaccaggattcttgtcgattttcaatgagaatatggttgctacttcgttactcatgctatttttctttgggatcattctgattgtactaggcaaagattatttgattcaagcgcaattcatgcaagaaggacagagtttcttattctacattatgacgacttctttaaattttgcggtatatctggcgatcttgcaattaggtgttcggacattcgtcgatgaactaactcaatctttccaaggaatctcaaacacgattttaccaggagctgttccaggaattgacgtagctgctacttttggctttggttcgccaaatgcggtaacgattgggttcttgtttggtgctttgggacagtttttgatgattggtttactgattttattgaaatcaccaacgatcgtcatagccggtttcattccgttgttctttgataatgccgttatagcagtttatgccaataaccgaggtggattcaaagccgcttgcctgttcccgtttctttcaggaatcatacaagtaggcggttcagcattattcgctacatggattgggatgtcaacatatggtggttatatcgggatgttcgactgggcaacagcttggccattgtttacagtaatcatgaaagtcctaggttatgctggaattgccgtagttgtcattggtttattggctattccgcagttacaatatcggaaaaatcctgagggttattttttgattgtagaagactatgacacatatgcagaaaagcagagagtataaaagaaaatctgattagacaacactcataatggagggattaagatgagaattttagtatcgtgtgcaaatggatcaggaacaagcttgatgatgatgagaagtgtggaaaaagcaatgaaagaactaaacgtaccaattaccaaaatccatcattgtgccatttcagagggaaaaagttcagctggccaatacgatgtagtttttacgccagtcaattttttgaatatgtttactcaggcagagaaaaaaggagttacagttatcggtatcaaaaatgtgatgtcagccaaagaaatcagtgaaaaatttgctgaaacaaagtggtaccaaaaaaacaagtaaaggaaggaactaagatgagcaggccgaatttgcaaattgcgttagatcacaatgacttagaacatgcattaggagatgttatgaaagttggtgatttagtagatattattgaagtgggcacaattctttgcttacaggaaggacaaaaagcgattcgctgtattcgcagtatgttcccagataaaaaactagtcgctgatacgaaatgtgcagacgctggaggaacagtggcgagtaatgttgcaaaagcaggagcagactggatgacagtcatttgttgtgcaacgattccaactatggaggcagcacaaaaagaaataggtgaattgcaagtagaactctacggcaattggacttttgaacaagccatggattggcataacatcggtatccggcaggtaatctaccatcaaagccgtgatgcgctgttatctggtgaaacttggggtgaaaaagatttatcgaagatcaaaaaactgattgaactaggctttaatgtttctgtaactggtggattaaatccacacacattacacttatttgaagggatcgatgtgtatacctttatcactggtcgtggtattacagcagcaaatgatccgatgaaggccgcacaaaacttcaaagatgagatcattcgtatctgggggtaaggaaatggctcaaattgggatttatgaaaaagcattacccaaagatatttcatggaaagaacgtttttcccttgtaaaagaaatggacttcgattttatcgagatgtcgattgatgagacggatgagcggttagcacgattagattggtctgaagaaaagatagctgagctgagagaagagatgttcagctccggtgtacgtattcattcgatttgtctaagtgcgcatcggcgatttccgtttggttctgctgatccagaaaagaaaaaagcagcgaaacaactaatgaaaaaagcaatccatttggcgcataatctaagcgtcaaagtaatccaaatagctggatacgatgtttattatgaagagaaatcaatgaattccagagaagactttatcgaaggaataaaagaaagtgtaaaggaagcctctaaatatggcatcattctttccgtggaaatcatggatgatccatttatgaactccatttcaaaatttttagaaatcaaagaacagattcattccccttttctacaagtatatccagacctaggcaatttgtccgcatggccggaaaataatccggctcgagaacttgagaaagggatcgattatatcactgctatccacttaaaagatacttaccctgtaacaaaagaatattcaggccagtttcgtgatgttccttttggtagcggttgtgttgattttcttggattattaagacatttgaaacgtctagattatgatggaacatttctgattgaaatgtggagtgaaaaaagccaagactttcgaagagaaatccagcaggcaaaagactacttaagttctaaattgaaggaggctggctatgatgtcttgtgaagaaaaaattgcagcaatgaagcaacgtgtccttgaagcaaatctggcattgccgcgatacggattagtcaaattgacttggggcaatgtgagtgaagtggaccgtgagctaggagtcatcgtcattaagccaagcggtgtcagatatgaatgcatgcaagcagatcaaatggtggtaacagatttgttgggaaatataatagaagaagatagcttaaaaccatcttcagatctccccacacatgttgttttgtatcaaacttttgaagatataactgctattactcatactcattccacgcactccgtcatgtgggcgcaagcaggacgcgatttgccagcttatggcacgactcatgctgatgctttttatggtaaggttccttgtacacgccaattgacgaaagaagaagtaagagaagcttacgaagttcatacagggaatgtgattgtcgagacgtttaaggaaagaaaattagatccaaacgaagtccctggagtacttgtttatggacatggaccgttcacatggggggattcacctatgaaagcagtagaaaacagtttgatcttagatgaaatttgtctgatggccaaagaaaacgagctgatcaaccccaatatatgtgaaatcccgcaatatttactagataaacattattttcgcaaacatggaaagtatgcatactacgggcaatagaaatcctggatcaagtgtagaaactccaaaattaatacttgttaaaatgaattagaggttgtgaaaaaatcttatcacaaccttttttgtatatcaaaaagcttatatcttaaaagaaaagctgaattctaaggaatcgagtgaatttttacaggagaattgtaagagatagactaaataatcaaagacttatattaatgttatatactttagctcatattgctggataatgttcattctagtcgactccacttattatcctggtaaaattcaatgtgccgtatttcgtcgtagtgaattttgtcttttccaacgtagattcccagctcatcactacctaagatctttccaacaatatcgtatggatagtatccttcggcgtttcgttcttctttttggatacatactgatctattttttatgactgcagcgttcaatactttcacaatatcttcagtcgtcatttgttcttttgccaaattatgattggtacgttgctcattgtccgcatcgatctcttcagtatgatcagataaataaaaccctgcccactttaaacgaccacgatcattgtaatcaatcatttttaattcccacatttccgcccgcatgaccaccaacaagtgtgcttctagtaatgcttctagcgccttctaacattgaagaagcatgtacaatcgacgtaaaaccatatttttgccgaatcttgtcaataattttatctaaattttcttcgtcaatttgcttttgtggatcactaaataaatccagctgaagcgaatcagtataaaatagcttgctgtaagtgattccgacgtggcggacttcttgtccttcataatacttatcaaacaagaaaagacaataattctgcaattcctttgtattgtctgtgatagggattttcatctggtgtgagaaccctggtctcgtttctaagatcgatgtaccaatgtctaaatggacacatcctgttttacaattatgctgtctgatacgaatggctacttgttccgccatttcttttacaaccagctcgatttcatttcttctagtataatcacgtggcaacacttgtgaattaccataggacttttcttttgtcggttctggtgggattgctatatcagttcgatcaataccatttgcatgaaagtatagctgtaagccaatcacacctaaacggctcttaatggtgtatggattccagttagcaagatctctaatgctcataatccccatctgattgagtcttttcttcattcgagagccaatgccccaaaagtccgtcatttcaggaatattccatactttttcaggaacgttttcgtacgtccattccgcaataaatccttcattatgctttgcttcattgtctaaggctagtttagccaaaaggggattatcgccgacgcctaccgtagcaatcaaacctaactcttctttaatacgttcttggatcatttgagcgagcttcttccttcgctgacttcgtgttccttcagtcgtaaaaagattcagtgatcgggtcacttttaagattgattcatcgatcgagtaaatcagtagatcttcatcagccacatatcttctgaaaatattatttacctgcatatttcgcttgatatataggttcatacgtggtggaacaacgtgtagtgttttaggaaatggttgtggtaagtcacgtggtctactcacatttgtaataccataccgcttttttgcttcaggagaagaagctaatatcaatcctgaaccagtattatcagatcgactcataacaacaagttctgttgttaatggatctaaatttctttctatacattcgacacttgcgtaaaagcttttcatatcgattaaaaagtaatcatttactggctcttttgaataatccatcataaataacactccattctttcacattatacaaacatatgttcgatattgtaaagaagaaatagctaaatacataaaaaaagaagcataggtatgctatccccctgcttcttcttttgatttgtatagttaactcattgtatctttttattatatattttgaaaatcgattaattatcattcttagcttttcttataatacacgcgaattgtaaaattaagttagaaaaataaaaaggcatttatggtacactcaaattgtatttccgacgaaagaaaacaaaggagtgtaaccataaatgacctacaaacatcttaccatagacaaactgacaatgatagaatcatattatcttcaacataataagccggttgaaatcgctaaccgaatgggacgtgctatacaaactatttataatgtagtcaataagttcaagcaaggcaagactgctcttgattattggcaccagtataaagaaaataagaaaaaatgtggtagaaaagtcattcaattacctgctcatgaagtagattacattaaagagaaagtcactcttggttggatgcctgacgtcattatcgggcgaaaagaaaggcctgtttcatgcggtatgagaacactttatcgtttattttctaaaggaatatttgatattgacacactaccgatgaaaggtaaaagaaaacccaatggccatcaggaaaaacggggaaaacaacagtatcagcgctcaatccatgatcgacctgataattatcctgatttcaattctgagtttggtcaccttgaaggtgatacgatcgttggcattcatcataaaagtgccgtcattactttagttgaaagattatctaaagtcattatcacgattaaacccaacggccgtaaggcattagatattgaaactgcccttaatcaatggttttctcgcttccctaaaaacttctttaaatctattacgtttgactgtggaaaagaattttctaactggaaagccattagtaaccaacatgatattgatatatattttgcggaccctggaacaccttctcaacgcccattaaacgagaattctaacgggattctgcgtcgtaatggactgccgaaatcaatggattttagagaagtgaatcagacatttatttccagtgtcagcaatcaacgtaatcatattccaagaaaatcattgaattacagaacaccaatcgaaatatttttgagctatgtacaagaagcattttattctagcttaatttgacaaatcataactttaaattacggatcatgatttggcatggggaatcattactaataaaataaaaaaatgaacagaaagaaaacagttctttctgttcaccaacttcatttgacaaatatcctatttagcttattttatagctttttatatacacttttttaaaaagtgatttttccacatgaattcccttgagcaattcgaccattatctattattaaatcattgaactgatttttctccggaaaaacaactataacagaagtatctttaccagattttattattttgtcaaaatccacatcaaccaacgaggtttcaagagtaacctcatcattttcttgaacacaaatcgaaaaaggctctccttgtaattcgactgtatcaattccaatatgaatcaaataatcaatgcctgagttgctttttatattaatagcatgtttagtaggaaatatatttgttactcgaccagccaatggagcataaatttttgaaccatcaggtatgacggcaaaaccatcacctagtaatttttgtgaaaagacaggatcatttacttctgtgatggaaatgatttttccggaacaaggtgcataaaaagtttcttgttttttctttttgaaaatttcaaacatattaaaaacctcctaattatcttttcctaatatttgattgatttcttgacttaataagtcagctttccctccaaaaacagcttggatgccacccttcacttcgaagacagcagttgcaccagtgtcttttattgtttgtttttgaataatctccccattcgtaacagcaacacgcaaacgagttgcacaagcttcaacagactcaatattttcttttccaccaagagcttcaataatgataagagactcttcatgtaatgatgtatttttgtttattactttttcagaatgaacttctgattcttcttccattccaggaatatctaccttaaattttttgataaagaatgtaaaaacaaagaaatatataaatgcccatgcaataccaaaaggaattaattttaaccaattagttttgtcattcccttgaagtacaccgaataataaaaagtcgatcaaaccacctgaaaaggaattccctacacgaatatttaagatatcagcaaaataaaaagataatccatctaagaatgcatgaatcacataaagccaaggagcaacaaataaaaacatatattcaactggttcagtaattccagttaaaaatgatgtaagggccccgctaaaataaagcccaccattctttttacgatttttcttaggaattgcacgatacattgcataacatgctgcaggtaatccaaacatcattgttgcaaatcttcctgcaaaaaatctagtaccataagtaaacagaccagtgtggtttggatcagctagttgggcaaagaaaatattttgggctccagcaattgttgatccagctacagtttcggtaccacctaaagatgtataccagaacaaagggtaaatggtgtggtgtagtccaacagcacctgttaaacgcaataaaaaaccatataaaaaagttcctaaactacccatttgagcaatttgttcaccagcaactactaaaccattttgaattggtggccaaattaagtaaaagacagaactaataatgattgcagctaaactagaaacaatcggaataaatcttgatcctccaaaaaaacctaagaattgtggtaattcaatttttctatatcgattgtgtaaaaatgcaacagtaccaccaacaacaattgatcccactacacctgtatctagtgttgcatcttttgatgaaaaaagttcaagaaacccactaatagttgcagtatatactagataagctactccaccagctaaaccagctgttcctttatctccatttgcaagtcctacagcaataccaattgcaaaaattagtgctaggtttgcaaaaactgcatttccagcataactcataatacttaaaattgtatgcaaccacggttgatctaaaaatggataagcatttatagcactctcatttgttaacgctcctcccagtcccaatagtaatccggctactggtaatatagcaattggtaacatgaaagcgcgtcctaattgtgaaaattttttaaacattttatttctccccctaacttaatgctttaacaaatcttgatgcaatttcctgtggtcgagtaatagcaccacccacaacaatacctgcaactcctattttttttatctcttttgcttgttctggagtatgaatccttccctcagcaattacacaaatcccttcttctaccaattttttaatcaaatctatatctggcccatcttgttttttactttcctcagtatatccacttaaagtagttcctacaaaatctattcctgctttatatgcatttttgccttcttcaaatgtagaaatatctgccataaataactgatgaggatatttttcttttattttagtaataaaagaatttatagatagtccatcatgccgatttctaagagtgcaatcaagagcgattacctcaacaccggtttctactaattcatctacttctctcatagtggcagtaatgaatggagattctggtggataatctcttttaataattccaatcattggtaatgatacacactttctaatttcaataatatctcgaacagaatttgcacgtataccaactgctccagccctttgagcagccaaagcaaaataaggcattaaactttcttcctctttgtaaaatggttcaccaggtaatgcttgacatgaaacaatcaaaccttttgaaataagatctaaaaacctttttttatccattatcctaaacactccaattttttattatttttggataataactccaaaaataatatagcatccgctttcataaaagtaaagataaaaatagagtatttaggagttttttttattattttggagtataatggagaaaagttgaaattgtagaggagtttgtatgagttatatctatttaattaaagaaaattatccatttttaacgaagtctgaaaaaaaagtcgctgattttattttaaattctgggaaaactattatttatagtacgatgagtgatattaagaaaaacacaaaagttggcgatgctactattattcgcttttgtcaaaaaattggtttttctggtttttctgatttaaaaattgaaattgcaaaggaagactttagtcaaaaaaaagaacatccgactagtgtaaagtactatgatgaaattgctaatagtttaacagaagctctctattccactattaggcttttagacgaagaaaaattgaatgaagccattaaaatgatcactcaatcaaaaaacatatatatatttggagtgggatctagtggaaatactagtcttgatttagaaaatatgtttcttcgcgtaggagttcaagcaaaagctgtactagaccctcattttcaagcccaagtcgcttctttattaacagttaatgatttagtaatcattttttctttatctgggaaaacgaaagatacttatgattcattgaaaatagctaaaaaaaatggcgcaaaaattattgctataactaactatattcattcacctataggaaagtctgcagacttagttttacaaacagccattgaagaatttcttaatggtggatctttagctggaaaaatatcacaactttatatttgtgatctattagttcatggttatgaacaaaacaataatattgattcagttgaattaagagaaaaagttttgcgctctattattgataaaagtattgagtgaactacccccacctagctaaacctaacggtttttaacgattgaagtaggcaattcttgggatgagagcatacttgatagcttattttttactaatagcggtggctcttattgaccaaatatccccgtagttcctacggttcttgattttatctaaagatatttttatcgtggaagctattgatcaacttgaaagaaaaacgtgtagctcattatcactagtttatcgagtatggatgaagcaatggatcatcctctcttaaataaatttattaaggatctgatccttcaaattttttccatgatcgatgagcaggaacctactgaatctaaacgacatcgggcacaaggaattattaagattgctaagcgaatgttttctataaagggtgttctaagctatacagtgttaattcaaaagattcccaatcatcttgtttataagaacaacgttgaagattaaaaaagtgtttcaatgctaaaattgcaaaatacttcaatgttatgagacaaactgtctataagaatcaatttccacccatttcatcacttgttaaaagtttatgatccttttgatttttatattaatttatctgtatttaatacagattttatttattagttcatctgcctattgtattttattttgttgccttaccatctgaagtaaatatactcttaattgtcaaattaagttagacagatcatcaatacttacgtaactcaaaaatacttccaaaggtgttcgataatccagtgattttctaggaagattatttctgcgccagcattttctaatgtttgaatttgtgttttgtaatcttggttgcttgtgctaattcttgaatagccgtaaattgccaaaatttcatcaccctttctggacataagtttctgacaccagttaaaatcaagtctatcagtaacccatacacccgtgaggacgggtgtatttttaatccccctagaaggggtcgacactcgctgccccttaaaaggggatttttaaaagaccgccaactgctcatcttcactcacttacttctctttattttttaaatggttctacgtactctcttttacttataatatatcgaatgcgatcatcagcttcttgttcacggatgtatttttcatttgtcttttgattcaatccgactgtactcacatagtatctcttcgaccaaaaggatttgtttccgtatttatatttgagatttgcgtgctgctcgtggattagtaccgcactacgacctttcagataccccataaaactggatatacatatttttggtggtactcgaacaagcatgtgaatatgatctagcattgcatgtgcttctatgatttccacatctttcatttcgcacaacttcctaagtatttttccaagatcttttcgtaattgcccatagattacttttcgtcgatattttggtgtaaaaataatatgatacttacaattccaacgagtatatgctaaacttttatcgtcatttgacatgaaaaaactcctttcgatctgatgagcggttggtagccactcactagtatatcgaaaggagtttttatcgctaaagatacttcttccacgcgtagaaacgcgcggttttcttgtttcgcacgctttacgcacaaaactgactgaagccattaagaaaataaaagggtctaaaacttttaagttttgtaccgacccccaaaagttagaccaaaaaatctaacttttggaggtcggtattttttatagctaagtatacttttgaacttaaattaaagatcgttcatgattatttggatggtaaaggcggaagtgattatctggcaaagaaacattccattaaggttccatcacaagtgaagcgctggatcaatgcctatcaagtatttggtgaagagggtctagtaagaaagcgacaaaagaaaaaatattctgttcaatttaagctggatgcgatagagttatatctaacaagtgagctgtcctatcgtgaagttgccaacacacttaacatgaacaaccctaatttgatcgctagttggatgcatcaattccgtgagggtgggatcgatggactctcaaaaacgaaaggatgtccacctatcttgtctaagaaatatgaacccaaaaataagaaaaaatctacaactaaagcaacgtctaaagaacgtgaacgcatcgaggagttggagaaacgagtccgttcccttcaaattgaaaatgcctctttaaaagaattgaggaagctgcgaaaacaggaagcccaacaacgacgaatgaagcaatcgcacgaatcatcgcaagcctccgaggaccgtttaaattagttgagcttctagaaactttaaagttccctaaggcaacctttatgtactggcaaaaacgattggaccgtaaaaatccaggtcaagagattgaagcggaaatgcttaaagttcgggagaagcacaaggattatggctgtttacggatgaccaatgaactaagaaaccgcgggttctctatcaataaaaagaaagttcagcgcctgatcaagaagctaggaataaaagtaacgacatacacacgtaaatcacggcgctacaattcttatcgaggacaagtcggagcagtagccaaaaatcggatccatcgtcgtttctacaccagtatctgccatcagaaaatcacgacggatacaactgaatttaaataccatgaagtggatgccaaaggcattatccgtcaaaagaaattgtatctagatccttttatggatatgttcaatagtgagattttatcctatcgtatctctgaaaagcccaatgcattagcggtaatggaaagtttggaggaagctatccagaccactaacgattgtccctatcgtcgtacgtttcactcagatcaaggttgggcgtatcaaatgaaagcttatagaaacaaattgaaggagtacaaaatctttcaaagcctgtctcggaaagggaactgcttagataattcacttatggagaatttttttggcttattaaaacaagagatttttcacgggaaagtttataactgtttcgaggaattaaaatcagccatcgatagctatatctattactacaatagtgaacggataaaacagaaattaaactggcaaagtcccgtccaatttcgtaaaacaaccgtaacagttgtgtaaaaatatcattttagagcatgaaaaaaggagtggatttctccactccaaaaaagtctaacttttgggggtcactacaagttgacaactcctttttgtttacaaatcaattggatatctacaaattgtattttctaacgaattttatagacattaaaaaattaatttaacgttaaatacttcctccagaaagtattgagattggtaaaatataatccttatttgtcttttcgcctttaatttttttcagaagaatatcaacaataagacttgcaatttcatcaattggttgtcttattgttgtcaattgtgggaaaaatttctcaataaaagaggtaccatcgtatccaataatttttaaatcttctgggatattaagtttaagttgatgagcaattttcatagtgagaatggctgttaaatcatcagaaacaaaaataccatctggtttgtgatttataatagttgactttatttccatttcacgacggatagtagacagattattaggaattttgaaaatttttccatttggattttgaaaagaaaaacctagtgcacgtaattctgtgggagaatccgtgttatcatttcctgtaatcataatggtattttgacaaccatttttttgtaaagtcttagctgcaagttttcccccttcaaagttatctgaagaaacaatggaaacattaggagctaaatttctatcaaaagcaacaataggtgctctcacacgctcataatcagcaattccaagattatggcttgatgagattatgccatcaacttggttggcttcaagcatttcaatgtattctctctctttagcaggatcattttgactattgcaaataatcgttttatatccatgtttaaataactctatttcgagatactcaatgagttcagagtaaaagatattactaatattaggaaaaataagaccaataagctgaggtgactttccttgaagtccacgtgctaaattatttggtttataaccaagagttttcatagcttcatgaactttttgttttgttttttctgataaatatcccttattattaatgacgcgtgaaacggttgttgggctaactccagctaattcagcgacatcagttaattttgctaccattttaatattttaattcaaagtattttccagtaggttcgcctgatttgatttgaataccattttggtgattttcagggaatacacgactagtaaacactttttctcctttattaataaaaatctcaatgattgagttatctacaaaaatgttagcagttgtttctttagtatcaattgagcattcacgaatcgtaccaaagtcagtggcatattgaatgcctgctttgctgcgatctaaaataatttttccttctttggtatctacaatcaagctaagtccatttcctttactatcagagaaaagaagtaactccgatttctgatttggaggaaaagttagttcaagctcataagtattatttgtttctgcttttgctgtaaattgttcagaactagcacgtaatgatgtaatagcttctactggatattggtaaagtttaccatcttttattgaaagttcttttacaagactcattgctccctgataatcatacttatcagttggataatcgatatcaggtagtccaatccaactgacaatcagagcacgaccatcaggagtattgaatccttgagtcgcatacgcttcaaatccataatcaagattttgaatttctgaagcgcccacaagttttactttttctatgtcaagcgattgacagatcttaaaagtattcggatagatattcccataatttagctcagatttatccaacccttgaggacaataaatgagaacaggttttttgtctacaaatactagatttggacactcaatcatgtattctgaaccagtgccgccaaaatcaaggttgccaacttcctcccatgtttccacgttattgtcatccgctttgtaaagtttgataaagcctgatttttctaaattttgtgctccaacaatcgcatacaattgtccttcataattaaacatttgtggatcacgaaaatgatcagttacatcagcaggtttatgaataagaacattctcacctttcgtaatgttgtagtctttatccatccatgctccgatttgaagtgtatcacgttcccaattttcatttcgaacgtttcctgtatagagtaagaatagattctcctctatttcatatgcagaaccggaataagcgccgtggctatctcgttttgtgtctggaagaagttctgctcctgttacatgaaaatgaattaaatcatctgattcattgtgtacccattctttcaacccatgagcagctccaaatggccaattttgataaaaaagcgtatattttccgttaaaaaaagaaaaaccattaggatcgtttaacaatcctgttttaggttcgatgtgatagctagcacgccaaggtgatcgttttacattatccttaattttatccatctcatctttagtccaatcagaataagcacgatatcgtatttctcgaggtaagttcatattttactccttcaatttatctttttacaactagtatggtaaacgttttccgttgaaaaatcaatcatttcatttaaaaaaataaactatatgacaaacgtttgacatatttttaagatatgctaaaataaatttgcatttcagtgaaccgttttcacgtaaaaataaaaaaggagtgattcgaatgaattacagtaaagtagcttccgacgtaatacaagcggtcggaaaagataaccttattgcagctgcacactgcgctacacgtcttcgtctcgtactaaaagatgacacgaaagtgaatcaaaaagctttagacgaaaatccagatgtgaaaggcacatttaaaattgatggacaatatcaagtgattatcggtgcaggtgatgttaatttcgtttatgacgaacttatcaaaaaaactggactttcggaaatttcaacagatgatttaaaacaaattgctagtaaagataaaaaattcaaccccattatggcattaattaaattattatcagatatttttgttccaattatacctgcccttgttgcaggtggtttattaatggcattacaaaactttttaacagctgctggactttttggaccaaaatcaattgaagaaatgtatcctgcgattgaaggtatttcctcaatgatccaactgatgtccgctgcaccattcatgttcttaccaattttagtaggtatttcagctgctaaacgttttggagcaaaccaatttcttggtgctgcaattggtatgatcatgacaacaccagatcttggtggctcaactgaatattggaatatttttggttatcatgtttcacaaacaaactatgcttatcaagttattccagttttagcagctgtttggatattatctatattagaaaaattctttcataaaaaattgccatcatctattgactttacattcacgccattattatcagtaatgattactggatttttgactttcacagttattggccctgtaatgttattgttgtctaatggaattacagacattattgtttggctatataacactactggatttattggaatgggtatttttggaggaacatattcacttatagtcatgactggtttacatcaatcatttccagctattgaaactcaattactttcagcgtggacaaatggtatcggacatggagactttatctttgtagttgcatctatggcaaacgttgctcaaggtgctgcaacatttgccatttggttcttaactaaaaattctaagacaaaaagtcttgcttcctctgcgggtgtctcagcacttcttggaattacagagcctgccttgttcggagttaacttaaaataccgctttccattcttttgtgctttaattggttcaggaattgctacagcagtagcaggattacttaaagtagttgctgtttcacttggttcagcaggtttcttgggatttctttcaattaatgcaacatctattccattttacgtattgtgtgaattgattagctttgtagttgcttttgcaattacttacttctacggtaaaacaaaagctgctggtatctttaaagcagaagaaattgctgaacaaacaccagttaattcttcaaaagtagcaacaacagatccaatatctactgatgttgaatcaacacaaacaaaagtttcatcagaaacaattgttagtcccatttctggtaaagtgattagtctttcttcagtaaatgatccagtcttttcatcagaagctatgggaaaagggattgccattaaaccaaatggaaacacggtccattctccagtagatggtactattcaactcacgtttgaaactggacatgcttatggtattaaatcaaataatggtgctgaagttctaattcatattggtattgatactgtatcaatgggaggaaaaggatttacacaaaaagttactactaatcaaaaagttagaaaaggcgatattcttggagcatttgaccgttcaatgattgagaaagaaggtcttgatgatacaacaatgattattgtgaccaatacttcggattattcagaagtaaatatagtagctgaaaatacagtcactgagggtactgatttacttgaaatcaaataaatatatttccctgagtaaagatggaattttctttccaaaatcaaataatatagattaatcaaatatttgagaataacattttatttaatcttttcatatatcaattgtatgaaaaattattagaattttaaaaaatgataaaaattcaaaaagaaaaaatagtagttatttacttgtcatgttactaaataaaaaaataatttaaatatgatatatagtcatttatttagtgatttcattctaaaataaagggagaaatgtctatgctatacggtgcaattgaagcaggcggcacaaaatttgtgtgtgccattggcgatgaaaaaatgacgatcaaggaaagagtgagctttccgacaacgacacctgaggaaacaatgcctttagtcattgacttcttcaaacaataccaagcagatttagcagggattgggattggctcatttgggcctatcgatatccatcgcgattccgccacttatgggtacattacctcgaccccgaaattggcatggcaaaattttgatttcatcggtaccatgaaaaaagaatttccgatcccgatttcttggacaacagatgtcaatgcggctgcctatggtgagtatgtcttcggcagtggcaaaggattgagcagtgtcgtttactatacgatcggtacgggtgttggcggcggtgccttacaagaagggcgctttatcgaagggtttagtcatccagaaatggggcatatgctcgtcgtccctcatccaaaagatgactttgctggcagctgtccatttcatggcaactgtttagaagggatggccgctggacccgccatcgaaaaacgcttagggaaaaaaggacaagaggttgcagaagatgatccttattgggaaatcgaagcctcctatattgctcaatgtgcctacaatacaaccttgatgttttctccagatgtgatcatttttggcggtggtgtgatgaaacaacgccatatgctgcaaaacgtccacgacgcatttgcaaaattggtcaatgggtatgtcgaaacacctgagttaagcaaatatatcgtgaccccagcattagaagacaacgctggaacgctcggttgtttggcattggctcgagaagcggtcttacattcataaacgaaaaaaggcttttcgacatttagtgttggtagagaaagatacaactgaaaatttagtcataaccagttaggcagagtgcttaactggtttttgttttacttggaagatcaagccttgaatgagataaattcttgctcgaaagttatggaaatttcgatagccgtaggccacttgtattgtgcaatagttttttacaaaaaaaagggggtgcggatatttttttggacctttttaacaaatatatctttgcttcttccgatattgaagagggcttagccctcctaaagataacttaattcgttgattattataccaatgaatataatcatccaatttgtttataaactgattgattgttgtattcttccagtcacgttgataaaacatctcgttttttaatcgtccaaagaaaccttcgcacgctgaattatctggtgaataaccctttttagacatagagtgaagcaagttggctttgttccaatagtccaactaacaatagcaccatcgtaacaatcgacaagtggtgataagtagattttccctgcgggaattctaaattcagtaatatctgttaaccatttttcatttggcttctttgctttaaaattccgatttaataaattggggtgtgcaggagaaatttccccagcatacgaagaatacttttttcgtctagaaaatttaacaaatagattttcctcagtcatcaatctacgtacaactttttcagaaagctttttacccatattttttaaagcttggtgaattctacggtaaccatacgcacagaagttatgattgaaaatcgtgataattaattgacgttctttgtaatacttatctggtttctcaagtgcttgtttttgataaaaatagctgcttttaggcaactggagctgttgaagaagctctttcaaggtgaactgatttcgtaaggcatcaatcaatattgttttttcttgatttgatagacaaagaagattgacgcctttttctttttttagcagttcagccgctccttcgagtaatgctttttcgagctgtaattggtgtacttgtttttgtaagtcttctacttcctttaaaagtagctctttttgtttttcctgattttttaaagtcatacgcaatggaaaatcctttccaagaaccgtgtttttccattgatatagagtaactctactaattccttcagattcggctaaatttttcctattagtttgcggtttatagaattttttcaacacagcttctttttggtcttgtgttaactttaccgcactttttcggagttttctagctcctggtgcaagttcttcacaccactgccgcaaggactctctattaggataaccaagcatgcgaatggttcgtgcataacattgaccatattcaaaataatgattcaccgctattcgtttttgttcttcagaatactttgatttttttcggtgctcctgatggagctctccggattccaaatactctttataccatttccgtagtgcaccaatcgacggataccctaattctcgaatggttgcagcataagagcaatcgtattttaaaaataactgaattgcccttacacgctctttgtgggaaaacacacggacattcctcctaagtttattttttcgtccaggattatgtccgcacccccttgctttctgatgacttattctggttctttgagtgtcaatgcatagatgtgatgtagctagttagaaaaaaattttgaatactctttttttctttcagacttctttttaagtaagattttgaagtgtgagttacggggtcagaaacttaaaagtttttgttcctttattttcaagtctgatttggcagcttttcggcagctcatttatttatggtcagaaatagatgctgaaattttaatctattagcaaatagtccagaacgtatgaagaggagtcggatatcatttgtcattaacaccataaatatttataaaattcgtgttcacctacaattaaatttaatatataatattcgttgtaagggcttataattttttgttaatgaacaagaaaacgctatatttaagatttcaaacaactatattaataggaagaaaatttcatttttcctcttagttctataaaaagtgtggctaatttgaggcaaaatattaaattaaatttgccacaaattaatggctccactattattttaaatcaagaagtagtaaataatcttattttttactaccagactgtctttagatattagcttttcgtcacccactacagttgacatagacccacaaaaaacttaaaaaccttgcgatgtaagactggcacggagaagaccaatctatcatcacaaggtaagagtattcaaatcttattgaagactcaaataataacaaattttaattaaggatagtaatatcatagatttttctagaagtttcttgaggtgaaattttcgttacctgtcttttatcttctaagaaattaccttcttcaagtgaagtggagagaccactccaaggttccaaagcaatgaatggacttttattagttgtagaccacagaatcaagttcggaaaatcatcaaaatctactcgaagacctttaccagacttccttgaccgaagcgttacgctacgagacttgagctggtcaagtgtaatggcatcatgggaaaaaagtgagtagtccaaatcgagaattttttgattttccaaaaaaggtgtccgatcttgcaaatctaataatcctgtctcaggaaaactctttggtatcgagcaagactcaacctcactaaattcaatataataatcctcatagttttcaccttctactaaaggactattgaatgctggatgggctccaataaagtaaggcattgttttttccatttccaagttcgttacctgaaattcggttctaattgatttaccattcaaggtataaacaactctcagttcaaactgatataggtaattatcaagcatctcagcatttggtttaatactaaaggtcacgctattatcattgacttcttccagaataaattcttcttttcgaacaaaaccatgtctacgaataagacctgtaaaaaagggtctttcttgaggtctataaatagcccaatcatttcgtaaactaccacagataggaaatagaataggcgcctgtccattccaataatttggatcagcttgccagagatactctatcccatccttgtctttaatcgaagtcagttgaccaccaagtgttttaaactgaacagtaagatactcgttttttaattcgatagtcacaactaattcctttctttttattattggaaaggcaaataatttacctcgaagtgaatagtctcacgtatttctacatcgagtgattgtaaaaattcccattcaaatgctgataactctaaatcagaatggcaaatccactcttttccagttgaaacataccatttaccacattttagcaacggggtagcttcaagctcaggaatcataggacaatcttcgaaactaacaatatataccttttcaaagcctggtctaaataagtgttgtactttttctaaagtatcggataacaattttttacattttcaagtaatattactctatcacttgagtttctgctactttcttataccaatgagctgatttcttaggatagcgttcttgcgtgtcaaagtctacatagaatagtccataacgtttttcgtatccgtttgaccatgagaagacatccataagtgaccagatgaagtaacctttaacatttgcaccatccgcaattgcgtctgataaaacttccaagtgtttcttcacgtaatcaatacgaccatcatcataaacggtattatctacaaactcatctttgtatccaagaccgttttcagtgatgtaaatcttcttgtagtttggataatcatttttcactcgcatgatttggtcatacaagccttcaggataaataatccagtcccaatccgttctaggcacataatctggtgcgattcggcgaccaacacctttaatctggtacttagaacttcctttttcacccttaccattgtgaatgatttcagtctcaccatcaaaggcttgcatccaatcactcatgtagtagttgataccaaggaaatcgttcaaatctttagctgcttcaagtgcttggaagtcttcatcacgaagatcaagttctccaccattttcagctaggatgtggttgaccccttccatcgttttatctgaatagtgtccaaggtaggttgcatccaagataaatttgttatggatgatatcttctaactcagcggcacgaacatctgctggattttctggatcataagggtatttggttggcaacgcatgtactacaccaatttcgcctttataacctttatctttatacaatttcacagcacgtgcatgagaaaccatcatattgtggtgtgattggaagactttggcaagatcatattgaatgcctggagggaatttaccaaccaagtattgaccatctccaattgggccaatttcattgaaagttgtccagtagtttacttctgggaactcttcaaaacagaaagcggcataatctacaaagtgttctatattttcgcggtttaagaaatctccatctgagtgaagaacttctggtgtgtcaaagtggtgcaaagtcacgaatggctcaacatgacgtttgtggcactcggcaaaaagattatggtagaattcaacacctttttcatttacttcgccatagccagttgggaaaatacgagaccaggcaattgaaatacgaataccattaacgccatatttttcagctaattctaaatcaacaggatatttatggtaaaaatcacttgcaggctctgctgtgtaccaataattgtcttcaagatacttatcccatgcaactgggcctttaccatccgtgtgagtcgcaccttctgcttgataagcagctgtagcaccaccaaaaataaaatctttaggaagtgttttagtcataactataaatcctttcaaaaaaagcatttgagacgatattctgagttccggaaaccaaggaaatgaaatgcaatgatatggttaacaatattataaggaattgaaagaataatctcgtctcaaataacttttacaaatttattaatcaaactgttgttgaacaaatgcaagagcaccttgtccatcacgtgtcaatttgatatattgagctccttcagtttttgcaagtttaatgcccaatttatccgtttcagccttcatatcatcgaagtttgaagcgacctgtggagccaagataaccaagtcaaactctggcaacatttcacggtgagcaccgtaactacccgctgccgctttgactggaacattgtattctgctgctgctttgttcaaggcattggcaagcaagccacttgtacctccacctgcacaaagaacaaggacattagtttcttttgtgatattattgtttgctgctacatcttctttagcaacgcctgcttttccaagaacggcatctgctttagcagtattgaagtttgcagctactttttctttaagagcatcgtttgttttaccagaacgttcttcttcaagaatttgttcatcgtataccttaacaaatgggtaataaatgatagtatcaacaactaccaagagtccggctaagataaatgatagaacttggaagttagtaccgagtacaattcccaacggaccaggagtaacccatggaaggttggcagagaatgagttcatgttcaatgtgtcaacaaagaatttaaagatccaaacgttgacaatcggagcgaaaatgaacggtacaaagaaaatcggattcaatacgattggtgcaccaaataagattggctcattaaccccaaagaatgttggaacaactgaggcacgtccgatggcacggttacgttctgatttacaaatccacatgaacaagaatggaacaatcaatgtagctcctgttccacccatggtaacaataaacatttgagtaccagaagtgataactttatctgcatgttgtccagcttggataagatgcaagttggcatcgatattggcataagtgatagcagcgattgctggttcgacaattgaaggaccgtggataccaacaaaccagaagaaggcataagcaccaaagataagtgtaattccaaggtaaccatctgcagctgagaagagaggagcaagaagggtaccgattgattctgcaacggttacaccaagagttcccttaacaatgagttcaaatccataaaggagaacaaccgctacagtgaatggaatcaagtctttaaatacttgagagatatttggtggaacctcttcaggcatacgaatagtaacattatttttcacacagaccttgtaaacattaactgtcacaaaggctgcaataaatgctgtcaaaagaccttttgttcccgtgaaggctgtcaagaagcctccttcttttgcaggctcagctgccatcaaaaggaaccctaccatagacgctagcatcgtagataagaagttaatctgattggtcgcaggtaggtcacggttcattgagtccgtcaaagctttagcggtagtaccaccaacaaagaatgctaggatacccatcgaatagctataaggagtcatcaagaaggtctcaatgtcttttgaccagtggaatccccaagcatttgggacataggcaataaggataaagatagatgagaaaaggatgactggcataccagcgataaatccatcacgaatagcacgaagatagatgtttcgagagattttctcaaagaacggtttccctttctcaataagttcaatgagtttatgcattattttgctcctcttttataaagttcgatgaggtgatgaatcacatcttttaataagacagtagtcattaagtggtcctgaccatgcatcatggtaacgctgtatggaagttcctccccagaagcttctcgagccaacatagctgtctgagaattgtgagcctctgcaatacagcttcctgcttctactacaagactatctgccttagcgaaatcaccattttcagccgctttaagcgcttctaaaagtttagagcgagcatctccagcataagcaacaatttcaaaccctaagagagtcatctcttctctgttcataacaatatcctccgttttatgtttttactatactttatcagtccatggactagctgttttaacaagaactttgttaagttcatcaatattttcgaatccagtagtacgcaaccattcacgtgctgctttttcaccttctttgatgtaaggttctacagatcctgcccaagtagcacgtccacaaagcacaccattaaacttggcacctgagtcgtgagcaaattgcaatgtttcttggaacaatttagcagatacacctgcacttaggtagatgtatggaaggttagtcgcttcttcttgtgctttaaagaagtcagcagcttcagctttactgtaaactacttcaccatcagcaaaaccttcgacatatttaacgttaactggtacttctactttaagaacatcaatgttaaagcgtggatcagagaaaactttcatcgcttcaatgactttgcgaggtttcacttttgcatattcaacagaacctgcatctgagatttcttcatcataagcaaggatttccaagaagaaaggaatatcttcagcgacacattcagaaccaacacgttcaatataagcttgtttttgttggttaagttcatctgagctgtctacatcatagtaaagcaagaacttaacggcatcagcgccttgctctttgatacgttttgcagaccaaacatccaagcagtcaggcaaacgttttgtacttgatgtatcataacctgttttttcataggcaagaagaagacctgcttctttatccaatgcttttgttgctggaagtccatattcagggtcaagcaacattgaagaagcgtattttgtaagttcatcagcaaccaaaacctttagttcttccatttgagctacagttggttctgtatcttgatactgtgccatcaaacgtttcaaagcaccacgttggtcaaatgccaaagctgagataacaccgtttttatctgaaattttttccaaagatttgcgtttctgttctgtaagtaccatttttatacctcttttactccaatttgtgagtttagtgtttcgtaattagtcatattcacatgccctgtcattgtttcttgagcatttaacatacccaatgtcatcgcatgttttaataagtcagcgtcactttttttactatttaaagctgatgcaataccagctaccgttgagtcccctgatccgactggattaacaactgggatatcaggaatatctaccttatagaaaacatcaccatgttttgcaaaggcaccgtttcgacctaatgagaccactatccattcgataccactaaaaagtgactctttaagaacgtctttgagttcttcaatatcttttgttacttcttttccaagcaactgtgaaagttcctcattattaggtttgatggcagtaggtttagccgacgattttagaactgtttcaagaggtgcacctgaacaatccaaaacgactgctactccttcatccgaagcaagttggataagtttttcataataatcgttgggaagtcctgaaggtaaacttcctgaaattgtcacaacttctgattgtttaataagattgctatagtggtcaagaaagccttctgcttcttcatgagaaattgttggtccttgttccaaaatttctgtttggttaccctcgtgtaagatagcaatacagtttctagtgtttcctgagattttataaaaagctggactaacaggagattgttctaattcgctttcaataaattcaccaattttaccacctaagaaacctgtagcagtaactttatcaccagattcatacaagactctagtaacatttaagccttttccaccagctgtcttactaacatctttcaccctattcactgtatcaattttcaatgtttctagaggataagagatgtctactgaaggatttagggtgactgtcagaatcatttgttataccttaatcgtggtagtcaccacggtcccatctttcaaggaattctgtaaagaaatcttcatctgcttgatgtgcattatgtgtttcaacgtgttcgatttttgcaatcaattttttattttcttctgttggtttgtactcagcttcaatgaaagcttcaatgatgtcattcataagaagaccaccagtaatctttccaccgaaaccgataacattcgcatttaactcttcttttgcatatatagctgatgtcatatcacgaaccaacgctgagcgaacacctggaactttattgactgcattgttaatgccgacacctgtaccacagatacatactcccaagtctgcttgaccacttactactgcttcaccgacttttttaccatagatagggtagtgagtacgtgcgtggtcatatgtcccgaaatcaaggacctcatgtccttttgatttcaagaattctgatactgccattttttcatctgtgacaatgtggtcacatccaattgcgattctcattccttaactccttttcttaacacattttgttaagcatatctactcggatttgatgacgtccgccatcatatttaccattgacgaaacctttagcgatgtttttagcaagctcatcaccgacgatttcagcgccaaccgtaatcattcgtgaattgttatgtccacgtgtcatataagctgagcgttcatctgaaacttctgctgcaaccatacctttaattttagttgctaccatgaatggaccagctccataagcatcaattacaatacctaagttttgctcatctttatttacttcagaggcaactgccaaggtaacatcaacaaaatcttgtccgtccttagtcacatcaattacctcaaaaccttcttctacaagaaaatttttcacaacatcttttaatctcgtacctttgagatctgcaccaacaacaatagccattttgaccacctcctaaattttagaaagaaatgctacgtagaagtagaaaacattttgcaaaatgttcgaaaaaacgttttcatcatttctttgtttatataatatcaagcattcaaacaaaaagcaacactttttttgtttattttttgttttttttatttgtttttttaaaaaatagataacaccgttaaattattgttcatttttgttcatttaatccatcacaaaatggacgtgaaatatctattcaagtattacaaaagtcttttactttctataacttactgattaagaggtcttactttattttcgtcttatacaaaatctgacctaagctaatatacgtcaatcctctgttcttatttcatcatctaacatttgtttttgtttgaaattgtttgttttaccttgaaaatattgtcttttatgatacaattaaaagagaattatctttggaaaaaaattactttatgaaagaagggtcttcatatgaacaaaaaacgacgattagaaaaaattttagatatgttaaagattgatgggaccataaccataaaagaaataatagatgaactagatatttccgatatgacagcccgtagagaccttgatgctctagaagctgatggacttttaacacgtactcatggtggtgcacaattgctttcctctaaaaagccacttgaaaagacacatatcgagaagaaaagtctaaatacaaaagaaaaaattgacattgctaaaaaagcctgctctttaatcaaagatggcgatactatttttattggacctggaactacacttgaacaactggcattagaattgaaaggtcgtaaaggttataaaattcgtgtcattacaaatagtctccctgtgttcttgattctaaatgatagcgaaaccattgatttattgcttcttggcggtgaatatagagaaataactggagcttttgtaggttcaatggcttcgacaaatttaaaagcaattagatttgccaaagcttttgttagtgcaaatgctgttacccataattctattgctacatatagtgacaaggaaggtgtgattcaacaacttgccctaaacaatgctgtagaaaaattcttattagtagacagtactaaattcgatcgatacgatttctttaacttctataatctagatcaactcgataccatcattacagataaccagattagccctcaacacttagaggaatttagccagtacactactattttaaaagcggactagaattatgacttataaaaatattgtttttgaccttgatgacactctttatgaccatcaactcccctttaaacgtagcgttgagaaatgttttccaacgattgatatccaacaaatagataacatttacaaacgtttcagatattggtctgatgttgcttttcctaaatacacgaaaaaactcatcagtattgagcagcttagaatttttcgctgtcagaagactatggaagaatttggcatcgatagtatttctaggaaagaagctctagacttccaagctgactatgaatatgaactcgatcagattacgatgattcctgagatacatcaactactgctggctctacataaaaaccgcatcccaataggtattctaactaatggccctgttgacttacagagtcgaaactccaaaatattggtgcctatcaatattttgaaaagcaaaatatcatcattagtcagtccactcacggaggagctgcagaaaatagctatgaaggtaatgtaaaaaacttacaaagttaccgaaatgtccaattatctaaaagggctatagaaattcttaaagaggaaattgagttaaatcaccaacatatgagattcaatcctgattataaagataatggatggatttttacttccaaaagtcgtcataaacccgactataatggaacacctcttcattatagtgtccttaacaatttcctcaactcacctgaaaatggaaaattaaatcgaaaaggtaatccaaaacgagcaggaattgatattgataataaacttagttttaataaacatattacgacccatatattccgtcatacgcatattagtttcttagcagagtaaggaatacccctagaagcaattcaagaccgtgtagggcattctagaggtagtcgtgtaacagaaatttatttgcacatcactaaaaaaacaaagtatcaaattatacctatccttgatactcttacacaataagtgtggcaaatctgtggcaaaacataagaaaaaggcttgtccatattggacaaaccctttattttcaagcttatataacctaattaagctttaccagctgattagaataggatgttgcatgttttactacgtctttttcatagagtttcactaattcgtcaaaatttgggtgctgttgtttgaacgtatcattatcaatgataacaacatttcaagatcaagtcctaaaaaaccgctatatttgccaaaattcgcttttaaataagcaaattcgttctctgtaataaatggtgtatctgttcttggataactcaataattttgcttcatacagtccttgcatagcttttaaagtttggctcgctgtcgctttataaagctgattgacttttgattgcaaactacttaaagaaaacgaactcggactattcgttttcttctctttggtttgaacatcagcaattatcccctcttgattgcctattttagcttgtttagaagaaacaaaagctaaaaagctcctcttgggttttaaaacgctgtgtggggcttagaacgcccttaaatgacccttgttttacttagtttccacctcgaaaaaaggttcttttttaaaattctctatggcttcctggcgctgaaaaataaggtataaggtgggcgtttgaacacgtcctagtgaaaatgtaccttgtacgcccttctgttgtaaatttaacgtatacaaagggcttgcgttcatgccgatcaaccaatcggcaatttggcgtgtttgcgcttcttgataaaagggatagtaattcattcctggttgcaaattttgaaaaccgcttcggatcacatctttttctaagctattgatccatagtcttttaaatgttttatcttttgaaaaggcatttgcattatggataatcgaccaggcgatattttcaccttctctgtcgctatctgttgcaacaataattgtatttgcctttttgagaagttctgcaacaattttaaactgctttcccttatcttttgcaacttcaaaatcgtatcgatcaggaaaaatcggcaaagattcaagtttccaattttgccacttttcgtcataatgacctggttctgctaattccactaaatgcccaaaaccaaaggtgataaacgtttcatctgtaaatagtgggtctagcaaataactagctctaaatataaaaaacgcgatgaataatcataaatgtgattgcttcgtcgcgttttttatttttggctgctttgtgttgaaaagcttccgcttttcttctagcctcaagggataatttggttagattcatgctcataagcatcattccaatgtcagtaggtgcaacgttcttgcctctgacatgggttcttcacataccaaatacacctttcaatcgatcaaaaatagtttctacgtcaattttgcattgagcgtagagggcttttccataatcactttcaaggctattatttaaaatcgctaaggcgtgaaggcaaatgctgttcatatctcaaaacggttttctgactcgcaattttttctctttgtcttccaagttgattcctaagagatcaccaacatgcgccatcaccttatgaaactgcttctcagtgatatgaagatcataatgggctgtcgagggaaataaccactcagaattgatattttcttgggccagccaatcatgatattgcaacaagtcttgctgaacaggctttaaatataacgtgtttgctttaccggtctttttatcatgaataaaggttgcatttttgacagagccgtctggattatagacatctgatttttttaatgtcatgacatcactcacacgtagtagcgtggccttaccaacttgaaaaacggtgtaatttcggcgaccagcacggaaactatcgagaagtgtatcttgtaccatctttaagacgctggagtctttgatgggtaggacaatttgttgcaccatgattcatgtatacctttctgaaattaaataattaaataaataattaattaaattgtttatttattgatgaccaggaccgtatttctaaacttcttttatggtttattatatcacttaacaaaaaaacagcccccattatctagtcactagataatgggggctgttttaatcagttttcaaaggggcgattttctaattatagaccctgagttaaggaatgtactgatgttttctagtatagtccctagtttgataatatttattgtatttttctgttttagttattcgatgatatcgaggctaatatgtcagtcttccaagcagccattggttggtatatcaatttttataatcgcaatcgtatctcaaatgttgcctaagtaactgaataaaaatagtccaatttattgacttctgagcagccgctgaagctattaaattattgaaaggaatcagccttttaaaaagtcaacaaagaaattctgctttaaatcatattagggtatcacaaatactttacaaatatgttttgcgtcgcatcaaaagccagcaaattagacttagtatagcagagataatcaatacggctaaaacaccataagaagacttttcaaacgggacatggacattgattccccaaaagccaaaaataattgctggaatagtcaaaacaattgatatctcggttagggttttcataatcatgtttagctgatacgaaatcatattgtttatcatattttccaatttgtccaaatattggctgtaacttaaaatgattctatccattgtatcacttgtatcgtataaatcatcaattatttttttagtactaaaatcaatatcgtcaatagttgtgaaattttttttaatgaaatcaagcgctttatggttagctttataagttgttgacaaagctatcatgtatttttgaagagtcaataaatcaccaaacgttggtttgagtgaaccggacgttgatatttctgagtctaaatcatcaattttttccttgactccacgaaggtcgttaagcatcatatagaaatctttttgcatgatctttaaaagtacttcctccacgaaatgattgacatcacgtaaaaccatattggataagagttcgggaatgaattttaatttttgttttgtaaaaattatcaacttatttttaaataccaagaaaacaacagatgtcgtcagggtatctagatgcccaccttcatgtacctcgggaaacaaaaaacttacgagcaaacttttttcatcgttcttatctatcatcgtgtcatatgcaactcgatcatcaaacgttagtatattgcctattttaaagtcatatttatgttcagaagattcgatatattctcgttcgtcaccataaacataaacaacagaagaatttttgatatttgattctgacgaaactaataatgtatcttttgttaaggaataagttttcagcattgtaatcctcctgctttatatttttctcagaaataaatgcgtaattgttgtggaataaatacgttatcagttttaaaaacattttgtcttatgtatgataacctgccaaaaattttatctcacacattatctagacaatcttgtctccagcttctaatgtattatctaatttgtaattatagaccctttttttttttttcatatacttttttggcttgtaaaacacctaaatttgtatactctctaatctttttgataactactacgtctttcttattttccgaaatcatagctttaataatctgttgttcttcatccgtcatagaccgaatttctggttctgtaagaacttcaattaagttatcactaaaattagatgaaacaagaaaaagtattgctaaaattaaaaaaatatcatcatcggtaaaaaagtaataaataataaaaaataatgtaataccatataatacccagtttaaatatttatagttcaaaaaatttaaaaacttcactttatctctcttttctatttaaaatatcaaacaaacattttttgtagaaatccttttttctgctctttcaacaaatctaacttacgttgatgaagaacgatagtgtcatcggttctgttgcgaagtttgaaaatcaaacgcaccctctctgaactccaaatatcttaggctgttattcccattaataccttgatttcagtagacatttattaatcgaacggtttacttttatataaagaaagccaaaaagaggtgcgacactagttgtgtcacacctcttttttatttacctaatctaatgaaacgttccaagttttgataagtattttttttaacttcttcaactgatagctctttgatttcagcgattgtctttaactgttcttcaagcagtgagacataatctttttctgaaaaactatcccctaatgcccactctgctgcatgtagtccatccgtttcaataagtaagtggtcgattgggactgttttagctagttgccagactgctgggttctttttcaaatcaagaccaatgctgaaataacagcctaaatcaatatagtcttgttgatagtccaaagaagaataccaatgaatcaaatagtgattagggttagcttggatatagcttaagatctctttttcgcatccttttgtatgcagtacaacaggtttctcatttatggctgcaaaagcaagctgtcgctcaaatacttttttttgtgtagtcatcggtacattcgtccaaatattatctaaccctatttcaccgatgatccttgcttttttcaaaaaaggctcaacttgttcaaacgtatagctatctgctttccaaggatggataccgtaacttaaggcttgagtcttacttgctgcaagctgtctgttttccttccattcttctggcgaatcacaattgatgatcgtcaaaatcgtgtgttcctgctgaaggagtgctaaactctgactcccatctaaatgacaatgagcatcacttaacatctaattcacctgccaataactgataaatcgtttgctttaactctgattgctgcagtagccattcacgtgaccgtcgtttttcaggcacttgaatctcagcaatcacatgtgccggacgggcggaaagcacaagaatcctgtctgataaataaattgcttcttcgatatcatgcgtcacaagtaaagtagtccgctttgcttttttaggcagcttcaacatccagtcttgcatctgccctctggtcatagcatctaacgctccaaatggttcatcaagaagcaagtaagaagaaggattcatgattgttcgtaacaaggccgttcgctgcttcatcccgccagataattgttccggcaaaaaatgttcatagccgtttaacccaaagatatccagataatcccttacttgttcttcattgattgttagatgattgattttttgatataacgtaacgttttgatagacgctcagccaaggaagtaacatatcttcttgcggcatataactaaatgctgtatggagaccagttactttttgatcgtctactttgatcgttccagaagtcataggctggactcctgttaaagttttcagcaatgttgacttaccggctccgcttggcgcgacaatcgatgtaaaggtatctttagggatagtgaaatggatgtcttctaatattttcaggttttcaatgactacattcaagtggctgatttggattgacatatctatcactcctattttataaactgattagtgaatagttcttgcgaaggtacatcttgcttgatcaatccgttttcctgcataaaagctgtataattgcgccaaactttttcttccatcaatccccaattctcaggatcatccgtataattttttgacaagaatgcttgtgattcttctaaaaacgtccgatcattttcttttgcatatttttgcaacagtttagcactgtcatttggatccttaatagcttcctgatagccttttttcgtggcatccataaaagactgtaccaattctggatcacttttgatcagttgatcattcgtaataattaccggagtatagtaatctaaccgttcatctaattctttcaatgggatatagtttagttcaatacccgcttcttttgctttgatcatatcccaaccttcaaagtaccattggatatctgaggattttcctaagctttctggcccttctccattgcttcctaccattgtcagttttgaaaagtccccgccgtctttttccatcacagcttttaagacagcttcttcacttggactttgccaacctgcatatgtttttccttcaaaatcttttggtgaatggatgttactgtctgatagggtggcgaatccagaagtattatgtttgatcactgtagcaattgctttgactggtatattctgtccatctgcgtgagcataagtgacatcttcttgataacttacaccaaattgtgctttgtccgcacctactagaccaatacttgtcgaattatctcctggttcgatgatttggacatttaaaccagcctctttataatagcctttttcttttgctaggtagatgccagtatgattagtattcggtacataatccaaaacaagtgtcacttttttcaaatcctttatttcttgtttgctacttgtttcttttgcagtgccacaagcggataaaagcaacagtagcggtaataaaagccgtaattttttcatttgatccccttctcttaaaaaatataaagcatacgataatacccttttttcaataatgaacaagcgccattcagcaataaactcaatagaatgacacaaatgatcgcagcaaaaactttatcgatctggtagctgttttttacgcgtatcatgtaataccctaagcctgcttgagcgcttagccattctccaacgactgctccgctgacacaataagtagcagccacttttaaaccggaaaagaagccggataaacccgctggtattttatatattcgataaatcttccctgtatctgcccccatcgttttcaaaaagatgatttgctcttttgatactttcctcaatgtatccgaaaaagaaactacgatcggaaaatagcttatcaagacaacaaggatcacttttggaagcataccgaaaccaaaccatagggtaagtaatggccctaacaccatgattggcaacatttgtgaaatcactagtaacggataaaaagacatttctaaaaacttccaataatccattgccaaggcagtaataaaagaaagaacgctagctattaccaaaccaagcactgcttcatttaatgtcgtgacagaatgggaaagtaatacttgtgcatctgccgctaatgcagaaaatacagcagcaggtccgggtaaaataaaggcaggtattttccaaactatgacaacaatctgccaaataattaaaatgaatgccatactgactgctggataaagatttttcttcattttgttacctcctttcttctaatatgaataacaaaaaacgcttgaaatgggcacgacatagtaacccgcttcaagcgtctgctatgtttctcccttcaccagtattaactgacaggttcaatgggtctaagttcacaacttactctcatgtcgtctacgacatccccagaaacaggtattcattttttaaagtgtagcacaagaaggaaaaagcaacaagcgctttagttatcatgctgattatttcaataaataggagagatcacttgccaatgtcggataccccatgatatagctatccaactcttttttagtcaatttttgattgatgactagtgtcaaatcatcgatcaattcgtctgcttgctcgctaatcactgcagcaccaatcaaataattttgctggtcaaaggtcaattcagccttagcaactggttcattgacacgatgataggtgaaccaactggtaagatccatctctaccacttgatctgacgaagaggcgtgactttttgtaactcctacttcagcaagtttaggactggcgtagacgatcgtaggtataatcggatatttgataggttcgcttgttgcatccgttatccgcttagctacataatttccttcaaaagtggcgactggtgtcaattttggggttttccttgaaacaatatctccacacgcaaaaatttttggattgctcgtttgcagataatcattgactgcaattccgtgtttatcaaagacgacattcgcttgctcaagtgctaaagattctgtattcggctgtctcccagtcgcacaaaaaatcatatctgctactaattccgtctcttttccgactaaacgatagcgagtaccttctgaaatgatcttttgggtttcaacaccaaaagcaaactgaatgccagatgcttccatttgatggacggcttcctctaccaaagacgcctcaaattcttttaatggccgttgattatgatggacaatggttactttgctccctgcagcattggcaatcgtagctagctcaaaagcaatataaccaccaccgataaaaatgatttctttaggcagtacaggcaatgataaaaagtctgcactagttttcaagtattcctttccctccactggtaagatcgtaggtctttgcccggttgccaaaacaaagtaatccgcatggaagacttcttcgttgacttcaatagatgaatcatccaaaaaacgagcggttcctgaaagatgatcgatttcagcttctgctaattgtttttttcggctttctgggactggatccgtaaatgttcgtttgaatttttgaagttcttcccagttggcagttgggatctcgttaaaaccttttccactcaattgttttacccgattacgtgcctctactgcacttaacaagacttttttaggatcacatccacggttaggacaagtcccgccccatagatcttcttcgaccactagtactgttttacctgcttctttcaatccataagcagcacttaagccgctcacacctgaaccgatgacgattgcatcatatgttttcatttccttcctcctctcgacttaaaaaagcaaagatttctttacttgtcagcgacccaatacttctttgcttttctactatcacaatgcttggatacaccgaaagaagcgaatatacttctttcataggcgtatcaaagcaaacttgttgacgagcattttctggtatttcatttaagaaatatccattgacgactaaatcttctactcgccactctttcgtctgtttcggttcatcaaagaaatgccgaacgtagtcgtttttaggattcatcaataactgctctggtgtgtcacattggataatttctccatccttcataaatgcaatacgatcacctagcttgattgcttcttccatattgtgcgtaacgaaaacgatggtcgtgcccaattcttcgtgtaaggacaaaaccaattcttgtaatgagtttcttgaaatcggatctaatgcgctaaatggctcgtccatcaaaatcacatctgggcttgcagcaatagctcggatgatcccgatccgttgctgttctcctccagacaactctctaggcatacgatctcgataaatatcaggagataagccaactttttgaagaagttcatctacacggtctgctcttttctgcttttcccaacctaacatttcagggatgacttcaatattttgcttgactgtcatggtcgggaacaaagcgatttgctgcagcacatatcccatattccaccgcattttctgcagattatattcatttaacgattttcctttgaagtagatgtctcctgctgatggtttagataatccattgatcattttcaaagtagttgtttttccactaccggaaggaccaaccaaaacaaagatttctccttttttgattgccagatttaggtcatcgatgacatacttttcatcatactttttttgcacatgtttgaactcgattaatttagtcactgatcttcctcctttactaatccttcatttttcaggaagattcgtgctacttctgtcggctttttcttttcgacattgacttggtaattcatatcaatcatttgatcctctgttatttttccgcttaatttattcagtgctttaacgatttcaggatgttctttagcaaaatcttttttcatcagcggtgcgccttgataagctgggaataaccctcgatcatcttctagagtcactagatcgtactccttgagctggctatctgtggaataggcatccacaatattgacatctccattattgattgcttggtaacgcaaacttggctccatgctttgtacacttgaaaaattcaagccatatgcttcttggattcctttatatccatctgaacgatcaataaattccagtgtgaatcccgctttgatctgatcagagatagctgccaaatcggaaatctttttaagttgatgttcgttcgcaaaagatctcttgactgccaaggcatacgtattttggtaagccattggttttaataatgtcatatcgaattgcttattcaataattcttctgcttcgtcatatgttttttcttttgtcaaatcagcacttttcattgcttcaggtaccttcaccaagctttctaggacagtacctgtgaactcaggatagatatcgatttgaccttgatccagtgcattgaacaaaaaactcgtcttgccaaaattcggttttaattcaacttctgtttttgtgttgtcttcaatcaattctttatacatttggatcaggatttcaggttccgctcctaattttccagcaatcgtgatggtttcatttttaaacaaggcagactgatataaagaaacgccgccaaataaacacaccactgctgctaaagtaatgatggaatatcgaggtttcttatgctgcaaccagcgaatcagtccgctgaatataatggcaagcaaggcagaactgatcgcaccaatcaatgtcaaaacaggtgtatttcggtcaatacctaacaaaataaatgtccctaatccacctgctccgatcaatgctgccaaagtagccgtaccgatgattaaaactaaggcagttcggatacctgagataatgacaggtaatgcgatgggaagctctactttcagcaagcgtctcattctggacataccaaatgctaccgctgcttcttcaatagacgggtcaatttcagctagaccaatatacgtgttttggaaaatcggaagcaaagcgtaaataacaagtgcaatcaatgctggaacagttccgatccctacaaatgggataagtaaacctaataaggcaagtgaaggaatcgtttggagcacacccgtgatctgtaataagacttctgccatttttttatgattggctgcccaaatcgctaaaggaatagcaatcagtgctgcaatcagcaaagaaatgagagaaatggacagatgttgaaatgcagcttccagcaactcgccttttctttcacttaatgtttgtataaaattattcatgcgaccttcctttctgttattctttaagtataaacatttctttcctttttcccaactaacttgtcttgccttaaccttacagcacgaacaaaaaaaaggaaaaaatacctctaaatatgcggacaaaaaagaatccaagcaacaaagtcggatcaactttttggttctcgttttttcactacgaataccataaaaatctatacgaaattgtcacttggaatcagctatatcttttttacacacacaacttttattttaataaaaagaaacagccaataaagtagaaatctcgtgggggagaacacctttattggcctgttcaacgaatattatactgtatcatgacacttttttgccaaaaatgtaaaaaacggttgttttgacatcataaacgtcttgttttcttatttttacttatatcaccactttattttctatctctttcactccataaagcggaatgagttcttcttttgactgataataaacagctttctcacggttcttcatcaaaaaaagaaagatgtctttcatagcaagtggtgctttgccgtgttcaaataaaaagataaattgatttgctttatttatctggaccattgtcacaggcaccagtttttgttcttgagccaaaaaaactcctttatactctgtttttttgggtgattttgtaagaattgtcaataagtctgctgctcgcatttttccactccttatttgataaataaaaagaaacagccaaaaataattttttttcattttcctcttgaagtaagtgtataagtcagtataataaagaagttgctgaaaattttcaaaagaaaagaggctagaaatgaaaaaattaaatttatttacagaattgtgcggaatcattttaggcgcaggaatctacggattagctgtgacaggaatcaatattccatctaagctggcagatggtggggttactggtattgctttgcttttgcataatctttttggattcgctccttctgtcacttcactgctttttaatttacctttattgcttatctcattgtttctttttggaaaacacgcttttcttcggacgatcgtcggaacatttgcgctagttttctttttacatttatgggagagccttcatatacattttgctgtagatagtctactgatcaatagtttgatgacaggtattctttctggcattggttgcggtctcgtctttcgattcggcggaagcacaggcggaacagatatcatttatcaagccattgaaaaatattttcatattaagattggcaaaagtcttttcttgattacttttggtattttagttgtctccttgctttatttggatctcacacattttctgtatacattacttagctgttctattctatcttatacattgaataaagtgaagtatctggaaattggatctgttttgccccaattggaagcaaaacagactacagaaacatttgaaccacttgatcctcttgaacagttagagcactgattcttatttttcactactttatttaatttacagaaatatcattatgtaaactaaaatgatattattcagtaaaatcttctttataaaaaaataaactatttttgcaaacgatctgcgaaaaaagtttgtttttttattttgccattattttcttacttattgggagaaaaaattcgcttaaactcaaaaaaatctgaggatacgatataaactttcggatagagtataaaataaggaaacgccgcagcgtttcctttccaactgtagccgaatataaatttgtatatcacttatttaaaatagctattttctcccaaagagtttccttgatcatcgatcaatccttgtaatgagcgttctaagataccatggctttttttcgattttttttcttctgactgctttgtttcctctaacgtttttgttcgattgaatgttcgtacagacggctcaccatttcttttttcttgatacggcgtcggttctgtatcgaacaacagataagagtcatccgtttttttcatcgattcgattaaatgatcctcagaaattttgctttctctagggtctgggataatcgatgcgggtacatatttaggaacaaaataagaacgctcccgcaccttcgtgtcaacagatgcgtttcgtgtagtatgcttggactctgtccttgtttcactttgtctgacagaacgagaggaatcaccaaaaagtttttttcgtcctgtcgatgtgatttctgattggtaatggccggtataatccggtaattttcctttatgcttttccaaattttccttacgcggagctgacttcaatccatttgttacacgacgcttgcgacggattttctcggtgttcgtgttcgtgaaatgaaattctttcatctgctcaaacggggactgattctgttcagtcaaaagatcttcttgtccgtcaaataatactcgcttcttgtcgttggttaattttacgcctaactcatcatcgtacgcaggaaaacggaaatgttttcgtctgatttctttcattcaaaccatccttctcaaaaatgaaacttttctcaataatagcacagattcattgttttcagtagcaatgcgctgattattttaagaaaatagcgatgaatttcataaatatatatatagtaataagacttaattcgttgtctctctgataactagttcaggaaaaaaacgacgataaccttgactcgcccctttttcttctattttttttaacaacatttctccacatacttcacccatacgtataatatcttgcttgatcgttgtcaatttaggtgaactgatttggtctaaaaataccccatcaaatccaatcacaccaaattcttcgggcaagtatcctccagcatttataatccctcttactgctcctagtgctagccgatctgaactacatacaaaacaagttttatctgtaaaatctgcccagttttctgtcatatatctttctacttctgtggaatgatttggaaaccgcaagattttactaggaagatcaacttccttcatcacagataaataaccagtttcccttgaaatttcaaaaggctcgtccacttcgataccgatataaataatcgtttgataatctctttctaaggcatattgcgttgcttttgctgtaccatattcattatcgctgtctacataatcatatccttcagaattttccccaaacaagacaactggtttttccaaacggtcgatccaatcgaagtctttttttctgacacctgtgatgatgtatccatcacaagaaccgacgtcgaaggcatcatttgtaactaattggagagaataatgcgctttaccgatccgtttagcgattcccatcagcaaattcatgtaatagggctcagttgtgtcgatttcttccagtataaataatttgatgatctgcgaccgattcgtgacaagtgcttttgcagcaatatttggacggtaatccatttcagccattgctgagaaaactaactctttcaattcgtcagtcacctgttccggatgattgatgactcgagagaccgtcatttttgaaacattggcacgttttgcaacatctgctaaagtgggcatgctctcttcctttctaacatgttgtcattcttactatcaattataccaaattttcctaacagagtttattatagcccaaaataaaaaacggaaaatcctctatcgtcatgagtgattttccgtttcaattatttatacttttttatcaaattttttgctaaaaaagtggaagcttcttccattagtggtatttgtaccatatgtcgctgtgtttttgaggaacgaaaaacaatttcttttccgtaagacttatgccgatttttttctacaaatcgttccgtttgtatataagggattttttcgtcagcttgtccatgccaaaagaacagaggacgtccagctaacttttccggctgcaatgacaaatcatagctcttaacccatgaaatcaaatcaaaatagtcttttggtacgacataattatattccgatccgcgccttacgatttcttttccatattccaaaggtgcaggggaacccatcaaacacacgcccgctactatatgaggatgtttagccaacaaggcgcatgttgtcattccccccatcgaaaccccgccaactgcaagctgatcatgtagaagacctcttttttctaaatgcttgataagtgtgtcaaattcaaacagatttccgtagatactatcccaaaatgtataggatggaatagaagaaaccggctgtttgcgctccccatgattcatcgcatctggcaggatcacacgaatgccctgctgcgcaatttttcttccttgcgtcaaaactaactccttacttgtctgccatccgtgataatagatgacaacgggaatacgttcctctcttaattctttcagaacaacttctaacactggaatatgatggacagaacgtttcaatataattggattcaattgttactcacctattttcattaaatttcctgatcgccatagcaaccatgctccaacagttgtctggaacaggttcagtgtaccaaataatataaatgcaggactgaatggctcgggaaataagcacagagaacaaagtcccaccactcctaatgctagcgaaaggagtggataaatagaaaaattcaaaaaactggcaacgctaccgaaaatattaccaataaacagtatcaaaaagaaaaaaacgcttaaaattaaaccatctgtcagcgacatctgaaaaacaatgttctctacctcaattggctgttgaatcgaatagacacctaagtatatactgagaaggagacttagcacgtggctggcacaaaacacacgattgaccgttttcattttaatcacctaacctatctttataattctattataatcattttatcatttttttgtatgtataaagtttcaatttttcttcacttacgattttttttgatattgttgttatataaatgaaaggagttttacaaatgattgatccaaaaatgttggggatgatcttcctcattaattttgcttatatcactctgaacacgttacgtttcatgttgacaatgaaaggctatcgactgattgctccacttgtcagtatggtcgagatcacgatttatatcgtcggcttatcccttgttttagatcgtttagataatccactgaatttatttgtctatgcgttaggttacgcagtaggtatcagtgtcggaattttgattgaagacaaattggcattaggatacatcatggtcacaacgattttgccagcaaatagcgcagaagataaaagtttgccgggtatactgagagaacacggttatggtgtgacacagacttctgcaatggggctggaaggtgagcggctagttctcgaaatactttctcctagaaaaagcgaacgtgaactgtatcgcctgatcaaagaaatcgaagagcgtgcttttatcatttcttatgagccaaaatatatttcaggtggtttctggactaaaaaagtgagaaaacgacaaggaaaataactcacaaacttaaaaactgtctaatatctaaattaaattttaaatgttagacagtttttatttattattttgattaaaaaacatcgacatgaataaattttatcaaagtctccgtacagcctcttccacgattaagggcatggagaccattcgaggaatatataaaaagaaccgaagaaatggaacgctcttcagcttttcggtgtctactgaaatcaaggtattaatgggaataacagcctaagatatttggagttcagagagggcgcgtttgattttcaaacttcgcaacagaaccgaaaatttataccggaagattttcaaaacttacagttagaaaacatgcgtttagaagatttatttagattagcagaagatgataagtatagatttgaagttttgaaaattcaaaagaatgaactattgaataagttatatcctgagaatgcgataaaagcacattttggtgatgctaatcatatgtatagttggttcattcctaaaagatttagagggaaaatcaatgctggagatcaagtgaaagtactcaatcgaaatagtacagatgtcgtaatgataacagatatctatgtagaagatgaagttataatcaaatatatgaagcctgtgataaaacttgttaataaaaataaaggaaacggataacactttacaatgctgttttggtactccaatttaaacaaaacaatcgaatttacgtacttaattaagtacgttagaatggagatataaattagagggggagtagatatggcaaaaacagtcttaaatcctagctcagcacggaaaaatttttataagttgttgaaagatgtaaatgagaatcatacggaaattgaaatcattagtgagcgcagtgaaaataatgcggtgcttattggtttggatgatttgaaagcaatcaaagaaacgctattacttgagcaaataggcactttgggtgttgttcgtaagcgagaaaaagatgatagtggatttactaatgttgatgaaattgattgggataacttataatgaataactattctgtgatgattaaaaactcggctaaagctgatttaaagaaaatcaaacagtctaatttgaaacctcaatttgagaaggttattcagactttaaaggaagatccctatctccctacccaatcatttgagaagttaaaacctacatatgaaggtaggtattctagaagattgaatagacaacaccgggttgtttataaggtagatgaagatgaacacgtggttgaaatttattcagcaaggacgcattacgagtcacagtaattacttgtaaatacattatctcgtggtataatgtatttactaagtaattacatactgttagaaatgagggatttaaatgattacaaaaacaagaaaacaaggcaattcaatcatgttgacagtacctaaagattttaatgttcctaatggagtcgaagttgaagcaaagttggtagagaatggtattctttatgaatttgttgaaccacaaaaagaattttatgattttagcgaagatattttgtctgatataattgcagaaggctacgataaagatgagattcttgtagaatttaagaatagaaaaaacaaaatgcattcttcctttagagatattgctgaagatacacttactaattctaaagtaatgactaaagaggagttggcaacagaaattggcttatgaaatcgttccttcaaaacatgtcattaagtatttaaaaaagctaaaagagaagccattgaaagaaaaatttttgaatttaatttatgatgaaattgcgattgatccatataagggtgaacaaaaaactggggatttatcaggtatttggtctagtgggttcaaatatgcgggcacaacatatagagtagcttacgagattatagaaaacaaggttattccagtattgttatgtggaacgcatgaaaacttttatgaacagttgaaaaaattaatctagtgatttgttgtcgttcttaagaaggacggcttcttttttatcgaaaatctgattcgtctacatgactaaagtcgcgagtattctctgcttctcgataaattaaataacgtcattactttgaggaaagctataaatcaatatatttcagcttttccttatttatgtactaccttttacttattaattataaggtagtacatatatatcttttttttggtagtaactaaaaataaatatgttataatagtatcaaatgaatattgctaaaagaaaagaggtaggaacgtggtagcgaagaaatatgtaatcggtaattttaaaggtggcgtaggtaaaagtacgtgcgcgcaaatgttagggtttgaatcagcagttaatgaaggaaaaagaaccttgataattgacttggatatgcaaggaaatacttctgatgtgatgaacttaacgcatatgaacttcactaacgaagaaggaggcggagaaggtgaaccgattgtttacgaaaatactgtgactgacgtgttgataaacaatcttccacctaaagaggctgtctataaagtaatcaataacctctatatacttccagcagatatgtcctttgaaatgtatgatgattggatcaaagaccaatataatgattcattatcccaattcaaatatatgaaagaaaagctagaaccattatttgatgagtttgacgtcatctatttagatgtcccaccttctatttctgtatatagtaaatccgcgatgtacattgcggactgggcaatcgtcgtcttacagacccaagtaaaatcgatgagaaatgcgatgcaatatcttgagtatatggacttttttgtgaaagaatttgatacaaatttatatgttgctggtgttattcctttcatgttggaaagcggtgacgcagtagatcaggaaatgtataaacaagcccaagagatttatggggaacatttgattaaaaatgttgtactcaaaaatgcgcgcttaaaacgatacgacggatcaggtattacgatggagaagacaaagaaaggtctcttaaaacaatgggatcgcaaaagccacgaattatttatcagtattttgaaagaattggaagaacacgagaattggtatgcggaggtggagtaattggctgacatcaaaggacttgatatttttgggaacaacaaaggactcgccaaaataaaaaaagaagcagaagcaaagaaaaagcagcaagcaattacaccatctgaaaataagcaattagaagtgcaccaagttcaagaaataaaaacttcctccaatgttgaaagacagagtagaggaagaacaaaaaaagttggcgcaccaatcagaaaatttgataaggtttattccaccaagcatcctttaaaactgtcgactttgttaaatgcgacttccagagttttagtagaaaagtatgagactaatatgacaagagatgaattgcttagaaaagctttagatgagtatattaaacagaatcttacgcaagaagataagcaagatttgtttaatgacgtggtgaaagaactagacttgttcagagaaaaatatccaattgttccagaattagatgatcgtggagaaataataagaactaccagtcagataaaacaagataccgaagactcactgcgcaaagggtggggaatgaataataaagttagatagaaccccctttttatagcataaaaaagatttagaaggatatatgatcctattgcatgagaagtacaataaaattaataagaagtaacattaacgaaaaaacgtggaaattattcagtgaatacaaagaaattaaatcttgaaaagtaatggagtatggtttggaaaagttcaaaaaatatcaagacaagcttctcaaaaaaagggattttgatatccaataaaaagagtgaatcattgtactgccctccaaaaaagtagtaccaaaaatctaaattttttggaggattttacatgactcactctttttttatcaaagaaagtattttccaagcagttttttcatccaaaaataaatctgtaaaaaaattaccattcaaggcgcctaaacaactctccgctttgaacttacttttacaaataccaattcgttttggaatatcgaaaatttcttttaaagaaagaccaaaagtcttatcctcagatgctttgatgaattcaccattgatattgaagggtcttccgtaaagaaatccaacagtatccgtcatgcttggaaataggattttacgatgcttgttccagggttcgacagaatcaatagaggataaggtgccaattccagaaattaacatatctgcatgcgaagcggttgctaaggtattagctaaagaaggttctagagccattagttcacgtgcagtttcattgatgacatataaaggaatactgagagtcaaataagaagactcataacgttcagcagctttttgaactaatcgtgtggagccagctaaggaattatattttccgatttcgccaatgaattgagtaaaaattaattcttcacgagcacccattttaaactgatcaatcactttgtaaacggtatctccccaagatagtgcaaccacattggctttcttaattaattcttgaatgtaatcggcagcaaattttgaaaataataaatcgtgttgtgataagtcttcactactttttaatatatagatattcgttttaaagtaatttttgaagatttcttctagctcataattcctagcatacggagaattaattgaaatactaactaattgtttttcacgtgcatcttcaatatattttaaagctttatatctggtgatcccatattttttagaaatttcactaatattgatatcctcgagataatagtcttcacaaatttttacaaggagtgattcatagtcagagaattccagatgcatagtatagctcctaactttttcaaatagatattttttctcattataccaaaaaaattgaatttagtctttttttaattttttaaaaataagcatcatttttttaaaatttaaaatgaaagggtttttttattttaaaaaaagtgttaaagtggttttgtaattaaaaaatgtaaaaaggagtgaaggtatgcttgatgaagttttagaaatccataaaaaaaatgtaggtgttttacggatggaaacaacagaagccgtgcaagatgatcaagatttagcaaaaatgtacaccccaggtgtagcagaactaagtttaatgattgagaaaaatcatgctttggcaagagaattaacaattagtggtaaattagtggccgttattacagacgggtcggcggtattaggtcttggaaatgtaggaaaccaagctggattaccaatcgtcgaagggaaagcgctgctttataaaaatttagcaggtgtcaatgcgattccattagccatcgaacaaaaatcagtagacgagattgtacaaacaattgtcaatttgcaaaatagttttgcagggatccatttagaagatattgcagcaccgaagtgttttgagattgaagaaaaattacaagaaaaactttctattcctgtgtatcatgacgatcaagaaggaacagcgatagtcgttttagctggattgatcaatgctgctaagatccaaaggaaaacattaactgaacttcgagttttgatcaacggcatgggagcatctggggttgcaacagctagactattaatcgctgctggtatcaaaaatctaacattggtggataaacaagggagattaaagaagcaagatagtacattaaataaatatcaaagagagttgttggatcatatacatgatacaaataataatgcaagcgttttggaagatgcaatcgttggacaagatgtttttatcggtctttcaataggaaatgttttaacgcctgaaatgattggaaaaatgaatgataatccgattatttttgctttagccaatccagtaccagagatcacacccgatttagcaaaagaatctggtgcaaagctaatcgctacaggttcttcgaaatatcctaaccaagtaaacaatattttagtatttcccggattgttcaagggactattactatcgaaagcgaataaagtcgatctttcattacaacttgaagtagccaaacaattagctgctatggtcgcagagcctacggtagaaaaattcatccctaatgtttttgatgaaggagtcgcaaacgtcgtttcacaggcagttttggattatttacaaaaactaaaagaaaacgaggataatatacatgctgaaaacattaaatagaattaaaattggttttattcctttatctctttatatcattttggtactcgcgtatcttgcaatgacgataagcaatatcgttccagaaaatgatatgttagtttctttgggtattatgactgtttttgcttatttattagaagaaattggtaaaactattcctattttaaaagatttaggtggtaaagtattagttgttacatttttgcctgcatttctagtctataaacattggctacctcaaagtactgtaactgtggtttctgattttatgaataataacaatttcttgatgttctttatcacactactagttgtcggcagtattgcttcaatgaatcggcaaacattggttaaagcaacttcacgtattatcattattttaattttatgcgatgtgattggttctttgataggaacaggtgtgggaatactccttgggctatctgcttggaatgtgtatttctttatcgttgcgccgattatggctggtggtgttggggaaggagcgatgccattatcgattggttattcagcaatattatctggtatgggacaaaatgatatctttgggaagattctaccgtgtgtgatgttgggaagtttagtcgcagttctactgtctggtatgctcaaaaaaattggagagaaatacccacaattaaatggtcagggtaatttgatcgatggggatgatgaacatttagagaacttgaagggttcagctaaaccagtcaatattgaaaaaacattgttagcaggcgtggtagcaataacgatttattttgttgctgtctatgttgagcacttattaaaatcactccttggcttttctattccttcacctgtgatcttattagtctcgcttatgggggctaaaatgcttggttttatccctaaaaatatcgaagaaggtggaaattcgttgtatggattcactgttcgtgggatcacacctcccttactttttggcgtaggggttgcaaaaacagattggttagagctgatcgaagtatttaaaaatcctgcaacgatagtaacaatcattgtgacggtagtagctattgtcgctacagcttttatcgccgcaaaatttttaaaaatgtacccagttgatactgccatcgcagtttcatgttgtagcggacaaggcggtacaggtgctttagctatcttagctgcgggtgatcgcatggaattaatgccatttgcacaagttgctgttcgactagggggtgctatgaccgtaacgttcgctatctttttaatgggtctgctatcataagaacataaagaaaggacgtgaccatgtgtttgatcaaacagatatccaacgattatttttaaaaaataactatatcaaagaccaatgggaaaatcttttgcttgattcaggaatacaaaagaagcaaatcgaagattttcaacatttagatcaaacattgggtatataccataaagaaaagttagtaggaacagtatcttatcaaaacaacgtgattaaatatatcgccgtgtctgaaaaatataaagatggtggacatacatttaatgtactagtctctgcaataattcaggcaatgagtcaacaagagatttttcattatattgttttcacgaaaccgcgctatcaaaaaagttttaactttttaggttttgaaacaatcgtatctaccccaaaaatagctgtattagaaatgggagatagttctataaaacagtacctagagaggattcctaaagtgaatggtgaaaaaaaagcagcaattgtcatgaatgcgaacccatttacagaagggcattattatttagtaaaacaagctgccaataacaacgattgggtatatgtatttgtactcgaaaaagaacaaaatcttttttcgacgaaggaccgactcaaattagttcaacaaggattacaaaaactgaaaaatgtcattgttctatcaggtggcgagtatattattagccctgcaacgtttcccacctattttttacgagaagatgatgaaatagcaaaggagcaaatggtcgtagatgctactttattcaaagaaagaattgccacttatttagatatctctgctagatatgtgggagaagaaccactttccccaatgactcgttcatataacgacatactggaaacgattttaccccctgaaataaaagttcatgtccttgcaaggaagaaaacggaacaacaccaagttatttctgcttctcaagttcgtaaagcgtatcttgctgggcaattggaaaaaataaaatatatggttccagaaacaacctatcaatacttaaaaaataaaagggagcgttaagtaatggaaataaataaatcagcgattgctggaacattagagtcaagtgatgtccaaatcatgatttcaccgaatacagaaggaatagaaatcgatttagacagtcaagtgattgagcaatttggaaaacaaatcaaaaaagttatctatgacacactagcagtttatcagattaaaaacgtaaaactcaaggtagtagataaaggggcattagattgcgttattgttgcacgattaaaaacagcgatccatcgttccttaggtatccaacaccaagaaacaccgtgggaggtttaattagatgatgaaagaacgtttgagaagaacaatgatgtttgttccaggaaataatccagcgatgatcaaagatgcaggtatttatggtgctgactcgattatgttcgacctggaagatgcagtgtctatggcagaaaaagacagcgcaagaatgcttgtggctgaggcattgaaaacagtggattatggtgacacagaattaattgttcgaataaatgacctgcactcagaatttggacgtgcagacatttttgcaatggttaaagccggcgcgcatgtattacgtttacctaaaacagaaacctctgaagatataacagaagtagaaaaagtgattatagaagcagaaaactatcataatgttccgatagggcgaacattgatgatggcagccattgaaggtgcttctggtgtattgaacgcacctgcgatcgccaaagcatctgatcgattgattggaatcgccattggggcagaagactatgtgacaaatatgaaaaccaaacgatatccagatggaaacgaattgttttttgctcgcagtatgatcgttcatgctgcacgtgcagcaggcatttccgcatttgacactgtttactctgatgtggatgatatggaaggatttttaaacgaagtacgtttaatccatcaattaggttttgatggaaaatcttgtatcaatccacggcaaattccagtagtcaatactgtttatcagccgtcaatcaaagaaatcaaacgatcactagacatcatctcggcaatcgaagaagcaaaagaaaaaggttctggcgtaatttctttaaatggaaaaatgatcgataaaccaattgtagaacgtgcacaacggacattgatgttagcaaaagcatcacgattgattgatgaggagggaaatatccatgcataataaacaaagacgtagcattccatcaagtgttttaacaaagtataaaaaagaattccaaagtgtttcattatcgccacaaacgattcaacgttgtgcaccaaaagtaacgactgtaactaatcagacaaataaattgatgcactcgatcaaagaagctatagaaaaatcgggcttaaaagatggaatgacgatttcatttcatcatcatttaagagaaggtgattttgtttttaaccaagtgatggccgtgatccgtgaaatgggcatcaaagaattgaccttagcaccaagttctttaacgaacactatgaatgagatggttattgaatgcatcaaggacggtacagtaactcatatcacaagcagtgggatgcgcggcagcttaggtgaatttatttctcatggaggaatggacaatcctgtgattttacgttctcatggtaatcgtccacgtgcaattgaaagtggtgaattgaaaatcgatgttgcatttctaggagtaccaacatctgatgattatggaaatgctaatgcgactgttggaaaatccgtttttggttcattagggtatgcaaaagtagatgcacaatatgcagataaagtcattcttctaactgatcatttagttccttaccctaatacgcccattagtattccgcaaacacaagtcgactatgtcgtggaagtagaagcaattggtgatccgaataaaatcggtgctggtgctacacggtttactaaaaacccaaaagaattaaaaattgctgaaatggtcaaagatgtcattgttcactcaccttatttcaaagatggcttttcttttcaaacaggaacgggtggtgcagctttagcagtaacgcgttacttagctagtgaaatggaagaaaaacagatcaaagcttcttttgcattaggtggcatcactaaaccaacggttgatttattggaaaaaggtcttgttgaaaaagtgttagatgtccaagactttgacaaaggagcagctgaaggaatggcgcggcttgagaaccaacaggagatcgatgcttccttttatgctgatccaagtaataaaggagcggttgttaaccaattagatgtcgctattttatctgcattagaaattgacacaaacttcaatgtaaatgttatgactggttcagatggtgtgctaagaggtgcgattggtggacatcaagatgcagcaacggctaaacttactatcatctcagcgccgttagtacgtggccgaatacctacagtagtaaatgacgttactacattgatcacaccagggaaaagtatcgatgtattagtcacagaagtaggggttgctatcaatccccaacgtaaagatctaatagctatttttgaaagaattccacaaattcctgttttcacaatagaagaattacagcaaaaagcagaaaaaatagtaggcatccccgaacctttgcaattcacagatcggatagttgcctatgtagaataccgagatggttcaattttagatgtcgttcgtcaggtgaaagaaattgaagaagagagatcatgatgtttgatactggagaaattcaagaaatcgaggatattttgatccataaagaacaacgcgctaacttgcaaagcaacctgctttccaagtatccaaatagttcattgatggtctttacattgaatattcctgggccgatcaaaaataatccaatgattgagcaggtatttcgtcagggacagcagtcaattcagcaaatgtttttaaaaaaacaggtggaaatgacgtacacaaaagaaatcaatttgccaagtggattggactggtacgtaatagtaacagaagcacctttgaatctcaaaaaatggttggtcacgttagaagagcaagacgcattaggtagacttttcgatttagatgtcttgtttaaaaaaggagagcagataacaattgttagtcgccaagctcttaatcatggggaacgtccttgttttatttgtgggaaatcagcaaagatatgtgcacgtaatcgtacacatactgtgaaagaaatgcaaaagaaaatcgaacaaatagtagccgattccttaaaaggagcattgaaacatgcatgataatattcaaaaaatagcacaagaagcacaattagcgatgctttatgaagttacatgtatcaataaaccaggattggttgatccagtagaccccgggtctcataaagatatggacatttttacttttctacaaagtagtgtagttttgactccctattttgaagaatttatccaaacaggattggaccgacaacatcaaccaattgaagaaacctttatggcgattcgacagattggtttagaggctgaaactgcgatgttctcagtgacaaatggtataaatacacataaaggtgctatcttttcattggggatttttctggctatttgtggccggttaactatttggaaagttccttgtaaaaaaagtttctttcaaaaagaaattaaaaaaatgacgaaaaatctgcttgacgattttgggaagattgatcaaacaaaaccaaaagcatggacttggggagaatatctatttgttaatcatggtttgacagggatacgaggggaggccaaaagaggttatccttgtgtttttgaccgaggattaccttattatcaagcacatcaaggatcgcaacaagagaagatgatagacactttactttttctatcaacggaagtagaagataccaacttgatcaaacgaagtaataatagacatatttttgaagagtatcaattacttatccatccttattttgaattagggggtgcaaaaaccgcacaaggaaaagaatatttgaattacttaaatcagcaatttaaaaagaaaaattggagtattggtggaagtgcggacttattgatccttacaatctttttagatagactcatgggcaaagggtggttatgttgatactataatacagtattttgtattagtaagctaataactaaaaaatggttcaataaaaatattttatcactttttgactcatttgaaccttcgaccttgtttgccttattcaaggcccaaagggaaaaaggggctattatcaaaaaatgagtttctctatgacgagtattttgattgttatatttgtccgcaagatcaaatgctcgctttttcaacggttactcgagaagggtaccgagaatacaaatccaatccaaaagaatgtgtgaactgtcctctgctaaaccaatgtaccataagtaaaaatcatcaacgagtcatcacgagacatgtttggggagatctgatggatgaagtggaacatcttcgcctaacagatctgaataaatcaatttacaaaaaacggaaacaaacgattgaacgaatatttgcggatgcaaaagaaaagcatgggatgcgttggaccaagtatcgaggcttggaaaaagtcgcgacgcatacgatgctagtgtttgctgcaatgaatttaaagaaattagccacctggctatggaaaggcaaggagcctttatttttttgttcaaaaattcgaaacgaagtagataaaaagctgttccaagctcgagttacgagtttggaacagcttttgtctacagtctgaaagcaaaaagattgaacgaattcaatctttttgcttttttattcatccatatcatccatagctgatacttgcaacaaatcgttaacataaacaatttgttgtcgggactcttcgatggcttggcgaatggttgtttcactcaaatcgttgctaccgattgctaaggctaaagtcattaagattggcaaattaacgcccgcaatcaattggatattgtaacggtctaaaaatttggcaaaagtctggttaacggaacctcccaacaaatccgtgaaaactaatatttgttcttcggcttcgaattggtctaatgccgcttggacttggttttcaacagaagtgttttctaggtacgcattaatagcaatgatttccaccatatttggtgcaatatagcctaacgtactcttgaacccttccgctaagcggtagtgtgtagctacaataatttttttcacctatttccctcctcgtatgattaaggtgcgactcctaagaaaccgaagtaggccccaagtaaagagaacgcgagcagcaagaagataacctttaaaaagccccattttttcttttccatcaagaagtaaaccaatgcggtcaacaagaccggtaacaatgctggtaagatacggtcaaagacttccgcctgcaagcccatggttacttcaccgaaagtaaattctattggcgtgtaaactttaacaacagtcgcaattaagcttcccactaccgtcagtcccatgacggaagctgattctgtgatggcgttgagtttatcggccatgtcagtgattaaacgtatccccgattcgtaccccaaatcaaacaatttcagacgcatccagactaatccgaggttcaatataatccaaatgatagcgcctaatgggttaccttccagagccatgtagccactgatagatcccatgatagttgggtacaatacccatagtaaggaatctccgataccggacaaaggacccatcagggatgttttgattgaacggacagctcccaaggattctgtcccttgttgctcttgtagcgctacgtcagcaccagcgactaagggtcccatataaggggtgatgttgaagtactcatattcaaccctcattgcttccacgtaatcatcgtcatttggataaattttacgcaaggttttcgccatggaccaggcatagccggttccttgcaaggttccgtagttaatgttgttactgccgataaaagaccagcgccaagctgcattacgacgatcttttttgtttagttcctgtgtaagtccttttgttctctcattattcatcgaagtcatctccctcatcgtatgcagcattttcagttgttacagccactttttggctcgttaagttattatagataaaaactgccagtgctaatccaacaattgaaacggccaagattggtaattccatatatgctgccattataaaaccggctaacaaagcccaaatgtagcgttttgttggcatatagcgcattaacatggctaccccgacgactggcagcatacccccagcgacgtttaaaccatttgtaatccattctggaatccattgggtggctgtttcaattgctacttgaccaaaggctacgaggataaccatcggaatgaaagcttgcatcgcgacgaagaagacactgatgaagttaatccattgcatcttactaaatttccgttcctccaaatattgtttagatttttcggaaacgaaagagttgattgtccgcgaaaagatgtccaagttaatagccaaaataccgactggtaaaccgaccgcgatggaagttcctatttctgctcctgtacgagcattcaagtaaatcgcaacaacggttgccaaaccataatccggtaccgatgatccacccaatgcggctactccaaggctcattaattgaaacgttccagcgataaccatggcggattgcaaatctcccatcactaaaccagctaaaagaccaaccgttactggccagtggttaataatggtaattccccggttatcaataagagtaagcatagggattaaaataattaagatattctgtaaaaattctggcattataattcctccaatctcaatttattaaataaatttgtctaacggttcttctttgtcggatggagcaaattggtatgataccggaatgcccttatctgcaagctgttgcaactgttgcaattcttctggggaagccgcgaaattcttagctaactttttgcggtcgtttctatccagcataatcccgatgttcactttcggaatggcgatgccttgttcactcaagtcgagtaacgttttaacattattaactaccaacaacacgttatgactgtcatatttcccggccttaaaattggtaatgccagtttctgtgtcaatcaaggacattcctgtccctgctggtttgcttagacgcatagctgcctttcttggttcatcttgggcaacttgatcgtccactaccatgatacgttttgcttttaccgcactggcccattgtgtcacaacaattccgtgaaccagtcgttcatcaattcgagctaatactaatcccatttttcatttctccttttcaatttccaaatatatctgctagatggtgttcgagtggtgctccctctttacaaaataccggaatggtattcagtgttacagcaattttgtatatctgaccaccagggtaaacttttttcgtgaaaacttgaatccaattacaaccctttggcaagtagactggtatgtgtgttgcgccttctgtcacaaccggagcaatcaacaaatcgctgccgaataaataatgagtggtttcttcccaagatttgggatcatctggaaattctatgaacagactacgcataattggtaaaccttttgtagcgctctcattatatacatccctaatgtaatccttgagacgcgttctgatatggataaagcgcgtcaatatgccttcaacttcttccccgaaagaccatatttcatttggtccaccgcttgtccttaccccccctcccgaattccctattttttgggtatgaggttggcgatcaccgtgcatccgtagaatcggactgaaaacagcgaactgaaaccagcgaatcatgagttctttgaaaactggggactgactgtttccactatggaaacctccgatatcgctcgtccaccaagtaatgccacttatgcccatactaagaccgacttgaacttgtcttcttagtgaatcgaatgaactttcgatatcccccgaccaagctaatgccccgtatttctgggcgttaaaccaggcagaacggattaaggtaggttctgtgttcgatctctctggatttttctggattgcctgtagataatggagagggtatttattggcatatttttctaagctaccctcgtatataagatattccttgtgttggtacacatccatttctggttccgcttggtcagcccaaaacaaggaaattcccttgctccggtaattttcgtccaagacctgacggaggaatgtcttactctctggatggaagaaatctaacagagcttttccggcaaatagcgaatctttatttgtgaccgacctgatcaagagttgattattccggtagctctgataataacgactctcctcggttaccgttggccatagagataccatcagttgggtgccagtcttcttgatttcttccgcaaagtcctcgattccttcccaatagcgagaatcaaatgcgaaatcaccatctgaagtccaatgatagtaatcaacaaccaaaacggaaagagaaatgcctcgttgattgtaaccttcataaaccgttcttaattcatccaacgtctgataacgcagcttgctttgccataaccccagtaattccggttccaaccgaggcgtgcgcccagtcatttgcgtataattttctatgatttgtttcggattttctccgacggtcaccaagtaatcaataagattcgtattgttgctcttccatattttctggttgtagccaaatgttacttccccgattgccgcattattccagatgaaaccatactgcttatcggagagatagaatggtattgacgtctgggagttccgttgcattaactcgtacgttcccccgtttttgttaaagttttcttcttgatatccgcccatcccgtacaatttttcattcggatcaccttcaaaacgaagagttgcttggtaggtgttctcgccagaataggtgaattctcgaggtgaaatatttaacgatgaggtcggttcgtccggaatcggaatgtgggtgtcaatgcctacagtacgtcggacttgactttgcttccgagagtattcctccaggattattgtcccgttgttgtaaaagaccaacttttctccatcgtatgtggctgttaaacggttgttggtcaagattaattggtccgacgtctctgtaacggttgctgtagtcaagacgttcttctccaattcttctatcccttgttttgggtcgaaccctttgtggttgggataacaggtaacgcgcaccgtgtcgcgtccccatccttccactttcaggcattgattacggtccttcacgacgaaggactgttcggaaacaatcacttcttttgatttaaagagcatagcttctttcctcccaattgacttgtcctttatctcctctctttatgggctatttgcctaacgattcaaaaagttcagaggcggattctttaataaataccgggatttgttcaagaggtgctgcgacataataagtcgctcccccagcatattctttaccggtgaataagtgtcgccatttttcaccgcttggtaagtaaacctccctacctctttctttgtagttcataatcggagcaaccaggatgtcagaaccaagcatgtaggtattatcgatttcccaggattttttgtcctctgggaattcgtagaataatgtccgcatgattgggtatccgagttcatgtgcttctgtcattgattctgccaagtagtctttcatccgttctctaatttccacgtagtccgtcatgatgttttcaacttcactgccgtaagaccaaatttcgtttggtgcacctgttggcatcgaaccaccaccagaattggagagcggtttactatgtggcagacggtctccatgcatgcgcaaaataggagaaaacgtgctgtactggaaccagcgaaccatcaattcgcggaattccggatcttccggattaccaccatggaagcccccgatgtcagtcgtccaccatggaataccggccatccccatgttcaatccggagttgacttgattatgaaaggcttcgaaactggaatcaatatccccagaccaagccaaagcaccatacttctgagcacctgcccaagcacctcgtaccaatgtgacaacggattcatttgaatccttattgccatcgtaaaccatcttcaagtatccgtttggatacaagttgccactttccaccgccgttccggaatggtagcgataattttcgaaatcataaacagcataacctggttcagccacatccacccagtagtaatcaataccgatgtctttataatttttcttgattaggttccagacataatcacgggcttcaggattagtcgtatccatgaaaacagtgcttccttggatttgcatcgtcaagcgaactccgcgattcactttaatcaaatagccaccttggagatattgctcatagttataggcatctgattggacagttggccaaatcgaaatcaatggttcgacattgtaatcttccttgagtgttttgaccagtttttctggttctggccaaaaatcgggatcaaatcgatactccccttgcttcggccagtggaaatagtcaatagcaatagtcgatagctgaatgcctcgctgtttgtatccttctaccacttctaagacttcttcaggagtgcgatagcgtagtttactttgccataatcccagcagttttttcggcatttcaggaacacgtcccgtaacgctcgtgtattgctccgtaatttctttaggtgaatctccggctgtaatccaataatcgatataatccgttccgtacatttcccattcggtcatgttctttgcaaaggttacttttcctataccaggatgattccacaagaaaccgtagttccggcttgaaacgtaaaagggaaccgacatttgtgaattacgttgagccaattcgagcattgtgttctttaaatcaagataattttgttggtattgccccatcccatatattttttcctgggcatgcggttcaaatcggacttttgttcgaaagttcgacccgtcgttatttgcacggtattcacgagacttcaactttaaagtggaattaaaatctttggtaaattcgactgtcccaacatcctcactgccatcgtcatgcttaacggccctcagacgaatgaattcttttaagagaacttcatccttttcattgtaaaacgtcaaacgatctcgatgatcaaggacagcttttattttaccgtttacaatcgtagcttgattgtttttgtagtatgtctcaaccagcttttcatcatacccatgcagttcagttaatgcattttcccgctcaacaaagtgttgatccaaaaacgaccggactcgaagtgaatgctggccccatggttcaataattagtaattcatcatcgtatttttttacgattcgatttgcttcaattgtaatcatgatttcctcctattagaattacttacaatatactaagcgcatgagacaaatcttttgtcgcaccgtacaccttcgtatataagtcataaacagtattatatttttctacgttttccggaattggttggacagtagtaccataccgaatgacctggttggtacaagattcgaaagaatcgaaccaacctagaccgactgcagccaagattgctgctcccaaacccggaccttcttccgtatccaggctcacgacttccgtgttaaaaatatcagcctgcatctgtaaccaagtcttgtttttagcgccgccacccacactaatgatgcgcttgaactcttcgccttttaaagaagtcataagttgttgagaatccttcaaggaaaatgttaccccttccaaaacagcccgaatcaggtcatcccgggtatggtgattactcaatccgatgaaggacccacggatttgactgtcaacgtgtggtgtgcgttccccagaaatatacggggtaaatagtagtccattactgcctatcggcacattaggaatgtttcttaagaattcatcgtatgattgttccggtgccagtaaatttttgaaccatgagacgctatgtccagcagccaatgtgacgcccatcgcgtagtaggtatctggcaatacatggttgaatagatggacttttccaccataacgcgtgtgatcctcttcttccagggccaagaacacaccggaagtaccgatacttgctaaagcggtatgggaatccgtcaatccagatcccaatgaggacacagcattgtcggctccaccggtaaaaattcgtacctctttttcaaagccaaaggtcgctttgatttctggtttcaatgttccaacacaagcggatgattccactaatgggggtaagataacttcgggaatgttatatttttccagtataggtttggaccactctttcttagtcgtatccatcaataaagtaccggcggcatcggaataatccatgtggctgtggcccgtcaggtaatagcgtaagtaatccttgggtaaaaatattttacgtaccttttcccagatagcgggctcatgttcctgtatccaaaggatttttggtaaggtgaatccttccagagccctgttcttagtgattgcaatgatttcattcccaaattcatccataatgcgcttacattgggccgaatttcgaacatcattccataggatagccggtcgtaagacagttcccgcttcatctgtaacgaccaaggaatgcatttgtccggaaaaactaattcctgctagttcagcctggaaatcagagacattgcaagaaaatttttcgaacaatgcaccacaggctgtgagccaatcagcgggattttgttcattatagcccccttttgggctatgaagggggtaatcacaagcttcaatgtgccgaattaccccggtttcatccaccaacactcctttaagggcccctgttcctaagtctagccctaatacataacccatgttttacaccccgactttctatactaaataatcattaatcagtgatttgatgtattcgatatgacttgattggtttgtcacatctgaaagggaaagtgcgtactcactaagcgattcaaaggtttcttggtcatcaataatttttttaccgattccttgggtgaagcttgcatatttttcttccataatttcttcgaagaaacgttcttctttcatcttagcagcggcacgcaaaccacgtgcataagtatccatccctacgatatgtgctaaaatcaaatcttccatttcgaaggaagtccgacgtactttagcatcgaagttgataccacctggtgcaatccccccattttccaagacctcatacattgccaaagtcgtggaataaatatctgtagggaattcgtctgtatcccaccccaacaacaaatcaccttggttagcatccaacgaacccaatgcgttgtaactgcgggctacattgatttcgtgttcgaacgtatgtcctgccaacgtagcatggttggcttcaaggttaagtttaaagtggtcttgtaaaccatatttcatgatgaacgccattgaagtagctgcatcaaaatcatattggtgttttgatggttcttttggttttggttcaatcagaaattggggttgatggccaatttttttcgtataggcaatcgccattttgtagaaacgagccaagttatccaattcaaaatccatgttggtattcaataaactttcatagccttctcttccaccccaaaaaacataattttgaccatttaattttttgctaatatctaaacctttttttacttgtgctgcagcaatagcgtagacatcagcattattagttgttgctgctccgttgacaaaacgaggatgtgtaaacatattagcagtgttccaaagtaatttaatgcccgtttgatccattttttctttaatcagatcggtaatggtatcgatgttttggaaaaactcttccaaggaatcaccttgaggagcaatatcgacatcgtggaaacagaaatattccgctcccaatttttctaaaatttcaaagaaagcctccacacggtttttagccgtttccattgggttgttgccttcccaatttctttggtaagtacctgcaccgaatggatcggagccgtctgccgtaattgtgtgccagtatgctaccgcaaaacggagatgctctttcatcggcttgcctagtatttcttcttcgggattatagtagcgaaaagcaaatttatttttagtctgtttgccctcgtattgtatttttggtaccgcttcaaaataattcattgctaattccacctttcttagttagttcgaaactcgtactaacctgatatgattatattacctgggtgggaacagcttgtcaagcgctttcgttttttaaaaattaccttggttggttaggtgcgatttatattttttccctgggacttcctttagaatccttgacaagattgaaattatagtaaatgatttaataaaatctatttcatatttgaagtatttcgaaattatcttaattaaaggagcagactaaattgaatgattacacaccgacacattacaatgagtcgaccatcctcgaattcatcattcaaaacgccgaggtttctcgatcaaaattagcgaaattaacaaacttaacgaagtcgtctatttccgatatcacaaaaacattgattgaaaaatcactcgtctacgaattaaacactggaatggcctccgtatcaggcggtagaaaacctatttacttgagttttaacaacgaatgcgcccttgttattgcgatagagattgggaaggactatatccatagttctttgtcctacatcaatggggagttggtcaataaattgagttaccattccctcttagtaaccaaggatacacttgtcatgttgttgacaaaaataatctccgatttaacttcgaaaataccccagaccccttatggtattttaggaattgggatggcaatccatggcatcgtgaaagatgatacagtcttgtttacgccttattcagacattgattccattcctttgaaagacctacttgccaaagaaattccctacccaatcgtcttaattaatgaggcaaacgcgggtgctcttggggagtatacgtttaaaaccccttcggagaatttggttaacatcaatattcaagacgggattggggctggtatagttgagaatggtaagctgtttatcggggcaaacggcacagcaggggaaattggacacactaccctttaccccgatggcattctatgtccgtgcgggaatcatgggtgtttggagcattatgcttctacccgtattctgttgaagaagctgcttgattcagatcataaaccacatccggacatctcagtaatcgttaaaaaatggcaccagggggatgcacatacccagaaaatactgaagcataatgcgaaattactcagcatcggtattaacaatattgtgctaatgtatgacccagaggttgtcatcatcaacagtgaaatttaccgaggcattcccgaattgattgacgagattaagaagcacttgactggtaaaaacacaaaaaacttagctattaagaatacatctctaaaaggtaattctacactctatggctgtgtttccatagttgcccagtcctttctgaaaatcaataatctgaaatttacagtgtaaagtgatagaaaaatatcctccttaaaacttcctatttttcgggaggatatgattttattagggtgtaagtacttagcagcatttttttcactaaatgatttcagctaacgtttcccaataacttttatcatttgattttttagaaaaagcataaattttgttttttacttccgtcatattatgatcttttatttgaataacgctctgattgaaagtagctatactgtcaatatgctgaatatttaaatttaacactaatccttcccctttttttgttaaaaatgaaatccgatcattatctacgctataagttccttcttttaattttgaatgaggatttgtttttagctcgttatcataagcgttagcaaataacgtaacggttataggtttatttctcattttttcgtctctcctttttggtctagagttttacaacttttttcttggcgtttgtcaagaagcctatcttttgatcttattttttatttttttaattatcttctgttctgttcatacagttgactcctttcttatttagtccttttttcaagtatgtccgtctgtcgcctgttttgcccttatcatgagggatttagggaagtaaagggcgagtgtagcgagtgcattttaccctttacttccctaaagaacttatgatataaaccggttggcgagagactgacttgaaaataggacgtgaatagaagtaataggttatgaacaaacgggtaattttttcaataaaaaaacgaacaaaagcagcaatctttttcgattgctgcttttgttcgtttcatctgttttaattgcatttatttttgggtattttgaacccgtggtgctagttaattttaatatcctaaagaatatctcaaagttccttcaaaacgtcgttgtgctcgacttaatagaacactgtaaaaagtaactgtgcgaaatagaacatctagttgtttctatttcgcttttttaatcctattatagatatacttagaatgttatagtatgtttaagacaataccctaaaatttagttggttactaagaatgttggtttatttaaaggaggaacatttatgctagaatcgtcaccaaaaaaagatggttttcaattggcgccagagtggtcttttcataaagaatgctatttgatttggccagaacgtccagataactggcgtttagggggaaaacctgcacaaaaagcatacgctgaagtcgctgaagtaattgcacgatttgaaaatgtaactatgctcgtttcgcatcaacaattcttgaatgcacgttatcaattacctgaaaaaatacgtgtactagaagtaagtaataacgacgcatggataaaagacacgggaccattatatgttatgaattctttgggggaagtacgtggtgtcgattttcgatttaatgcttggggcggtttgttagatgggttattttttccgtgggatcaagatgatttgttagctcaaaaaatttgtgaacaggagagaattgaatattaccaattacaagagtttgttctagaaggttgctcaatacatacagatggggaaggaacgctttttgcaacagaagaatgcttgttatcagaaggacgtaaccctcaattagataaagaatcaattgaaaaaattctaaaagagtattgtggcatagaaaaaatcgtttggtttcctcgaggcttttttttggatgaaacaaacggtgatatcgataatttaatcaatgttgtacggcctggtgaaattattttgagttggtgtgaacaaacaagtgatccaatgtacgaaatcgtcagagaagcagaagaagtattgatgaaagaaaaagacgcaaaaggaagaagcttcattatacacaagatagaattaccgaaacctttatacattacagaggaagaagctgctggtgttgatccggtaaatggcatgcttcctcgattttccggtgatcggttgattgcttcttatgtaagctattatacagcaaatggcggcattatttttccactttttgaggacccaaatgataaaaaagcagaagcactattaaaaaaaatatacccagaatatgaaattattggtgtaatggctcgtgaaattttacttggtggtggaaatattcactgtgttgctcaaggagtacctcaataagaaaggggtgatcggtaatggatttttttgaaatagccaatagtcatatttcagagctgactaagaatgaacaaattctttttgattacgtcatcaataacctagaaaacattaaaagtaaaagtatccgcgaagttgctgatgactgttttgtttcaacaactacttttctgcgttttgtcagaaagcttggattttctggatttagtgagtttaccactgttattaaatatacgttactttataaaactcctcttcccgagagttcaccttttgtcgttagccagaaagattatcgcgaagagtatttaaagaatttagttgaatctgttcgcgtaatagatacagataaagtgaaactaattgtagaacaactacaaaaacagcctaaaatttttttatttgctaaaggattgagtaaagaaattatgcgttatatacgatatttgtataatacagccggtttttttgtaatttttcctgaagatcatcaaactcgttctattgcacaaaagcaagttaaaaaaaatgatatagcctttatcttcagttacaaaggagaagatttagagttgatcgaaacaattcgaaaaataaaggaacaagatcatcctttaatcgtttcaattactggagcagataataacttaatacaaaattttagtgatattaatctttatttgtttacagatgaaatcagcttgaatcatctagatattacgtcacatatctcaatgattgcattaatggaattaattttgtaccaatttatcgaaagcagtggaacagacacttaccatcttgtttttcgttgaatgatcgacaagagaatattttgttcatcggcagcagcatcttagaaatgatgaacagtactagtatggaagcttgtcgtcaactaatcaaaattactggaagatcttattgtacgaaagtttatttgctttataaggatgttcttcagacaaccccagaggaggaaagcaagaaagcggtcaaaaaatgtatttgtacgttggggttgccaattggttatgaaacgctattataagtgtgggccaaatattatatacagcatttatttgattcaaaaagttattatcaaaacggtgtaagtaacaaacgttcacgattcgggaattactaccgtaaatgaaatttaaattgtagataacgtaaaggtagacgtatatctacaatttaaatttgttaaaaaacagcaaaatgagaatagtggcttaacaaatatcatgcgagaaatattatgggcagttgcaagaattgaaaaatgaattcgattcttggttgaacgggttagatgtatctaatgaacagatttaatctggaattttttattttttgaacaacaatacacaccgatttagaggttttactctaaggaacataagagatatagtatatccgcgtatggctatactatgcagtgcaaggttcattagtcataccaaatttattggtatgtttatacctttctcgtgtgaagcactattaaaattgacactaaaatgttaaaaggacagataaaaatacaaaatgaattatgtcagttgaagattctttccaatagaaactaaaaaagaatccaaaaattgacgaaaaagatgggctaaatcccggtgaaaatgtcgcagattttaaatgtctatctctatgacattgacattgaaggaaataaaaaatacttcgatagacgctagcaataagccattattagttatgacattagtgttaaacattcaaaacattttggataatagatacaatgaaaatccaaaatcctttgaaaaatcattttcatccttgacaaaaagaagaaatcccgagcgtactaagcaacaaagacaaaggacttcaggttaaggatattcatactctagtaatggggattaaccaaatgttgaaaaatcagcctagtccatttatcaaaaatatcacattttgtagcgaaggagcggtctttttgctttgtaagagttataaagaaatttcgatctggtaattatcagctatgttatgaccatgcttaacgaggttgaaagcctttttatcaagtgttggtagtgtaacaattgattaacatgcgtaagtacgaattaggattatatgagtctcattaggaaatataacctggtgaataaactagattgaaaggaatattaagtatggtataattttcaatctagatactgaaaattgaagaaagggtaatgttttgaatcggtacagtctgaagatgagtagtaataatgaactgcatataaaatttttcccgtgaatcgaccaaataactaattggaagagtatggattgtcccatcactggacagagaataatgtattccataattgatatagcaacgttttcgagttcatctaatcgaaacctatccccgacaataggggacgagaatgttaatagataactataaaacttcaagcaacgtattaaatagagtgaagaaaattttctatctattttttagtcagcaatctttaggtacaaattaagaatgtttctgcaaaagaatatcaatcatttacgcttagaatgtcgtaccataaatgattggtattcttattttgtcagaaaataagatcatactgttacagtatgatctgtgactaagagcattaatttatgctattttttgtttagttaggaattttgtggtgaacacttgtttgccaagagattagccaataacattcgctcgcgatacggagaaccatattataaatgatgctattttttgaaagaaaatggattgtaacaaagcacatagaaataatattctgagaaaaaaagagataccggaactgctgtccgttcgacaagctgtcctcggtttttttgtatgtaaaatttaaaaacagatgctcatcgatccatcggctgaattgccataagcaagtgattaaatctttttcatagaatatagaggcattatagtataaaagctcattggtaattttctattttatctttttgtgtttctccgaggaaaactcatttaataagtgatgggataatagtcattatctatactttattcaatgcacgactttccaataataattctgtcacgatcagtatctctttggcgtctaatttatccaatttttttaatgtgtattatcgattttttcttagtaaataagttctaaattgacaggagactgtaaaagttgctgtttgataaaagctaaatcattcgtaaattgacactatatttttctataagatgtatgagcacaagataattgtaaaaatcaacagattttagaaaagtatatcgagattgaagaaaaaattagaaatagccatattatttatgggagacccgatagagtaaatagtttggaggaaaatataaataacaggaatattaaaataagtacatcggaataggcgagtgcaaacggcagcatgtacaaatcaagctatccttactcttaaagaaggtagtcaacctacaaatttttcaagagtagctaatcaagcaaaaatttgaaaatcaactctttattcaattccagaggtgagagaacagatcgctttttataggaagggatggttctataagcaaaagcaggacgacactaaatcagattgtatgatccactcattagtaagaaaaattaagtctttagagccaaaaaataaaggaaaagaacttaagcttcaaataaaaaagatatacgggaacctattcgaaggtacaacacaagaataaatagagttctggtcaaagaaattttaaagtttcatttttcgaaaattgactaaaaattcgtgttcaggatatgaaacgccctatttcaggaagtttttgaccacgattaaattatccatgttatagtcgtgaggttctaaaaaaactttaaaaggagcatgtagagacatgcaaaatgtaaaagaattaagtacgaaagagataaaacaaacatctggtggtggtggtgctggtaaaaatcttatttatggtatgggctatggctatttgtggagttgtaataggttataatgttccgtaaaataataaaatatgtaagatctgtagttatatttatattgatagctacacttatggtgcctttatttatttttgaaggttctatgccactaaaaatattaagtttactagttatcttgttattaaatgtagttggtatattagtaaaaaaagagctggggatgaaatatttcggaatggtacactaattaaagagaggatgtttatattatgaatttaaaaaaaaataatttagagtataatttatgcatttttttagcagtaattataaatttaggattatttattttttccgaaactatattaagtaagattttactattgattgctattgttttattagttattcctaatttcatgcaaaaaaagaagagaaaaaactcgtaatgagttttttctcttcttttttagttgcatttagagtatacatttgctaacccagcagcccatgctagtggtccttttgggattccaaataatcccccagcaattgcagcaccacattttgctccacctttagataagttgttaggtctatttaactcattaggcattctgtgatcattttctccaccgataatttgtttcatctcttttacagaaacttcttttacattttgcatattggaactcgctccttttatattatttttattacgatactatcatgatatacatctatagcaaacagttaaaaacttcctgaaataaggctttttcattcctaaaacctataaaattacaatttaattttattgaatatgttattttaataactagttaacataatatgtagtttcttatacggaataagcatgagttgtcttgtttgtttagtgctatttagttttcttttttatatttcctaacttacgtttgtgtaatgtaaaaaagaatgggtgttattcattctggattattcgaaagaatcagtaaatgattattttctaatcgacatgaagcctttttatgcgagtatcgagtgtatagaaagaaattttgatccattaacaacagaacttgttgttatgagtcgcgctgacaatactggtttaggattgatattagagcttcttctcctgaagcaaaaaagcggtatgatattacaaatgtgagtagaccacgtgatttatcacaactatttcctaaaacatcatacgttgttccaccacgtatgaacctatatatcaagcgaaatatgcgggtaaataatattttcaaaagatatgtggctgacgaagatctactgatgtatccaatcgatgaacccattttaaaagtgaccagatcactgaatatttttacgactgaaggaacaagaagtcagagaaggaaaaaattcgttcaaatgatccaagaacgtattaaagaagaattaggattgattgctacggtaggtgtcgcggagataatcccctttggccaaactcgccttagacaatgaagcgaagcacaatgaagggtttattgctgaatggacgtatcaaaatgttcctgagaaagtatggaatattcctaaaatgacggtcttttggggcatagggtttcgaatgaaaaaaactcaaccagatggggatcatgagtattaaagaccttgctaactggaatcattatacgattaagagtaggttaggtgtgattggcttatagctgtactttcatgcaaatggtattgatcgaactgacatagcaaattattactgagatgattaaaaaaactaatttataagcaatgaaaacgttgacttataaaatgaaataaagtatatttattttgtaagaaaagaaaaaagaacttgagatagcgacgcagttatctctagagttatgttactgataaatcaggcagaactcagaactaatatcaagtaaagctttatgatcaaaagcttatttgatattggatctgagttcttttttctggaaaggagaaactaatgaaagttaaaaagattatcaataacaatgtagctttaattgatcggggaggaaatgaagcaattatctatatgacagggattgctttcaaaaaaaaagttggccaacgcattaatgattccgaaattgaaaaaacatatgttttagattcgaaagaccgtttagaacattttagctatttgttatcgcattctgatgatagactgatttctatgatcaacgagctcgttagttatggagaaaaggaaatcggtaaaaaagcaaatgattatctttatttagctttattagatcatctctccttcgcattgaaacgctcagaaaaaggacaatatcttagaagtccgctcttttgggaagttaaaaagttttatccagtttattacaaaatcggtttggaagctttaaaaatgatgaagaaatattttaattattcctttcccacagatgaagctgtttcaattgccttacactttgttaatcttcaagaaaatcaggtcaattttgatgaacagatagaagatatggagacactaagagacatgttgaatattatcaaatatcattttagtttatctattgacgaagagagcatcaactacatgaggctagtgacacatttacagtattttattgaacgattaagaaaaaaacaagcatacgttgaaaatgaatctcagttatttgaacaagtaaaaaaactataccctaaagcatatacagctgtagaaaaaatagaaatatatgtaaaaggaaagttcaacacctatttatctcaagatgaatacacttatttgatgattcatgttaatcgcgtagcggaaagaggcgacaataatgaataagtatcatgattttaacaaacatattattgaacttgttggaggaaaagaaaatatagaggcagtagttcactgtatgacacggttgcgttttactcttatcgataaaacgaaagcgcaaacaaataaacttaaaaacttagacggtgtgattgatgtagttagcaataacgttgcttatcaaatcatcataggcacacatgttaacgatgtatataaagaattgatgactcaattagaactatctcccaaaactactttagaagagcaaagtggaaaaaaaaatccaataaaaacagcacttgatgtcatatccgaatctatgacaccgatacttgaacctattatttgtgctggattacttgctgctgttttatccattgcttctttaactggaataatatcaccagacagttcaacctatcagatttttgatgctttgcggtctgctgtattttattttctacctattttaatggctatgagctgcgcaaaacgattaggagcaagtccttatttagcagtagcacttgctgctactatactttcaagttctatcaatgatgtgaaaggactggagttatttggtattggattacctcaaattacgtattctaatagttttatccctattttactagctatctggtttatggggtacgtaactaaagtagttaaaagagttatacctaacacactccaatactttttaacccctttgttagtaatgttaattactttaccagcaacgttattgatttttggacctttaggattttatatgggagaaggaatcattggattttttaatctactgatgaaatatgtaggtagttggtttgtcatgatgttatactctgctcttcaaccatttattataatgttgggcgcaggaaactttatcatgccggttgtagcttctctaattgcagcaaatgggtatgaccctgcatttatatcttcatgtacaatctcagatattgctgttgggggagcaatgcttgggtatttcttaagaacacggaatttaaaacaaaaacaattatttgggacagtaacactttctgcagtacttggtgtgactgaacctgctatctatggtgtctttgttaaatatcgtcgaccatttgttgcagtaatgattggaggaggacttggtggattatttgctggtttgactagtgttaaagcttattctgttgcttggggtttatttggcctcccagcgtatataggtgaaggagatttcatgaacttctggtttatgttagcggcagtcgtgattagttttgctggatcagctgtagctgcttatctcttaggcgtccctgcacaagaagaggatcaggagacaatcaaccatataatagctgaaaaagggaaagataaaaatctgcgcacttcttcattgggtaatgtagtagaaggagaagtgatttctttaaatgaagttaaagatcaagctttttcaacaggagctttaggaaaagggattgcaatcaaaccaatagatacacatctttattctccagtggatggggaaatcacggtagtttttccaacgaatcatgcaataggtatccaatcacaagatggaattgaaatactaatccatattgggatcgatacagtagagttagaggggaaatattttaatttaaatataaaacaaggagataaaattcaaagaggacaactccttggaacagtagactttgataaaatacaagaagctggttatgatacgtctactattgtagttgtcacgaataccgatagctatttagacgtcattccttcaaattcagaacaagtaataaagacagataatctactaaacgtcattttatagaaggtgaaaaaatgaaattgaaaaagaattttttatggggtggaagtattgctgcacatcaatgtgaaggagcctggcaggagggaggaaaaggaccagctatcatggattatgtcagacaaggaagctatcaggtcccacgccaaatcgatacaataatttcttctgaagctacgtatccctcacatatgggtattgatttatatcatcaatacaagtcagatattcgtctgtttagtgaaatgggatttacagcattaagaatatcaatagattggtctcgtatctttcctaatggagatgatgagcagccgaatcaagaaggaattatgtattatatagatgtggtggatacgttgttgtcttatgacattgagccaattgtaacattatatcacttcgagatgccaaaaaatttagtccaaaagtatggttcatggactaatcgaaaagtaattgaactttatttgaaattttgtcaaactatgtttgaatctttaaaaggaaaagtccactattgggttacatttaatgaaatgaatcatattgatcctcaaacagaagctacagatatttttacgtatattatcgcaggtttgaagtattctgaactcgaaaataaatcgcagacattggctgagatcggatacaatatgacagtggctagttgttcggcaatagttttaggaaaaaaaatagatccagaaaacaagattggttgcgtatttggaatcgaacctgtttatccagtagattgcaatccaacaaatgtgatgaatgcttttaaacaaatggatcgagatttctatcaaatagatgctatgtgcacaggaaagtttccagactataaaatcaatgaatatgcagaccaaggaataaagttgaccataacagagaatgataaatatatgttttctaaaggaacacttgattttattggtatgaactattatgcatcatctgttgcgaagtacgaaggagcagctgaagaaaagagtgccttatttggcggtcttcaaaacccgtatcttgtgactagtaaatggggatggaccattgatccgacgggtttacggtatctgctgaattacacttatagaaaatatggactccctatcataattacagaaaatggattaggtgccatagatgttttgacagatgataaaaacatacatgatgaatatcgcatcgaatacttaaaacagcatattcaacaaatgaagattgcaattgaagaagatcaggtagattgctttgggtatctcacgtgggcacccatagatttagtaagtgctacaacaggcgaaatgaaaaaaagatatgggtttatctatgtagacaaagacgatgaaggaaatggaaccttagaaaggtacaaaaaggactctttttattggtacaaagaagtgattggttccaatggagatattttgtaatacctgtttaacatagaaggagttatagtagttatattcatataacaagtagttagcttagagtaatattactaaaggaccaaagttctatcttaaaaaaataactatctttaatatataaaatcagcaaatcataaccaccctttaaaaaagaggggcagggtgtagacaaaagtatcagtctacactctgagatgtaagaaatatcataagatatttcttacatctttttgttttgagcaggactttagataattttattaatatatgctagcatgcttttgtaagaaaaagaaagagggcgtattagttatgtatcttaaaattacggaacaagcacaagaaagattacaaaaatatattgatgaaggcgcaacagttatattggatttagatgatggcgttggggaatattctaaaatgggtgtttgctctttagatactagttttcgtttacttcttcttgataaagaacagagaaaaaatgattataaactccaattagatagtgatattggggatgtttatataaaagattattcaaaaatgtacatggatgaacatatgaccctttctttagatccacgtctaggtgtatttactcttgaaagcccaagtggttctttagacagtcatgttcaattagtagatctacgaccagaaaaattctctggcatgaaacaataattttctcttcattgatccatgatccataaaactagtctcaatcaagctgtgttgaaaaaacaagacaacattcttaccatggtaaataaaaaagacgacacattttgtcgtctttttttaaattaactattttcgataaaagatcgcatagcttgtgccattatttctggcttttctctattcaattcatgttttccgtttttaataaagagtagccggccattcgttgaaagtttatataaacgttttgctgctggtttattcgcatgatctttggtaccacataaaatcaatttaggaagtcgtgatgtacgaagctgttttttgcagtctaatgtttcaagtgaacgaagtagggtaagggtttgttttttagatagacctaatttttcaaatatcttagaaggtacgcagtaaaaataaatattctggaaagggtgtctactgaaatcaaggtattaatgggaataacagcctaagatatttggagttcagagagggcgcgtttgattttcaaacttcgcaacagaaccccataatttaaacacctttcttctaaataaaaatctcttcttttctgagctattcgtaatcaaaacaagcaactattgagtatttgctatctgttcattcggtaaaatagtaaactgataggtcgtatggttgaccttttcttgaccagggtacaaagcgatcgaaccgagttcaggtaaatggactagatccggaaattcttgtggctcgatggctaaaccatagtttgaatgcatatgtttcccgttgatcataaaatcagcttcaaaaccagtcgtagaaaataataccacacttctatttgttgttgctatagacaactggagtccagattgtttttctgaaagacacagcaccttttttgaacgtttcggtgtagtaagaacaaaaacgtcatcaagtccttctggataagcgttgagaatttcttcgattgtatgtggtttcttgaaattgatcggtaaatccgcttgagtgatttgttcgcctgttggtagtttatcttcatctaataccaatagactttctgcttggacagccagttcatgtgtatcaatgtcacatttaccattcccagaaaggttgaaataggcatgattggttggattgcagatcgtctcgacgggactgttcgtttttgtgatcatttccaggctattcgcagttagctgatacgtgatcgttgctgtgataggaccaggataatcggaaaaagtgtcttgtaaataaaagacaacgccgatcgactgtggatttttgaacacttcgacatcccaatattggaaagaccatccatttgttcctccgtggatatggtggttgccggcgtttttttcaagttgatgatttccccatgtagcatttcggattctgcctgctacgggaccgactgtggctccaaagaaactttcatcggttaaaacatctgaaagttcatcataagaaagtaagacgttttctaaatgtcctttgttatctggagcaaagatttggtgaagtctagcgccataatttagaagaacgacggtcaattcatcgttcttcaatgttattttttttaattcagtgttggggataggagtcactgaaatagaaggttcaggcatttggctgccacgtttttttcaagtaatcgaaagtcaatgaagctgtatcaggtacgattggaatatcctccccaagatcttctgaacgtcctacgccgataggttgcgcaccactagcaatgatcgcagcgattccagcttttgcatcctcgatcccgatgcagtcacgaggggtcaaaccgatttctttcgcagcaagtagaaaaatatctggttcaggctttccattagcgacttttgccggatcagcaatcgcgtcaaagtagctttctaaatccatcttggcaagtaggaaagggccatttttgcttgcagatgctagtgaaatcttgatattgtttgcccgtaagtcttttaataattctaaaatccctggaaaaacatcttttggtgtgatcgattggatcatttcaagataataatcattttttcttttcgctaattcgagaaattctgtttttgagaattgctcttctttttttccatgagcaagaaggagagtcagagaatcttctctgcttacacccttcaattgttcgttgaatgaccgatcgaagggaataccgatctcatcacctagctttttccaagcaaggtaatggaattcagcggtatctgtaataacgccatctaagtcgaataatacacctttaaacattcgcttcaccttctcgtaatggaatagtcaaatgatcagtaagcacatacgctttttcgtagatttctagcggtaaagcttcgccagataagaggttcaatgttacctgttcatttgaaacggcgacaaataacaagcggccgcgataattgatatggaatgaataagcagaccatgttttaggtaagaatggtgcaaatcttaattgttcatgatctgtcttcatttgcgcgaatccttgtacgatagcaagccaacttccggtcattgaagtgatgtgtaagccatcctctgtatcattgttatagttatctaaatctaaacgagcagtgcgttgatacatttcaacggctttgtcttccatgcctagttcagcagctaaaatagcatggatactaggagatagggaagactcatggacagtcattggctcgtaaaaatcaaagttgcgttgtttttcttcttttgtaaatgaatcattgaagaagtagataccttgtaaaacgtctgcttgtttaatgaagcaagaacgaaggatcttgtcccatgaccaatgctgattcaatggcaattcacttgcagatagttccgctgctggtttgagatccttgtctaagaaagtatcgtgttggacaaaaatccctaattcttcatctactgggaagtacatattttcagcaatttcttgccaatgtgccaattcatcgtcactgattttagcagtgctctcttctttgaacttcaaataattttctcgtgtgtaacgtagtacccaacaagcaatcgtatttgtgtaccaattgttgttgatattattctcatattcgttcggtcctgtaaccccgtgaatcatatattgattgtttcgtttagaaaaatggactcggtctgcccaaaagcgagcgatttctgccaagacttctaaaccttcattttttaaatagtcgatgtcaccagtgtagttagtataattataaatagcgtaggcaattgcgccatttcgatggatttcttcaaacgtgatttcccattcattgtggcattcgacacctgtgaaagtgaccattggatataacgcgccttttaggccttgctgttgtgcattatggattgcttgtggcaattggttatggcggtacttcaagagattcttagtgacttcaggtttcgctaaagcgaggtacagaggcactgcataggcttcagtatcccagtaagttgcaccaccatatttttcgccagtgaagccttttggtccaatattcaaacgttcatcttcgccataataagtagaaaatagctggaagaggttgaaacggattccttgttgtgcttcatcgtctccttcgatgactacatctgccaattcccatcgtttagaccaagcggctgtttggtcctcttttgcttgggaatagtgaaccttcaattcgttgaattctttaaagagatgtgtcgcttgttgcgcttcagggatatctcggcttgtgaaaaccaatacttctttgtcgattagaagtgtttcattttctgttaagtcaaaggtgaatgaaccttcgattgctaaggtgccctcttggtagcttggcgtatataattttccatcaacgtagtggcgcatcccagcggtcactgtaaattgctcgatctcaaaattattcgggatcgttttagtcgttaagtacgctatttcttccttgacgccatgatcgatgtcattccaaaagtgttcatcgtaattgctgtcttcgttttggacattgccatctagcttagaaataacttttacagttccatttccttccaacatttcaatggttaagcgaatataagcggcttcatttttgacaatacttaaaaagcgctcgaatgaaagacgaactttgtttgaaggggtagtgactgtataactacgtgtcaaaacaccgtttttcatgtttaattcccaataaaaatcttcagtagtaagtgtagctagatcaatcagctgatcatcgataaaaagatccatagcgataaaatcgactgcattgattacttttccaaaatattcaggatagccgtttttccaccagccaacacgtgttttgtcagggtaccaaacacctgctaaataggttccttggtgatgatcaccagaatatgcttcttcaaaatttccgcgcatacccatatatccgttaccgatactggtcaatgattcttgcaagcgtaaattttctttatctaatttattcgtgctgattttccaagggtcgatctgaaataaccgtttaatttgtttcattgttctcctcctagacgttgtcgtttatacgtccataataaacgcaaccgattgcgtaagtcaactagaaaagtgaaattaaattttgaagtggatgaaaaaacaaaataaaagctattgtatcaatatttactactataatatgaacagaaaaaatgtataaagaacgattgagtacttacagaaaaagcataaaaatacgaaataaagcatttacaaaaaaagaaacacacgctataataactaacaacgaaaccgattgcacaaaggagacgaggaaatgaaaaaaatatttagctttgagttttggcaaaaatttggaaaggctttaatggtcgttgtggcagttatgccagcggcaggtttgatgatcagtatcggtaaatcgattccgttgatcaatcctgatcttgcacctttagttacaacgggtggcgtgatcgaaaatattggttgggcaattatcggaaatttacatcttttatttgcactagcgataggtggtagttgggcaaaagaacgagcagggggagcattcgctgcggggatctcatttatattgatcaatcggatcacgggagcaatttttggtgtgactaatgagatgttggcaaatgaagacgcatttacgcataccttgtttggcacgaaaatcatggtcaaagggttctttaccagtgtattagaagcaccagcgctaaatatgggggtatttgttgggattattgcagggttcgttggggcgatggcctataataaatattacaattatcgtaaattacctgacgcattatctttctttaatggaaaaagatttgttccttttgtagttattttgtggtcaacgattgttgccttgattcttgctattgtatggccgaatgtccaagcagggatcaataactttggattgtggattgcagagtcaaaagaaagcgctccgattttagcaccattcctatatggtacattggaacgtctattgttaccatttggcttacatcacatgttgacgatcccaatcaattatacgcagctaggtggtacctatgagatattatctggtgcgcaagcgggaacacaagtatttggacaagatcctttatggttggcgtgggcgactgatttggtcaacttgaaaggcgccggcgatatgtcgcaatatgaattcgtattgacgaactggacacctgctcgttttaaagtgggacaaatgattggttcttccggtatcttgatgggattagcactagcgatgtaccgtaatgttgatctagacaaaaagtctaaatataaatcaatgtatttttcagcagcacttgcagttttcttaacaggtgtaaccgaaccattagagttcatgttcatgtttgcagctgtacctctttacattgtttattccgtgatccaaggggcagcttttgcaatggcagatattctacctttacgtgtccattcatttgggaacattgaactattgacacgtacaccattagcgatcaaagcaggactaggtatcgacttgctcaattttgttatctgtgtcatattatttggagtattgacgtattttgtggcaaacttcttgatcaaaaaattcaattatgctacaccaggacgtaatgggaactatgataacgacagtgaagaaacgccgtcaggttctgcaactaatgcagatcaacaaatcattaagatcatccatttattaggtggaaaagaaaacatcaaggatgtagatgcttgtatgactcgtttacgtgtcagcgtcgaggatcctgggaaagtcggttcagaagaagaatggaaacgtgctggagcgatgggcttgatcgttaaggacaaaggtgtgcaagccgtgtatggaccaaaagcggatgtgttgaaatcggatattgaagatttactacaatcaggcgctgatattccagagccaacagttgaggcaacaaataaaaataagaagaatgaagagaaacatgttttaggtatcgaaaaagaattattcactgtagcaactggtgaggtaattgctttaaaagatgtgaatgatccagtcttttcacaaaagatgatgggtgatggctttgctgtcattcctgccactggagaagtgacggcaccactttctggtaaaatcgtgagtgtcttcccaaccaagcatgcaattggcatgcaaacagcagaaggagcagaagttttgatccatatgggactggatactgttcagatgagccagccagcatttgagatcttagtttctgaaggccaagaagtagtagcaggaacaacgattgctcagatggatctagatgcaatcaagaacgaaggaaaagaaacgacgatcatagtagtctttacagatgacaaagtcaatgggctgaccatcaataaattaggagacactgaacgaggaacagtgatcgggaaaataaacttgtaaagaatctcagaagttcatgtgtgtatttcatatcgaaagaatgtgttcgatgtgtgtaatcctagaagtaagccgataatcccgaaattgcttttcctatttcagggattattggcttattttttgagtgaactactttggggtctctacctatatctatatggattcagaaggtgggagcaatgtttcggcccatcccattaagaaggagaattatatgaaaataatgacgttgaatacgcatagctggttagaagaggaaccacgagaaaaattaaaacagatcgctcaaaaaatctgtcatgaacaatatgatgtgatcgcattgcaagaagtcaatcaaacgatggacgcaaaacgactaaccagtgagcagctgaagaattttagtcaggtgcaggaacaaacgcctgtccgctcggataactttgcctattgcttgatccagctcttagcagaacaaggtgaaacttactattggagttgggaaatgagtcatatcggctatgctatctatgaggaaggcaatgcgcttctttccaaacaaccactaattagtcaaacgcacctagtctccgaaacgaaagaaaaagaggattaccatactcgaaaaatattagtgggtcaaacctctgtcaaatcacaatgtattactgtagcaagctgtcatttttcttggtgggcagatgaaaaaagcggatttgcatttgagtggaaagaattagaagcaagtttagcgcctcttacaacaccactgtatctattaggggatttcaacaatcctgctgaaggcagcgggtacgatttagtggcaaaaagtcagttgcctattcgtgatgcttatccaatcgcgcaaaaaaaacaagctgaagcaacgatcgaaaagagaatcgatggctgggaaaacaataaagaggggctacgtatcgactatatttatgtaccacaagattgctttgttacaagttatcaacgtatttttgacggggaaaatggcccgattgtcagtgatcattatggggtagcagtcacgttggagtgaagagaaacgaaggaatattgtcacaataagaatatgggacaaatctaaaaaccaggtttgctacagactctcgaataaacgacgggagcagaagcaactccctcttaaataagccgaaacgaacaaaaatttgaaaagcaattttcgttcatttcttcttatttctcagagttaaacacttctgtcctaacctctctcaaataaacgacgtccgaaaggcaggtttttcggaaatttaaaaaaaacgagcaatacaaaaaatgtattgttcgttttttctctaatttctcataaacgatttttgtctcgacctcatttttttatgaatgtatccgacttctaataaacatgatgaataaaatcagccaaccaatgaaggtcaacccgatgatgaaataaaagaagagcggcaagtcataatataaggtgatctcattgataccattatgctgtttgacgattggcgtaccgatgtctgtcaattcatatactatgtatatagttaagctttatataatggaactgtatattaagaggagtgtctttatatgattagaaatccatatttacctttaactgaaacaactttttatattctgctagttttaactacacctgctcatggatatgctattattcaagaaattgataagttaagcgagggatcagttaaggtagctgctggaactatgtacggagcgattgaaaatttacttaaacttaattggatagaagaaattccaagtagggaaaaaagaagaagagtttacaaaattactgatctgggagaagaagttttaagactagaaatagaacgtctaggaagtttgattaagctatcttctgattttggatattaggaggagataacatgaaaaaatttagaattttcttatccttaaaaaaagaagaagaacggattaattctatacaagaagaaggttataggttagtttctgttagttcagtggtgcctatatatacttttgaaaaattggctagtaaagaaacgtttattccttatgtgcgccttgattttagagaaaaaagtatgggaaaaataaaatatgaagattatgtaacattgttttctgatagtggttggaaactaataaagggaagtcgttctggtggcgctcagtattttcagcaagaatatcctgatgtaacaagggacatattttctgacactgattctcaagaaagtgtaaagaaaagatatgtaaaatatggttatacttatggaactctatttttattgtatttctttattttttttagtagtaattcttggaatttggataagatattgaactttaaatcatggtattttacccaaggtttatgggaaatggagggtatgtggttttggaaagcgttcatttttgaaactccgtttgttttactccgtgtattaccgttatttttctttctgtttttgggtatctattatcttttacgttcacttataaatgatgattcaacagtgataacaaaataaaatattttgtgtaaatagaaaaaaggaagtcccttctgtagaatagagttaccacaacacattcacagaaaagaggacttccatatgaacgattttactacagaaattctaaagactctagcgaacaaaggcgatttgaatgaattattccgtgtccatttggaaaaagctgtcaatacgcttctcaaaacggagttaacggctttcctcgattacgaaaagtacgatcgcattggttttaacacgggtaattctcgtaacggctcctatgaccgtacggtcaagaccgagtacggggaacttcatctccagattccgcgcgaccgcaacggcgagttcaagcaacagactgttcctgcttatagacggacgaatgacacgttagaggagaccgtcattcacctcttccgaaaaggtattaccatgtcggaaatcgcagacttgattgagaaaatgtatgggcatcactacacgccccaaaccatgtccaatataacaaaatcatttacagaagaggtaacggcgtttaaagggcgggagcttcatgaccgttatgctgctatttatatggacgcaacgtatattccgttaaagcggaaaaccgtcgccaaggaagctattcatatcgcagttggcattcgcccggacggatcaaaggaagtattgagctatgcgattgcaccgactgaatccatcacgatttgggaggaaattttattggaccttcaagagcgcggtttgaaaaatgtcctcctgttcatcacggatggcttaaaggggatggtaggagcgattagtcggttctatcccaaagctcgttttcaacattgttgtgtacacgtttcccgtaatatcagtcacaaagtgcgtgtcgatgatcgtaaggaagtctgtgatgattttaaaatggtgtatcaagcctcatctaaagaggtggcgttggaagcacgtggtgcttttgcggaaaaatggaaaaccagctatccaaaagtggttgaatcgattctttcgaacgatcacttgctcactttctatgatttccccttggccatacgcaagagtatttattctacgaacttgattgaatcctttaataagcaaatcaagaaatacagccaccgcaaggaacagttccaaaacgaagagtcgatggaacgtttcttagtctcgtcttttgatacttacaaccaaaaattcctaggtcgcagtcataaaggctttcaacaggccgaaggcgaacttgaacaaatgctaagccaactgattgagaattagaaacaatctgcagtagggaagaatcatttacacaaaattattgacgcaaccggttaaatgaaaatagattagatagatattataaatatgttgattctattttcatagcaatggagaaaatacattagcaatatataaaagaaggtatcaagagtcacagtgaatttattccgaaaagtgaaaagagcaaatataaaatttaataaaaatatagaactaaataggaaaacgtagacgtaattttctacgttttccttttcatatatcttgcatttacttcccccccttttgttacaaatacactacattaaatatatcatgatagtgtatttgtaacaaggttaatgtctatcgatctaattcaatttctttttgaatccgctgctggttctttaattgctgcagtcttcgtttccatttcttccagcgctttttctcttgtcatataatcaatgtatgttgaaaaagattttttattgggcaaggtaaattgacaagtgagaataactgcaggcgatttattcatcatgttccccttctacttttatctttttagaatcttcgttggatcaaatggatctactctggcataaacagattcattcacaggtttcttcaactgaggggaatattttttggtttgattagatttaatttttccttccacacgttctcttgcttcttggtaaaccgttgaatttgtaccaattagtattcctgtatctttcaaatgaagatctgcaaactctgaaaccatttcggttaaaatagaaatttctttactcattccattcaactttgcttgattggaatttacttttttctccatttctggatcataattcatacatagaaaccgaacggcttcactatagtttttaacttctgcatgagtagaaataatctcatccaacacatcgatatgtgtttggtgaaagtaaatgtgtttgtctataacctttgccatatcaaagttcacttcctctattttgctcgatcaagatttctaaaatacgattgttttggctaacatattcttctaatatctttgtgttatagctttgaatttctgaaaacttttctaataactgatcaaacttttcttttttatattccatcaaaggacgatcaaaattattttctattagtaattttaaataatcgttacgactccatttattacccgtacggttacttagttcgtcacatcttcgatcaatttctcttacgattttctcatccacatttcttattcttacttccatattaattcctccaatttaaaaaggatagcgaaaaggagcctatcctttttgctatcctactaccctccttttactatccttcactatcctttcactatcctatttttaaatattttgttcccacatttatttttgagaaacgtaataggcacagcctatgggaacactttttttaaaaagtgttcccacgtttccttatgctctttacaaataaaggcttttagagacgttctggaattttagattccttgaattgttcccattcatcaatcaattggctataagtagccattaatttttttcttgctcttgttgctttcgaatcaacaaaaaatcagtttgattcgttaattctaaatattctgttcggtattcaatgttcatcgtacccgttttactacatagtaactgattatgacgttctttcactttgaataactgctccttctttaaggtttttaactccatgccaactataagcacaatcctgtatagaggaatcattttcaaacgattctccataattatttatctttcattggaagttctaaatcactactgttccaaaaaatgtatggtttgttttgacgaatattacttccatctaaccacaattttccgatgccatatcgtaggcttgcttcgacttcataaaaattgtagatctcttttcttcgatctattgctttcatttcctggccattttttaaaatagatctgatgcccttaacagtagattcatggatactcgtgtgaacgatatccgtattgatcaattcgtcatatcttccaaaatcaacattgtactcataaccaagaagtgtcggaatcaggtcaatttcaatttctttttcaattgaacgtttaataagtttcgtggatacatacccgacaaaaaagagaataatacccacttcaaacaaatacatgtgtccatttacaaagtgaataaacgtcaataaaaaatccttcactccttttgttgttcttccagattgttcaatttgttttattaaagtcgctagaattgcatttacaacaattaaatcgaataggcttttgaaaagttttcctgctgttaatttttgcctggtaaattgcatgactaattgagtaaaaatagacaatagcatgacaaaaatcaacgtcattagcactgtaaaaatgtctgatgctgcaatcctattgggatcatttatcaagtaataagccgttccaaatactccaatcgagtaaacggttaaatcaagaataagtcgtgccccgtaactacaaagttttcctaatggccataattgcaatacccaaaatttctttcgtttgctatttcttttcagaggaagccaggtgtgttcaatccagtcgtccgatttcatttcgatttcttccctaaattctttcctttaacgttttcctttgctactttagcagcgataggttgctcaatgaaccaattttttaagtaaataaaaactactactggatatacttcttcctttttcttaactcgttagctattttatactcaatatactcctgctctaacacacacaaacaatcatatacctgatccatagtctccccagaagctaaggacaacccatgaagaaactcaatcggcaaagaagcaactgttttttccctggtaacccaagaagacaaagtcccctgcttaaaaccataaagctcacagaacacttccacagataatcccaaacgaccaatgataaacacattaacaggatgtgaatagacataattttttaacgacatacaacttcctccatgatacataagactgcatacgcagttataagtataccacctacacgtagctaggcaaagggagcaacacctacagaagtatcatagatatattgtataaggcaatttgcaccttttatttttcaacctgtatctacttcaaaaagattcacttctttaagagggttcaagggggttgataattgtctaaatgtctcttctactaagctctcgttgagtccaaatacctctgtgatccttgttgaataatctagtctcttttctttacttagttgaataaccctcgcgaacaacgttttgactgaagcaatgatcattccgccatttcttcctcgtgttaccttgtagaagactttattctcctctcgtaactcatttaagatcttatcaagtgttcgcttgggcatcgttagttgtgaagccaattctttttttgacaggttcaaataaggctcactagcaagacttttttcgcttagataagccaatagatcttctttccattcatttttatgactatattttctttgatctcgtggctttttaaatttccaccagccacgtcgttgaatgaacagatcattattttttaaggttggtgaaacccattgctggcacaattcaataatgaattctctgcttgctgcttgataattaccagaataagcactacgtacaatctttactaattctgcttcagatagcggttcctgtaaccgttcgttgaatgtgaacatattgtattcgcaagtatccaatgcataacctgaagagtaataagctaaagaaagcgtgaaaatcacattatttcgaccaagacgtccttctccgccgacgatgtttgctttatgaagtaacatatcgaaccacggttcatctacttgacgaatttcttttttctcaggaaagacaattagttttcgttctcgatcttcttttgttttttgatctgattcaagcttcatcgaccattgaatccagtcagcaaaagaatactgatagttcatttctttaaaaacaatattattttcttgtgggaatcgagcaattccgaagtggttacatcctagatccactccggacaatttttcagccaactgtagacgaattgtttttgaaattttttttgctacatcgatcaccttgaaattgcttttctttgtgacatagcctggtgtctttagtacaaaataaacttgataaccatgatctgattctaaaattagcgttggcatgtagcccacttgatctaaacaggctaaaataatttcgccttgatggttctcttttgaatcgatatcaactacaaatgtgttgatttgacttaagtttttctcagaatgacctttaaccactgttcgataatcatccgcataagtaccaaagcgataggtattaggtgtccaatgcgttagtttcttttcgttctctaaaatagcttcttccgaagtaatgaccataccacgcccaacattcattaattgcttgctacggtacgcaaagatagcaccactcctactggaatcaatatgacctgcaggtttcatggtgctgtttcgatatttgtatgtacgtaagccgtttttaagaatagctgaataaatttcgctcaacatcgattgtaacgtcctttctcaaacaaaaagagaacacagtttagctttaatctcagccatagtatgtgttctctcttcagtgtttaagaatatttaatttaagtacactaaataaacgttcttctgttgagttgctcgcctttttttggtagaataaaggcaatcggaaaaggtatccgatcaacttttaatataagtagttggtagctacttacatattcttgagacgagcgtgaacacatgtcctaaccatgtgattcagaaataattgattctgctaaaatcaattatttccgtctcttttttttatgtaatttttctgtttaaagagtaccactgcttttgctactttgtaaatagtgaattatctgtggtttctatagaattaagtttacctcttttcactctaaattgtcaacgcaaaacgcacaaatatattttgacattttgaatatatctgatatactgaatatagcaaatatatttagtatatccactatattccttataaagtctgaattcttatcaatttggagtatattagatatatcgaatatattaagtatatgaagtatactaaatatatttagtataggaaattggagggaactatggaaaacttacggactgcatttaaaacatcagataaactaggaaaagttgtaatgcttacaggtagaaaaggcggcattggtaagactacagacaatgatttattagcgattgtttctagtcaactttttgaaaaagacgtgttgctaattgattatgaccaacaaagaaatactacttccaacattggatcaacgtatcaaattactagctttgatcgatccatgtctgcagcaatcaaaaaaggggactgggtttcaggtattactcaagtaagtccacatttatatattatggctggctctcctggatctgaagaacttaatgaatacttgtccgaaaaatatcctgatcgtcgtaagagatcattggccttcattaaacctttagaagaattgagaaaaaatttcgattatatctttatcgactgcccaccatcaacagataatgtggttcgtgcattcttaactgctgcagattatattattgcaatgcaagaattaaaacggtacgcaatggaaggaacagaagattttattaataaagttttagttccgattgtcacgaattttgaagagtctcatcttcaaatcattggaattttgcctgttcttttctcagtgcgacgttcctctcaacacgcaaactatcaaaaaacaattgataagtatggtgaatcaaacatttttaaaagcattgttaaaggctcggatcggttagaaatgtatggtgagaatggtatccaattaaatgattatgtagatcgaagatggtgggctatttttgcagacatctttacagaattagaagaaagaattgaatactatgaacaacatggtgatattgaaggatttgattatacacctaaatatgctgactcaatggccaatcatatcctacctcttggaaaggagattaaactaaatggcattattaccaacgaacaaagataagaagaaaattggtgctgaagatatttcaattaaagatgatattaatgtcgagttaggggaacgaaagtacactgcgaaagaaagaaaaccagttcaagtagatcctcccgtactaaaaaccattcgggatcttagttatgcaaaagatattcctatgtatgaaatagtcaaacttgcaatggacgcctatgttgatactttaaacgacgaggaacggattatatataatagacgatcaaaagattaaaatatagtaagtatactagatatagtaaatatatttagtatacttactatatttttagctttattaatcctaatccttcaaaatatgtgtattgtttgggggtatacaacattcacaaattttattgtttctagtttttactatactaaatatatttaatatagtgagtatagtaaatatattggtttttatctacaggtaatggtggttttaacaaacatatagttacagttactgaagaacagtccgttagtcagcaggagtaagtaataaatcgtttgtgagacactattttgattgatacgacctctaaccatgtgtttgtttcatttatgttataataagaatgtaagcatattaaacagcaaactatcacagcagcactagactcaatcaaatgaagggggatggtgctaatgaaaaaactactagcaatttcccttatcctaaaaaggagaattaatagtgtcaaaagaacctatgtccgcatggatgcagctcgctcttagcatcataaagctgatctctaattttgtggctttagacaatagagcaaaggttctaactacgcaatgtttagtaatacttacttgtagcctactggttgtaatagtatttcttttacttgcgttattcgtagtacaccttttgtttttttaaaacaaaagaagcttattcaactatatttagctgaataagctggtctcaatgttaaatcaagtttgttggacgggtttaacattgctttctagtgctattttagttagctctagtatgcttcaagctagttacaacgtcctaaggttgtaactagtttttttatattttttaattacctataggtaattttatcagaattgatacaaaatgtaaaacataaaagaaatataattttattgcactttaatagccaatatagtattcgtatttatggtatcctgctgcagcttctacatagaaagagaagcgttcaacaccaacctcatttatcaaacgctggccataaccccaaatctcttctgatagctgatcaaaggttatatactttagctcatattgctggataatgttcattctaatcgaccccatttattatcctggtaaaattcgatatgacgtatttcgtcgtagtgaactttgttttttccaacgtagatccccagctcatcactacctaagatcttgctaacaatatcttctggatagtatccttcagcgtttcgttcttctttttgaatacatactgatctattttttatgactgcagcgttcaatacttccgcaacctcttcagtcgtcatttgttcttttgccaaattttgattggctcgttgttcattgtcggcatcaattttttcagtatgatcagataaataaaaacctgcccactttaaacgtccacgatcattataatcaatcatttttaagccctcctgcgccgcctgcatgtccaccaaccaatgtacttctagtaatactacgagcgccttctaacatagaagaagcatgtacaatcgacgtaaaaccatatttttgccgaatcttgtcaataattttatctaaattttcttcgtcaatttgcttttgtggatcactaaataaatccagctgaagcgaatcagtgtacacaagcttgctataggttattccaacgtgccttacttcttgtccttcataatacttatcaaacaagaaaagacagtaattctgcaattcctttgtattatctgttatagggatcttcatctggtgtgaaaaacctggtctcgtttctaagatcgacgtgccaatgtataaatggacacaacctgttttacagttatgttgcctgatacgaatagctacttgttccgccatttcttttaccaccagttcgatttcatttctcctggtataatctcgtggtaacacttgtgaattaccatatgatttttcctttgtcggttctggtgggatcgctatatctgttcgatcgatcccgttcgcatgaaaatacagctgtaagccaatcacacctaaatggctcttaatagtgtatggattccaattagctaagtctttaatactcatgataccaatttggttgagtctttttttcattcgagatccaataccccaaaggtctgtcatttcaggaatattccatactttatcaggaacattttgatacgtccattcagcaaggaatccatcattatgttttgcttcattgtctaaagcaagtttagctaataagggattatctccgacacctactgtagcaagcaatcctagctcttctttaatattctcctggatcatttgagccagcttctttctccgttgacttcttgttccttcagtcgtaaaaagattcattgatctggtcacttttaagatcgattcatcgatcgagtaaatagtcttttttatttttttaacgggaagtagctcagcttggtagagcacttggtttgggaccaaggggtcgcaggttcgaatcctgtcttcccgattttttttatcttgctttttgttttcaaatgatttataatttttttaaattgaatatgcgcccatagctcaactggatagagtgtttgactacggatcaaaaggttaggggttcgactcctcttgggcgcgtcgatacggaatagtatattccgtatttttttttgttgattctaaaggatttatttaacaaaaagcgttcttctttctttctattaccaaattcgttataattaaggtcaatattagtcaaagggaatgaataagatggcacatcagaatacctcggatttaattgaatcatatataaagaaaattctggaaaatagtgaaatgatcgagattcgaaggattgaaatggcagacctctttaactgtgttccttcacaaatcaactatgtgattaatacccgttttaccatccaacgtggttatctagtagaaagcaaacgtggtggtggtggttatatacgaattgcaaaagtaaggatttcagataaaaaacaattacttgagcagataaatcagttatttgatgatacaatcagtgagaaaaatgcttttgctattattcaaaaactttatgaagaccaaataattacaaaaaaagaaggaaacttgatgttgagtgcaattgcaaaaaacacattgaatttcaatgaatatgaagatcatacacgtgctcggattctccgagcatttctggaacgtttaagttatgaagatgggaagtgagattagatggaagaactttttactgaaagagcccaagcagtattagaaattgcacaagaagaagcaaaacgattgaaacatcaatcagttagttcagaacatgttttactagccttagtggtcgagcaaaatggaattgctggaaaagtattacgtgaaatggatttgaatgaaacggaaatttatgaagaaattgaacatctgattggttatggtggtatccgttcttaccctaaaggagtctttcttccatattcaccaagaatgaaacaagtttttgctttagctagcagcgaagtgaagaaaactggttctcaaaaagttggaacagaacatattttgatgagcttattaaaagatgaaagtatcatggctactcgaatcatgatcaacttaggtatcagcctttcaaaagcccgtcaagttctgaaacaaaaaatggggctagctggtgattctgctggaaaaggaatgaatcgtcgtagaaatgtaaatgtacaagataaacggcaaacaccgcaaggaacacctacgctagattcattagcacgtgatttgacgaaattagcaaaagaaaacaagctggacccagttgttggtcgttcgagagaagtgaaacggcttatccagattcttagccgacggacaaagaataaccctgtactggtgggtgaacctggtgtaggcaaaacagccattgctgaagggttagctcaaaaaatcattttaggtgaagtgccagaagacatgcaagaaaagcgcctgatgatgcttgatatgggatctttggttgctggtacgaaatatcgcggtgaatttgaagatcgaatgaaaaaggtcatcgacgaaatctataatgatggtcaagtaatcttattcattgatgaattgcataccttaattggtgcaggtggagcagaaggagcaattgatgcttcgaatatcttgaaaccggcgttagctcgaggagaattacaaacgatcggagcaacgaccctagatgaatatcaaaaatatatcgaaaaagattctgcattagagcgacgttttgctcgcattcaagtagatgagccaactcctgaagaagcagaagtgattcttcaaggattacgtacaagatatgaagagcaccatggagtggagatcacagatgaagctgtacgagcagcagtcaatctttctgttcgttatatcacttctcgtcaactacccgataaagcaattgatttgatcgatgaatcagcagcgaaagtccgtttggatcaaaccgatcacttaacaaaatcaactgtgatcaaactagaaatcgatgaactagtacaagaaaaggaagcagcgatccaaaaacaagactttgaaaatgctgctcaattacgcagacaagaaaaagcactacgtaaaaagctgcaaaaagtttctgcaattgaagcaaaacaggagcaaggttattctgatcgtgtaacagaagaagatgttgctacagttgtatcggagtggactggtgtccctctacagcagttggagaaaaaagaaagcgaacgcttgttagaactggaaggacttctgcatgaacgtgtcgttggtcaagatgaggctgtcaaagcagtttcacgtgcgatccgccgtgcacgaagcggattgaaagatcctgatcgtccaattggttcattcatgttccttggaccaactggtgtcggaaaaacagaattggccaaagcactttcagaagtcatgtttgggagcgaagatgccctgatccgtgttgatatgtcagaatttatggaaaaatacagtacaagccgattaatcgggtctcctccaggatacgtagggtatgatgaaggtggacagttgacagaaaaaattcgtcaaaaaccatattcagtgattctcttagatgaagtggagaaagcacatccagacgttttcaatttacttttgcaagtattggatgatggtcatttaacagattctaaaggtagaaaagtggactttagaaatacaatcatgattatgacttcaaatatcggagcgacacaaattcgagaagaaaaaaatgtcggattcaatgtccaagatgttactaaagatcacaaagccatgcaaaaacgtatcttagaagagttaaagaaagctttccgacctgaattcttgaatcgaatcgatgagactgtcgtcttccattcattgagtaaagatgaaatccatacaatcgtccaaatcatgagcaaagcgattatcaaacgattgaaagaacaagatattcaagtgaaaatcacaccatctgcaatcgatgtgatcgggaaagctggatttgatcctgaatatggtgcacgtccaatccgtcgcgcacttcaaaaagaaattgaagatcgattgagcgaggctttgcttggcggagaaattcgtttaggtgaccacgtaacagtaggtgcttcaaaaggtaagatcacattgaatgttcgcggacctaaaaaggaaacagtaggttccctatagttacttggcctgtgtagctgaatttttataatagtaagacttgattaagaggttgtgacaagatttttgtcacaatctctttttatatttggacagaatatatcgaactttattttgattttttgtgaaataattttcaaaaatccgactttaaatagaagaagtattggaaagtttttagagctatgctactattatgaagttgtaggaggagaaaattatgatcgaactcataaccacagtagaaactattgaacaagcagaacagttgcttgctgcaggtgcagatacactatatttcggtgaagagcaatttggattgcgtctgcctgcttcatttacacgagaagaacagcgacaattggtagaattagcacacaagtatggtaaaaaagcgaatattgctgtaaatgggatcattcatcctgaaaaaatgaaaaatgtacctgaatatttggcttttttaaaagaaataaacgtagatgtgatcacagttggtgatacaggtattatttatacgatgaaaaaaaatcctgaattgcgtataccgtatatttatgatgctgaaacattagtaacgagcgcacgtcaaatcaatttctgggcgaaaaaaggcgcagttggagcagtacttgctcgtgaagttccttttgaagagatgaaggcgatggaagaaaaactcgatattcctgtagaaacccttgtgtatggtgctacatgcatccatcaatccaaacgtccactgctacagaattactataactatacgaaacaagacgaacaaaaagatcgtgaaagaggtctttttatctcggaacctaaaaaagaagagacacattattctatttatgaagatagtcatggcacacatatttttgccagcaatgatctgaatctctcgaatgaattgaatgaactttatcagcatcattactgtacatggaaattggacggattatttactccaggcgaaaaattcgtaaacatcactcgactattcgccgaagcaaaaaaacaaattttagaaggtagctgggatcaagaaaaagcggaaaaaatgactagcgaaatcagtaaattgcatcctgaaaaccgtgaattagatacaggattcttttatattgatccttctgctatcaaataaggagtatgatgaaagaaatgacagtaaaaagaaaattgaaacgaccagaaatcctagcgccagcaggaacactggaaaagttaaaaaccgcgatccattatggagcagatgcagtatatattggcgggaatgcatatggtttaagaagccgtgcaggtaattttacttatgaagaaatggctgaaggagttgcttttgcaaaagaacatgatgcgaaggtatacgttgctgctaatatggtcacccatgaaggaaatgaagatggagcaggggaatttttccgcagtttgcgtgatgtcggtatttctgcagtaattgtttctgatccagctttgatcgaaatttgtgcgacagaagcaccaggtctgccgatccatttatccactcaagcttcagcaactaattttgagacattggaattctggaaagaagaagggttggaacgtgtcgttttagctcgtgaagtttcaatggaggaagtggcagagattcgtaaaaatacggatattgaaatcgaagcatttatccatggtgccatgtgtatctcttattctggtcgatgcacattgtccaaccatatgtcgatgcgggatgcaaaccgtggcggatgttctcaatcttgtcgctggaagtatggattgttcgatatgccttttggtcaagaacgaaacagtttaactgatacaggcgaagtggaagaagaattctcgatgagtgcagtggatatgtcaatgatcgaacatattccagaattgattgaaaacggcgtagacagcttcaagatcgaaggaagaatgaaatcgatccattatgtatctacggtgtcaaatgtctataaagcggctgtagacagttatatggaagatcctgaaaactatgtctgcaagcaagaatggatcgacgagttatggaaagtagcacaacgagaattagctacaggtttttactacaatacaccaactgaaaacgaacaattattcggtgaacgtcgtaaaatcccagtatataaatttgtcggtgaagtattatcttatgatgaggcaacacagattgctacgatacgtcagagaaacttgttttctgtaggagatgaaatcgaattttatggtccaggattcagtcatttcagtcaaaccgttgaagttatgcataatgaagaaggcgaatccattgaccgagcaccaaatccaatgatgattttaactatgccagtcgcacagccggtgaaacctggagatatgatccgaaaacgtaaataaggaaaaagctgatatatccctgttttaagcatcttcgcatacaaaatccaagaaaagtgttacacttgttttctgtagaaaaaggatcgttaaataaaggttttgattgatctcttcaataaggaggaacaaaatgcaaatatatgattacatcgtaattggtggcggctctggcggtattgcttcagcaaacagagcagggatgcatggcgcaaaagttttgctgattgaagcgaatgaattgggcggaacatgtgtcaacgtcggttgtgtacctaaaaaagttatgtggcaagcaagtacgattttggaaacaattgaacgagatgcctcaagttacggtatccaagcagatttaaaaaatgttgatttcgccggtctagtagaaagacgagaaaaatatattgattttctacacggtgcttatcaaagaggattagatagcaatcatgtcgaggctataaaaggttacgctacttttatcgatagtcaaacgatcgaagtaaacggtgaaacctatcgtgctcctaaaatcttgatcgctactggaggccgtgcaagtaaaatgaccattcctggtggagaatacgcaattgattcaaatggattttttgaattaacagagttacctaagagagcaatcgttttaggtgcgggatacattgcggctgaactttcaggtgtgtttcgtggtttaggtagtgaagtcatgtgggcatatcgaaaagaaagaccacttagaacgtttgataaaatgctttcggacaatttgatccaaatgtaccaagaagctggaataaaaacttacgcacatcatattgctaaagaaattactaaaaacaatgacgaatatacggtgctatttgaaaatggtgaaaccttaactggtgattgtgtactttttgccggtggacgtgtaccgaataccgaaaaattaggtctggaaaatacaaatgtggaattggacaaaaaagggtttatcaaagtagataaataccaaaatacaacggatgaacatatttttgctgttggtgatgtgatcggtaaattagatctgactcctgttgcaatcgcagctggtagacgtttatcagaacgtttatttaatggaaagaaagattcttatcttgactataaacttgttccgacagtcgtctttacgcatccaccaattgcaacaattggtttgacagaagaagaagcattggaaaaatatggcgaaaatgaattgaaagtttatcgttcacgctttaccccaatgtactttgcattaaatgattatcgccaaaaatgcgaaatgaaattgatctgtgtcggaaaagaagaaagaatcgtcggcttacatgctattggtgttggtgtcgatgagatgctgcaaggttttgctgtggctatcaagatgggtgcaactaaagaagactttgacaatacagtagccatccatccaacaggagcggaagaattcgtaacgatgcgataatttaatattaacagttccaacagctttttattgaacaaaccatgtaaaaccagaaaatcagtatactgattttctggttttttgttttttagttatttatgtaagattgcttcgataattctcaaaacgaaataagtagggaagttggagattttgattatctttgtaactgacgaagagtaaatgaatccatttggtatgcactcttaagttcaaaattttaaaagaaatagaaatgtatcgaagaacagatgattaaaaaagtgtgactttgtataaataaattagaagaagcaaacgaggatgttaaaagaataccatatagttaccaaaccaagaaagttctcgtcaagttcgctggtacgaatcaaatcaagtgaaaaaagggactgtgacaaaagttgtgtcataggtagtcactttttccgaacaaatggtgttctcctgccaactcccaatcacaagacacaatattcataaaacatgagaagctgttttttgaacttgttccttgcgactcggagctaaacggcagactcacgacctctttcttaaatggtgttcaatcagctgtccttcggtattagctcaaaaacggcaaaatatgaggtaaaactaatataaagcttggtacgattctgtttgtaagacatacgaatagtatcagaggtaggagccaagctgcctgatattaaattatcgataaagtagaaaggttaagcattagccgctgcaataactaatgctaggagacagcaacgtgtaaccattaccgcacgtgtttctgaatggtggtagcgaccgatttgaacggctagggcggaaatacggtgcaaatgcacggtggtttcatgcaatgcttacagggcgtattttgtaagggtatgtaacggagataatcccgacggtaatggatgtgagaggccaagccgacgctgacggtagggcaaacaaacatagttgcactctagcgatcgttatttatttttaacggtcaaactagggtacaactatgcttaaaacacttcgcctcaacttctggtagcaaaagtgattttgaaagtcaaaatattttttatgagttatttacaattctaaaaaacaagtgtattaatctactaatttgagacttgtactattttattgttttcgtgtttaatgtattgataaactttgtttgtaactaaacagtcttctaaagcatcgtgtgaattattatctaaattgagataatcttttaaagttattagtttgtgattcagagtttcgaaatgtcttcgtgctaaaggtaaagtatcaattacacggattcgttgatttaattcaatattattttcatttaattgatgcagcaaaaactttaaatcaaaaggtgcgttatgagcgacaagagtataacaactaatgaacgacattagctgaggtgaaaagtcttcaaatgtgggcatatttacgacatcttctaattctaatccagttatcttagttattcttttagagatgtttgatctaaatggtttaatattttgatatatgcgatcaatttcttcgtttgattcatattttatagcaccaatttggagaatttcgctatccaacggacttaatccagtggtttcgaaatctattacgacgtaatcatcaaccagtttacgagctttaatgtaagttggactctttttatctgctttttttgatttcgagggaggggtaggaccggttatatttactgattttttaatcaaatcatcaatatctattttgttttcgataacgttttctttatcagggttttgaatagtagcatcttcatttttttctatcgtttgttctttgatgatttctttcattttatgagaaaaactcaagaaaagaattcctaccacgacagaaaatccacctgataaaaaatctccacttgctatgattccaccaaataaacctataaatacaagaaaagcgcctattgaaagtaataatattcgtacaatattttcatttttcatccccatctctgatataataatatacacagtctcggaaatgagaaccctagccgcagctccaactgcgaatggggtattttttataggtcaaaacttacttttaccgctttacccaaaattcttgctggattattttcatcaatgatataaggatgataatcattattatcgggcattagcattacaacatcattaacatgtttaactcttttgagagtcgcttcagagtcgccgtttactataactggtgcaatttctccatcttccacaactggttgtcttcgaatcaacacgtaactatcagaagggattgtaggaaccatgctattacctctgatttttaaataaaagacttcaccagtgggcaagttttcgtctatctcttctctatattcttcaatattttcttcagctaaaataggatctccacaagcaatttcttccaaaacaggaatctgtctatattttttaacaggtattaaatttttcggtatctcgccataccgcggatcaatcgtagacttcaatacgccaaaataatctgctatgtcgttaaaggcagcgcgcgttaatgctggattcactagcaaagaagccgctaaagctgctgatgtgcattttcaaacgttgtccaaatatgaaatagatagttctgatattccattttctcttttaaaagagctgtctaatctgtatcaagttcctattaacaatttttttttgagcaaagagtacgctttaatccgtatcataaataataaaagaaatgaggtaatgaattgaacgaagtttcaaaggacgttctggcaatcgaagcccacgaaaaagcaaagtcttagtctgatacgcttaacacttctttactattgtttaaacaaaatatcctaattatttctaattgattctataagcactttacttagcgatacataaaaattgtgatacaattcagtcatagttttaaaggatattatggtcactaagttacacatataaatttttatggaggtgtggtaatatggcaaatttctacggaaatgatccttttttcaacaatgatatggatgatgttttcaatcaattatttcggcgcatggataatcaaaattcggggcgtgcacggtatttagttaatggacaatcgttgacaccggatgagtttgctcaataccgagcaactggtaagctaccccaaaataataaaacaatagaagtatctaaagatggtaaacaggctgttaaaaaaggagggattttagaaaagttagggactaatttgacggaacaggctcgtgatggattactagatccagtgattggacgtgagaaagagattcaagaaactgcagaaattttgagtcgtagaacgaaaaataatgcaatcttagttggtgatgccggtgtaggtaaaactgcagtcgtcgaaggtctggcacaagcaattgtggctggtaaagttccagaaacgattcaagataaagaaatctattcgattgatttatcttctttggaagcgggaactcaatatcgcggttcttttgaagaaaatattaaacagctggtagaggaagttaaagcagctggtaatattattctattcttcgatgaaattcatcagattctcggcacgggtgccactggtggtgaagatggtggcaaaggattggctgatatcattaaacctgctttgtcacgtggcgagctgagtgtaatcggggctacgactcaagatgaatatcgcaatactattttgaaaaatgcggctttggcacggcgattcaatgatgttgtgattaatgaaccgacggccgctgacactttacgtatattacaaggtgttaaagagctgtacgaaaaacatcatcatgttgtattaccagatgatgttttgaaggcggctgtggattattcaatccaatatataccacaacgcactttgccagataaagctatcgatttgatcgacatgactgcggctcatttagcggctaaaaattcgcaaactgatgttgagacattggatcaacgccttaaaaaattagaggcagctaaggaggccgccattaaagcggaggactttacaaaagccgctgatatcaagaagtcgatcgaggaaaccaagcaaaaaattaaagaaacggatcaaaaagaaaaaatcactgccacgattgatgatgtggcacaatcggttgaacgtttaactggtataccagtttctgatatgggcgctaatgatattgagcgcttgaaaaatcttgataagcgtctgaaaagtaaggtaatcggtcaagatgaagcggttgaaatggtagcaaaagcaattcggcgtaaccgtgcgggcttttcagagggtgatcagccgattggaagttttctgtttgtgggcccaactggcgtaggaaagactgaattagctaagcaattagccttagatatgtttggaaatgaaaatgcgattattcggctagatatgagtgaatatgctgatcgtacagctgtgtcgaaattaattggtacctcggctggatacgtaggctatgaagataatgctaatactctaaccgaacgggttcggcgtaatccatattccattgtattattagatgaaattgaaaaggctcatccacaagtattaacgttactgttacaagtgatggatgatgggcgcttaacggatggacaaggcaatgtcattaatttcaaaaatacgattattattgctacttctaatgctggctttggtaatgaatcattaagtggtgacgagcaacgagatcagtcattaatggataagttagcaccatttttccgcccagaatttctgaaccgttttaatggaatcgtggaattttcacatctgactaagcaagacttaagtcaaattgtcgatttgatgttggcggatgtacaaaaaactttagccaaaaaatccatcaaacttgaggtaactaaagcggccaaagattggctgatggaacaaggctatgatgaagcaatgggtgcgcggccattacggcgagtaattgaacaacaaattcgtgataaggtaacagatttctaccttgaccacttagatgtcaaaaacttgaaggctgatttagtggatgatgagattgtgatatcggcagcttagcttaaatcagtgttcataaataactttatataagaggagatttattgggaaggagattgcttgataaatctccttttttcgttgattttcaccatttgatattaatctattgagtaatatgggtagcgtcaagaatcttgtgtaaatgaaatgcctccgtacatataatatgtagttaatttaaataaaggatgattctagggtgtcctgaagtcctttgaatccgcgatggattcgcttcatggacttctcgttgtagacattaaactgagaaaccaggaatcgatccagtgaatcttccgttggaaattgttctttgtggttggtgttgcgtttgagatgcttgttaaagttctcaatcaagttggttgaatacaatgaaccgcgaatagctggtgggaaatccatgaaagtgagcagattcggcattttaagcagatttttgattaacttgggataggtctgataccagttgttggcgaagtcattcaattttcgtacctggcatgacatttagtgggacttctgaacgaaatgaagttgattactgatgaatataactaggaaatgacgcaattgattggggatatggaccttgaagatgccaaaattagcatagaagatctaagtgtttatacgaacgatgatcaaacctatttcgtcgtttttgatctcaaatatgaaggattggattcaaatcaagtccttgtttatgtagcatccgatcacgtcagttattccaatataatcgatcattatgagctaatcgcaacaaataccaaattaaaaaagtggaatagatgatggctattttcgaaaaagtctcttactttatttctatcgatcatcggtaaagtatcgtcggtcggtcacaaatcaagtcaaacacctggaacgggtgacgagcaatgaatttgatcaattcaaaaataaagtagcttttgaaaagctgcagcgtgaaatcgaacaagcaaaaatgagtcaagagtcagacctattcaattaggagaaagaggaaagtcatggaaaattattactttatcaatagcgtggatccagagaaccaaatgatgcgtattcaagaagtgggtgctggcgaaatgagtgcgcaacaggtacgtatcacgaaagaggatgccgatgtttattctttaatgttggatgaagcaacgcaagaaggggagccgctgatcgttcagctggatctaaaataaagtcaaaatcagccgtagaaaaaattttttcgaccagtacaaataaaaaccgattttctttttttagaaagtcggcttttaataacgaagctaatttagttgaagtagttgctcaataatcgaagagctgcctggtaaaaataaaagtagactacctatgactaacaagatccctaaaacaaaacaggctattacgaatttggttgatctagatacttctttatttgaaacacttatgatcaacaaagttataccgacagctaacgttaaaaaataccaaaatcccattgttatcgcccactttctttgaatagtttttactttcaaactgtttaataaattttatcatagacaagaagaactaatccttgtacaagaaaaatatatgtaaagtttaaactttcttatactatataggttgaattaaatactttacatccgcacgcacagtcggtcaatcactaccaagccaggtaaaagcaaaggggctatttttgcgtatcgctcaaaatcaagcatgattggcggacgtggcgttgttctgacttccgaagaagcgattcatgaaaacaaagatacatttacgcattggacacccaacgtttatcgttatggaacatatgcagacgaaaatcgctcatatactaaagggcattctgaaaataatttaagacaaatcaatacattctttattgattttgatattcacacggcaaaagaaactatttcagcaagtgatattttaacaacagctattgatttaggttttatgcctactatgattatcaaatctgataaaggttatcaagcatattttgttttagaaactccagtctatgtgacttcaaaatcagaatttaaatctgtcaaagcagccaaaataatctcgcaaaatatccgagaatattttggaaagtctttgccagttgatctaacgtgcaatcattttgggactgctcgcataccaagaacggacaatgtagaattttttgatcccaattaccgttattctttcaaagaatggcaagattggtctttcaaacaaacagataataagggctttactcgttcaagtctaacggttttaagcggtacaaaaggcaaaaaacaagtagatgaatcctgatttaatctcttattgcacgaaacgaaatttttaggagaaaagggtttagtagggcgcaatagcgttatgtttaccctctctttagcttactttagttcaggctattcaatcgaaacgtgcgaatataatatgtttgagtttaataatcgattagatcaacccttagaagaaaaagaagtaatcaaaattgttagaagtgcctattcagaaaactatcaaggggctaatagggaatacattaccattctttgcaaagcttgggtatcaagtgatttaaccagtaaagatttatttgtccgtcaagggtggtttaaattcaagaaaaaaagaagcgaacgtcaacgtgttcatttgtcagaatggaaaaaagatttaatggcttatattagcgaaaaaagcgatgtatacaagccttatttggtgacgactaaaaaagagattagagaaacgctaggcattcctgagcggacattagataaattgctgaaggtactgaaagcccatgggcctcacctcgcaagggaaaagacagccaccgcccttaaaacttcctgcgtaatccattatacaggtgaattaagtgttgaccaagcacaataaaaattaagtcatggggtttcataggatcctaaatttgatcaaattaagaatcagcaaaacatcttttgtagataccctttttttagttcttggagtttttcaagcttacgctgatgaagggtaatagtgtcatcaagttgtttgaagaaggtaccgattttttgttgttcttcaatacttggtactgagataggcatcttagccatttgtttacctgatacttctataaatgtcgatccagcaccatttatttcaccgtaacgttttaattcagaagttcgagaaaatataaaatagctattaagcaagtctttgtatggaacaattgattgaaagccttgattagtacacccttcttttgcaagaatagcagtgtttccaatacctgcacgtgatgtaaagagcactgttcccactggtaatatatgagctgaacttttttgtaaaccaagtccagtgatctttttttgactttcatcgatataaatctggttaccgatttcaacgggtgagtaccaatcaatatcaccgttccagtattcagaaacattagtgcttggagttccaccaccgataatatctgcgacttctcccaacttacgctgttcccaagcgtcagcaaaccctgcaaatcttaattgtgggaacttgctaccatttttagggaacagtttctgcaaatagccatgtttaagttccttaagcttagctaacttacgctgatgaagaacgttactgaagaaatctcgccaaattccacgcgggcatcatcatttaaaccgattttaaagtgaccgtcttctgaacgggctttccagaaatagcgcgaatcatcaattttatcagccatgtttatcatcctttcctgcgtatatacgctactttctattatcggacttatattggaaatttgatagtaggagataattaatttttacaaagcgtgggccagatagttgccttcggtgcatgtttccagtcgataataatcgtaataaaaaacaaacaggactgaacaaaattactttcgtctcagcccctcatagtgacactattaatattatcgaatatccaacggttgcttactcgtcggctttggaaaggccttgtcgatttttgccaaatcatcctcatttaaggttaaagaagcggcctttacgttgtcaactgcatgcttagggtcgccggattgtgggatagccaaggtactgccatcgcgaattgcccaagccaataaaatttgccaaggggttgcctggtgggcctcggcgacttctttaacggccggattattaattagctgaccgcgttcgtcaccggcagctaccggggtgtaggcgattagcggaatcccctgttttcgctgccatggtaatagactgtattcgatccctcgactaccgaggttatagagatcttcgtttgcggcaacctgatcaccgcctgggagggcaagcagttctttcatatcggggaggtcaaagttggaaacaccccaatgtttgatcttaccttgctgctgcaaggactgaagcgtttcgacggtttcacttaacggcacagcaccacgccaatgatatagatataaatccacgtaatcggttcccagtaactttaagctggtatccaagctgtgggacattctgtcggcggaagcgtttgaaggcagtaccttatcaatcaggaacaatttttcccggtcaatattggcaatggcttcaccaaccagactttcactacggccgttaccgtacatttccgcggtatcgatcacggttgcgccggcgtcaataccagcttgaatggctttgatttcctttgcgcgggttgcagttgaattgcccatgtgccaagtaccaagcccgattgccggcaccgttttgtcgccaagatgtaattctctcataaaaatgaaacctcctattagtagaagtccgtttttcagcataaaatcactttgccaaaaaacgtgtatgaaaatatcgtacttgttttcattataggagtcttggcttagttgcgcaaatagttcctacgcgtatttttcaatttgattaaaagcctggttaagttcgaccgtggcttttaatcaaattgaattaagggtaacccattaatcaatagggttacgtcaaaacggcgatcaggattgacatcttgagtaccagctaaccgtggtcgcactgcatgccgtaccacttcataactagatttaccgccagcaacgtccgctttccaaaataacttgagcgtcaccgtgcccagcttagcatcatcacgttcaccttccactttgccaatgccattttcggcggctagtaacttagctgcttcgtaaggtgtcgggacctcaatcgcccgtttaacctgattaaattcggtatcagttaaagggtgtccctgcaatttagcatagttattgttatttaatttatcacgaaaattagcccataattgattcggcgtcgcaccatacaggtcttttcgttccacccattgattacttccggtcgttaaggttttaacaacttctttttcaaatgacagttccaacataaaaacattccttctcccacctttaaattactcactagtttattatacgcgaaacgattggcaaataggtttcataatttgttaatagggtagattgtaaaagtggccgtaacgttctacatcagcattttaatgaaaccgtacctttcaaagtattacataccgatgttacacaagtatgcttggccgatactaagtgggcttacgtttcagctattactgacgaagcaagcaaggaagttttagcatttcaagtaagtaatagtcctaacagtaaactaattatggatacactcgatgaactcacagaaaatattccggaaggaataaaaccaataattcattcagatcaaggttggcattatcaattgaattactataccgataaactctctgaaaaaaatttatacaaagcatgtctcgtaagggaaactgtcttgataatgcgccaattgaaagcttctttcatcttcttaaaacagaatgtcttaatggatttccacagtgtaaagatattggagaattcaaggaaatcacaaagaattacgtcgattgatttaacaatcgacgaatatcacagaaaacaaaaggcatgactccctgcgaatacagggaacatgccttagcagtttaaaaatattcaattttgtctaacttttgtgttgcactttacggctcatgctgttttagactcttttttatgcaattttgtcttagtttttaataatttaatgcgctttaaagtagttttttatgatttgctttttattaatttgctggctttaatgaaatctcgttgtatccagaatgagattagcagtgccaatagatcaatcaaaataaaggcagctaatgtcaaagtataattgtggaacagttgatgtgttaatgataatagtaatggtccaacaactccggcagcagcccatgctgtcagtacatatccatgaatagctcctaattctttagtaccaaagacatcacctaagtaggctgggatgacagaaaagcctgctccataacaagacatcaacaagcataatgcaatgacaaataggagcggtaatttgaagatgagcatggctgaaagcattacaatatcgagaataaaaatggcactaaaagtagcagggcgcccgatataatcagacaaagttgcccatatcaaacgtccaaagccattgaaaaggcctatgattccaaccataattgcggctgtttggacagacatgccggtcatactttgagccatgggggatgcagctgagacaaggccgatcccgcatgtaatattgataaagaacattatccaaagaaaagtgaaggatttagttttgagggcttggttagctgttagctccggtcctcgggttagacgtgttccctttttttgagaaatgctattttcagtagtgcttgatagtgccagatttggacgaacaataaactgtgcagcgagcagcataataacaaaataaaatgttcctaagagatagaatgtttgttcaagaccaacactagccattagctgttgagcaacaggaccagtcagcattgctgcaaaaccaaatcccataatagctaaccccgttgctaaaccgcgtttgtctggaaaccatttaataattgttgatacaggggtaacgtatcctgctcccagtcctaagccgcctatgacaccatatgagagatataatagccaaattgaattttgatggatagcccaaccagtcataatggttccagttccgtaaagaaagctagcaatagttcccgttagtctagggcctattttttcaacgactttgcccataaaggcggctgacattcccaagaagaaaatagcgatactaaatgcaagagcgactgaggattctgcccaaccattttgttttgcaattggattagtaaaaacactccaagcataaacggaaccaatcattaaatgaaacatgacacctgcaaacgcaacaacatagcgatttgttttcaacaccaattcctccatttttggtagtatacgaacaatttaaacgttgttcacaaccattgttggcatataataataatatcacatttattatcacgtttaaacaattaaattttagtataagacgaattttaacgttggctaatgaaaagtacatttaagttagctatagtactgggaaaaaacaaattacggttgctgtttttgaacaaataaaaaagcacagggaacctaaagtgctccataattgttagacaagaaatctaacagttatggagcactttaaacccatcttttaggagctgatcttttgtctagtataacctattccgaacgaattaaaatcgaaaccttttgtgaactagggctgtccaatatccaaatgggcgttcggctgaaccgatcaccgtcaacaatttcttatgaattatctcgatgtcaaccatatcaggctgaattagcacaaacagatgccgaatacaagcgatcacgatgtggtcggaaaactaagctgagcgatgagttaaagcaaaaaattctcaaccatttacgtctaagctggtcaccaggaatgattgctcacgaatttaaactagcgactaaatcaatttataattggttaaatcaagggaaaattgagttttctttaaatgatttgcctgaacatggcgtgcgccaacggcgtaaccttgaccaccgttctaaatataatcaatcattaggacggtcagacggtcaattgaacagcgacccatcgtggttaatcgacgtaatcgcatcggtgattttgaattagatacaattgttggcccccgtgggcatagtaaggcagttttattaaccttaatcgatcgcaaattacgtttcctttgggcctaccgattaaaaaaccggacagcagtaactgttaatgaagccctaaataagtttctagcaacttttaatggcccggtgcatagttttacggtggaccgtggcactgagtttagcggtctagtatcacttgaagcacaatacggtattaagacctattactgccatgcttatacgccagctgagcgcggcagtaatgaacgctttaatcggaatttacactatttttatcctaaggggacttattttgagcacattagtgctcaagatttaacgacgatgttactccaaattaaccagcgaccgcttaaaatactcgactggcaaacgccgtatcaggttatgctgacaaatttgtccaaaaattcggattaaatttgcaatctaccttatgaataaaataaaaggctagtcactaaccaaaaattggtcagtaactaggcttttattaattagtatattttagaaatataagttcagtttaattgcgcaatgagggtttaaaaacgtctatataaaaatcccccgtgttactaacacgaggaataagttactttaacggtaacagtttaaaaatttattttaaaagaggtaaactcatcaagctataggtttgaatgcttatcaatatcaacattataaagctgataggaaggcatcattaaatgctgggatatcctttggttcgcgactggtaattagattaccatcgatcacaacagctttgtcttcaatgcgtgcaccggcataatacaaatcagtttgtacagttaaatatgctgtcattgtacgaccttgcactaacccggtttgaatcattaattgtggcccgtggcaaatacttgctgttaacttattagttgctaaaaagaacttagtaaattcgacaaaccgttggtctgcacgtaattgatctggtgaaaatcctcctgggatgaacaatgcatcaaagtcttgaggactcacttcatcaatggatttatcaatgttaatctgagtaccatgcttaccttcaacagtgcctttttcaaaactgatcgttgtcactttgtgtcctgcagacttaagagcctctacaggttcagtatattcaacgtcttcgactagattagtcaccaaaactgcaactgattttgccataatcaaattcctccttgatttatagtatataatatatacctataaataatataccacaataaggcacttttttgtgctatcatgatctttagaaaaatttggttccgaaaagagttttgttgaaaaaaatcgggcgccacaattgagcaacgtctagtttttcaagaagcattaaattttgttcgagaagaagatacgttcatggtagaagcaattgatcgtttgggaagaaattatgatgaggttattcagactgtaaattatctaaagcaaaaaaatgtaaaaaggggacaaaaataaagaaggttcgtaaacataaatgaagtcttaagttatgaaactaattgcgtaggaaaaggttattattagtacaaacttaggtgtcttatacccagcatcagcgacaacacaattgatttcaggaaaaagtctcttcgattgtttgacgagctgaaaggcgacttgactgtcatgaatatttccaggagtgatgattgtgctaagaataaatccattgtcgtcgcatgaagtatgggcagaataagcaaattgtttttctcgttcgcctttgacgtagtagccgctttccggatcagctttacttatttttctttctttcagcttcacttccttttctaagtccaaagtaaaagggcgttttccagcctctattcgttgacgattgatctcatcttctaattcatcctgataggctttcgcttcatcatgggtcatttctttcgtaaacttatgtttattggcgttagctttgatgtgggtagaatccagatacaaattatcctctgttacaaaacctgctttaactgcttgttctaaaatataggcaaaaatatcctcaaacaccgtcgtttctctaaatcggcgaacataattctttccaaaagttgagaaatggggtattttctcctcgaaggagtagcctaaaaaccagcggtaagcgacattggtatcgacttccttaatggtttgtcgcatggaacggataccgaataaatactgaataaacaccaatttgatcagaatcactggatcgatacttgggcgacctaaatcggagtaagtggcttcgacgattggataaataaattcaaaatcaagcgcggcatcaatctttcgaacgagatgatcttgaggaactagatcatcaatcgtaagcatcgcaaattgatttctaccattcgtattgtttttagacatcatagctatcactccttgcattcgttttcataaatctattataaaagaaaagactgtagacatcatccataaaatggactttgtctacagtctggcattttattatataaaattgttataaaaaattttttttgaaaaatagtattgcaaaataaagcaatttcatagataataggtatcgtaaagttatataactttataatacctattagagtgagggataaagaaatgagacaactacacaaagaacagattgaaacagcaatggcagcgttaaaggaaaagacaattgatcatgtatattttacagcatgtgggggttcacaagccgttttaatggctggtcaatatctatttgataaagaattaactgtaccttgtcatgtttatactgctaacgaatttaactatgctataccaaaaggattatctgaaaattctttagttatcacttgttcccattctggcacaacaccagaaactgtagaagcaacaaaaaaagcaagagaatttggagcaatgactatttgtttatctaatgaagaaggatctcctctatgggaagcagctgaatatcctgttcactatgattggggtaaagatgttgatgctagtgatttaaataaaggaattctttatggtttattatttaatattttacttgttttagatggctctaaaaaatgggaaacttgcttgaatgaatttgataagttaaatgatcttgttattgctgaaaagagcaaatttgaaataactgctaaagaatggggtaaaaaccaaaaacgagataaaattatttacacaattggtagcggtattaattacggagaaatttactccacagcagcttgctggttcatggaaatgcaatggattaattctaatgctattcattctggggaatttttccatggtccttttgaaatcactgattatgatgtaccattcatcttagtgaaaagtattggagatacaagatttttagatcaacgggtagaagacttcactaaaaaattcagtaataaattaatggttttagaccaagctgattttgacttagaatctatagatagtgtagcgaaagaatatattgcagctgtacttagtggcgttgttattcgccaaatggtagaagcgattgcttttgaaagaggccattccttagatgttagacgctatatgtggcaaatgaaatattaattaataggaggttgcaaaagatggcaaatcaattatttcacattgtgattacaacacattctaccctttgtgagggttatttaaaggcaacaaaattaattttaatgaatgacgccacaggtattagtgctgttccatttaaagaaaatactagtccagatgattttgaggagagtatgaaagaaataattagtcagcatcatttgcaacctctaattattttaacggatttaattggaggaacacctaataatgtttctattaaacagttgaacaacaatagaattcaaattattgctgggattaatttacctcttttactggagttattaatggcccagtcagctggtaaatctatagaagaaatagattttaaggaattactgaataactctcaaaaaagtatggttcatattaattcgcttttaaaagatgtcagttaaggtggcaatttctattctataaattttaaaaattgaaggaggaaatagaatgattaaattagtgcgtgtagaccacagattacttcatggacaagtaatattttcttggactaaacagtatgatattaaccatattattgtggctgataacaaagttccaggagatccaatgtctgtgatggctttgacaattgctaaacctgctgattgcaaattagacattgttaaaattagtgatgttaaagggattatggaaacatccccaaatgataattacatgattttaattaaaggacctaaggaagcttttgaattagttcaaaatttaccagaaattaaagaaattaattttggcggtgtgtctaagaaaagcgagtccaaacaatatggaaaggcagtctttttaactcctgaagaattagaagccacaaaaaaaattcttgatcaagaagtgaaaatatttgtgcaacaagtcccatcttcaagtattgaaaatgtagattttagtaagtaaggggggaaaataaatgttattaaaagccattttattaggtttagttggtgtggtagctgttattgactccaggttaattggtcgacaaaatattggtagaccactaattttgagtacacttgccggacttgtgctaggtgacttgcatacagggattgttcttggggcatctttagaattaatttctatgggattcgtctcaattggggcggctggacctcctaatatgcaacttggtagtattattgccactgcttttgcaattttaactaatagtagtacagaaacagccttaacaatagctatcccagtggctgtagctggtgaatttatgagtattatcatgcgtatgataattgctcaatttggacatgctgcagataaagccattgaaaataataaatttagaaaagctcaaattattcatatttattggtcatttatttttaatgcttttgtttactttattccaatctttttaacagtatattttggtgctgacgttgtggcagatttagtagataaaattccagaaatgattacagacgccttgactgtctctggaaatatgctttccgcattagggtttgcaatgctattaagcacaatgttgagtaaaaaattatatccttactttatttttggattctttattgttgcctattcaggtctttcactaattggcgtgacaatttttgcagctctgattgcctttgtaatggatcaagttaaatatggaaaaagagaagaggcgcatggttaatggaaaatagtacagaaaaaaaacgtttaatcacaaaaaaagatcttcataagatgtgtcttcgttcatggacaatcatgtgttcgtggaattatgaaagacaaatgcatatgggatttatgtatgggatggcgccaattttaaataaagtttataaaaatgatgaagagaaaaaaagagaagcttatactcgtcatatggcattttttaactgtacgcctcaaatgactccatttattatgggactttgtgcttctatggaagaacaaaatgctcaagcagaagaaggaaactttaatactgaatctatctccatgattaaaaccagtttaatgggtccttttgctggaattggtgattcatttttccaaggtactttaagaattattacatttgggattggattgtcttttgctaagcaaggtagtattttaggaccgattttagctgttggcctttttgctataccttctattttagctgttttttacggcggtaaattaggatatgagtctggcaataaataccttactaaattgtatcaagaaggtcttatggatcgagtaatgcaatttgcttctatcattggtttggctgtagtaggtggaatggtggctagcatggtgccaattgtcacccctttaaaattcactacagggggaacagaacttgttttacaagacttacttgattccattattcctggattattaccacttgtatgtactttgggaatatataaattgattaagaaaaatgttagtacaaatatgctcttattaggttgtattttggcagggtttgttttaagtataataggtatcttataatgattaaggctctaatttttgatatggacggagttttaattgatagcgagattatgtatcaaaagtgggtatttaattttttaaaacaagaaaatttaagctatcctttgtattcttatcaaaaaaagattggaactacagcaagtatttttgatgatatagaaaagtacaatgagggatgtaacagtttagaattgaagggaaaatttactaaatattggaaatcgcaaaagattgattacttggatatttttcctaatatactaattgaacagcttgaatggttaaaaaagaaaaaaataaaaatggcaattgcttcttccagtccaatggatactataaatgaagttgttaccacttgtaaaatagagtcatattttgattgtttaattagcggaagagatttgccagaaagtaaacctaatcctactatattccttaaagcttcagaacagctcagaattccagttgaagaatgtctggtgatagaagattcttataatggtataaaagctggtaaaagagcaaatatgaaggttcttgcaattaaagataaacgtttttctcaagatgtaagtctagcagatgatgttatttacgatattaaatatctgcgacaagaagtacaggtgaaatttggaatataaataagttttttgatgtatttagagaatattagtaaaaataaaaatcatgcccaaatctaatcaaaattgattgctttgggtatgatttcttttaatatcaatctattactttaggatctgaatcatttttatgcaccgtatctaaagtgatattttctgtgacttcaataacataactaattctatcacaacgaactgtggattgagaataatgaaatggttgattatttttatctttgccaaccttttctaaaataaatagcggatctcctactatacattgcaataagtcggaaagctcaggtgttgcagataaaccgtttatttccataatagagctcgtagctttgacatcatagtcatcttctagaagtttatataatgaagtatattggctacctttttcaaataaagttggaaatttttcttctgatgcgaaaaaattatcaattcccatcggggcaccgtcttcccacattaaacgtttaatattgtaaactctatcagttacattgatttgtaatttattagctaaaaactcatcagcctttataattttagaatgtaaaacagtatatctaattttatgtcctcgggtagaaagagaatcgctaaatccatgaactccagctaattttaaactttcttttttttgagttacaaaggtccctttcccccttaatcgttcaactgttccactttctgttaaaagtttaaaagcttttcgaatggtaatcttacttactccataaattttacataattcttcttctgtaggtaattgctctcctggaagatattttttttcacgaatatcgttacgtatagaagcttctacttgtagatataatggtctattatcttgaaaattcatagtacactccctaaaaagttatacttcattatatcacaatttattaaaataaaagattaagatataaatataaatgaactagtctttgactaaccaatgcccgcttttgaaagaaaacaaattcattctgttttaagtaaaaatccttatgttaccactcattctgaaggggatgagccttatcgctacttggttgtggaaccaagcgataagacaattttataaattcaatattaattaaaataaaaacaaacaaagtagattattttactttgtttgtttttttattgggagcgtcaataattttgtgtaaataactcgtccttctgcaaaataatgggttactcagtaaacattgaagctaatgtatccgtcacttgttggaagcctttatggcttctatttaagaatttttgattgtatgtatcaaagatggatactaggaaacgctctagtgattcttcattttgaaactgctcttttctgcggctgtatttcttgatttgtttcttgaaagattcgattaaattagttgagtaaatgcttcggcggataccaggcggaaactcataaaaagtcaataaatcttgattttttatcagtgactgcgtcactttaggataagttttttgctacttctcaatcatactccctaaaaaggtatttgcctcttcctttgagctagcttgataaacagccttaaaatcatcacagatttcttttcgacgattataaagttccaatgccgaacttgttggaaattgtataggtttaattgtttcttttttttcaatatcttccaagtgattgactctagactctaatgctttagctgatttttgaacagctttttgcgcactatctttttgtttagaagatgaaagtcgatctggtttaatatttctttttttatttttttcactaacactactcattttttttgcttgttttcttttttgtgttatcgcttgttctaaacgtgttttttctttttcaactttttcaaatcctcttgcttcctctaactttttctgttctttttgtttcatatagtcactgtaatttccaggatattcagtaacctttccatcttctatttcccatatcttgtttactaactgatttaaaaagtatcgatcatgactaacgagaatcattgtcccataataatagctcaattcatctattaatagttgtatactttttccatctaaatgagttgtaggttcatccattagtaatcccatcttataatttgatagcactctagctaaacgtaatttattttcttcacctccgcttagtacttcgatcgtatttctcggaatagtgaatcgactaataagttcagcgttaagatcatcaaattcgtataaattattggtttcttccatctgtttaaagtaattaaactccacaaatcggttaacttcccctgaatttggtgataactttccttggataagattcagtagcgttgttttcccttgtccgtttcttccgacaatgccaattcgatcattctcatatacagttaaatatttaatggctactagttctttgtttccaaaatttacttctatattttttaattctaaagatatatttttcattattttgcactccttaaattaggccgtgcaatcaacagatttttgggtacacaaaaaagagatagatttctacctcttttgacaatttccatatctatattttcttagataaatagaatttgaaaaatagacagattgctcccctgtttctgccaatataacaggaccttttgaataatagtatttaattattatttcaaaaggttaaaccacaatcttatagatgctgtcattttccaaattctcctttgtacatcctatttgtatactagatactgctcaaatgaacacgtatctttctaccaacgtctcataaagcttaaaacatttttttcaaatagtcaagttatgctcacctattataggtcaagataacttataataggtgatatgaaaaaaaatactcttgctcctttttcgccattcaaggtaacttcaatataacatgaaattcacatggcgttttttagttagcggtggctaacttcattatataatccaccgtaaaaaatattattagttacatttgtcattatagtcttaacttaagagttgtggcattgcttattacatatgtaataagcaatgcgttttgtgaagtagtacacttaaattaacgggcaggttagtgacattagaaaactgactgtaaaaagtacagtcggcattgtctcatattataaaagccagtcattaggcctatctgacaattcctgaatagagttcataaacaatcctgcatgataaccatcacaaacagaatgatgtacctgtaaagatagcggtaaatatattgaattacctttattaatgaattttcctgctgtaataatgggtagaaggtaattactattattattgacatttaagttaaacccagtaaatgaagtccatggaataatagaaagagaaaaagcattttcaggtataggtgttttgggaaacaatttccccgaaccattatatttctctacatcagaaaggtataaatcataaaactctttgaagtcattctttacaggagtccaaataccagagaatgttttagatacactatcaaaaattgtataaagtggctctaacttatcccaataacctaactctccgtcgctattgtaaccagttctaaaagctgtatttgagtttatcacccttgtcactaagaaaataaatgcagggtaaaatttatatccttcttgttttatgtttcggtataaaacactaatatcaatttctgtggttatactaaaagtcgtttgttggttcaaataatgattaaatatctcttttctcttccaattgtctaaatcaattttattaaagttcatttgatatgcctcctaaatttttatctaaagtgaatttaggaggctgacttgtctgctttcttcattagaatcaatccttttttaaaagtcagtattattgtaacataaatatacgccgattgtaaaattaagctagacaaataaaaaagccattcgtggtacactcaaaatgtatttccgaccaaagaaaacataggagtgatcacgaatgacctacacccatcttaccacggatgaattagtgatgatagagtcttattatcaccaaaatattaaagtcgctaaaattgctgagttcttgaaacgatctcgaacacccatttataatgtcattcatttcttgaaagaaggccatacggccctcgattactaccaacaatataaagaaaataagaaacggtgtggcagacagaaaatcatcttaccaaaagaacaacagacctatatcaaggaaaaagtaaatcaaggctggactcctgatgtcattattggacgaaaagaaatgatcatcagctgttctatgcggactctttaccgccagtttaaagaaaaagtcttcgatgaagctacacttcctatgaaagggaaaagaaaacccaatggtcatcaagaacgcagaggaaaacaagccttcaaacggaatattgttgaaagaaagaccgattatcctgacttcgaagaagagttcggtcatatcgaaggcgacactattgtgggggctcatcacaagagcgccatcattaccttggtagaacgtctttctaaggttattattactttgaagcccgatgggcggagagccagcgatattgaagctaccatggatcattggtttaatgccattccaaggcatttatttaaatcgatcacttttgactgcggaaaagaattctctaactggaaagctttaagtaaccaacacgacgttgccatctattttgctgacccaggaacaccttcgcaacgtggtctgaatgaacattccaacggtctcttgcgaaaagacggattgcctaaggcgatggatttcaatctggtggaccaaagtttcatttcttctgttgcagacaaacgaaacaacatccctagaaaaatattgaattaccaaacgcccttggaagtatttatgagttacatgaataaagatattttgtctagcttaatttgacaaatcaaaaaattaaaaaagggataaaaaatatgaagatcgaatgacttatcatgtaatcatgaataatttgaagtaagaggagctaatcaagaagatatctgaagaaaaagatgtggcaagagatactgtgtataagattaagaaataatttgagataaaggaataaaaagaaattattacttttattgtaaccaaggaataaattaaataattaaatttataatattaaaataactatcgtatagaattcataaggaataatcactataatatgagtaagagtattataatcattttatggagggattgtctttttgaagaataaattggtttcatatgcaataatgactgtaaataatcgatataacagagattattattctctttttataccatttgttgcagaaacaattagattaaaagaatttaaatacataacaccgcagataataaaaaaagaaattcaagaaaaatatgacttagaaattccaactgctgtaataaatcaaatatttaataaactcgacaaagaaaaacttattgaaagaaaatattatgcggatcagaagaaatacttatatcatcctaattacgaattaatagatacatctaaatataacatgagtcagactacagaatttgaagataaatatgatgatttaatactagaatattgtagttatattcaattagagcataagataacaaaagattcagctgaagctgagaatgatatttacagttttattgaataaaatgaaattgaatttttaaatgaaatagataaaagagaccctgattatcaattttatgtttctcctaaagaggaaattaaatccttttacctagttgcaagttttattaatcattcgaaaaagaacaataataaaatttatagcttcctcttagatatcgttaaaggaaacatgttaaaggatgttctttttttttgatggtatagacgcattacaagaaaattttaaaaagactagaatttattttgatacttcgtttatgttatacgctttaggcttttcgggtaaagaaaggcaagttccatgtttggaattaatagatatgttaagaaaaaatgaagctcaattatattgttttaatcataatgtagatgaaatgacaaatatattaacatggacgaaacacaatttgtacaaaggtagagatgggcatgatactataaaattttttattgattcaggttacgctccagaagatatcgatataatgatacattctattcctcaaaagttattagaagaattaaatataaatatagattcagaagaatatactgatagtagaatttctaccgaattatatgaatattttactgatgaagcgggattagctgacgtattaagagatagtctaaattataggaaagattcttttgaacaagctttaaataatgatgtaaaaacagttagcatgattcttagaatgaggagtggatataaaactttaaacattgaagattctaaagctttatttgtaacaactaacaagacatttgcaaaaacagtcagagattttatgaaatcaacagaagttaattatatccctcctgtattgtacgatagtatgttaaccaatttagtttggttaaaggaccctggtttggctcctgattttccacagaaaaggttaattgctaattgttatgctgcaataacacctacagaaagattttggaaaaagtacctagatgaaagcgaaaaactttttaataaggaaaaaattattacaaaagaagatttgataattttaaggtatgctagcttagctgaaaaaataataatggacgaaaccaagggcgatgcagaattgatcgattcagagacagtagagggcgtattgcttaaaattgaagaattaaaaaagaaagaactggatgaacaagctaaaaaacataaagatgaaatacttaatttaaaaatggaaaacgagcgtaaagataaacttattaataatattaaaaaggaagagagtgaaagaaaagaaaataaagcagaaaaaatagctaatttaataattacaatagaaatattggttttagctaccattattggggtaatatccttttatgcactagataaagtaaatgtctctaataatgttcactggatatttagtctgatttctgggccgttcctagcagtactaggatttttaggaaatcattttaaaatatttgacttaaacccctatttagaattacaaaagaaaaaaataaaagtctttttatataagtcataaattaatactaacaaacttaaaccagtaatataagtaatggcaaagtattcccactattgttaattttgataaagatatagaaaaatacacttccattactgaacaaaatagttcatagttttgggagtgtattttttgagagaactttttgtgccagcctctttgctcattactatattaaaatgaaaattttttaaactttaatacttcttttaatcatctcagcttgtctctgtagacctcgcttttctaattcttttacaaatattggccaaggtgggatgttgcttttgtaaggtgttggaccgctgtaagctcctcctcctggaccagtatacaaaccgccaccagggccagtgtatagtccaccgccagggccagtatacaaaccgccaccagggccagtgtataatccaccgccaggtccggtatataaaccgccaccagggccagtgtataatccaccgccaggtccagtatacaaaccgccaccaggtccagtatatgctccaccaccaggtccggtatacagcccaccgtccggtccagtatataatccaccaccaggaccagaatattgatttctattccacattttttaacctccaaactatatataaataaagtttttattaactattttgaattactttatttttttccaattgtttccagattcagatgttggcggcaaacgatctcccttgtcaatattaacgatacggggatcatttacttttcctcctctaggaccaacttccttatactttccagcaggtttattatcttctccgggattatacattttagtaataaagaacagttagaagttaaaaatgctgattcacatagagtttatgacttcttggaaattctttttcaatcagttttttcatctgtttatgaaattcttttttttcagtaaacataaaggtttgggtatcgtaaccttcttcatgtaggaaatagattattcctttttctgtgttttgcgtataagcttttatactcctgtcttttttgaaagaacagatcgtatagccatctatttggtctggtagtcgtttgattttcttcaaaatgacttttttatcctcaagtttcatttttttcacctgactttatttttttcatatggaaatcatagcgcctttggttatatgaaaacaagaaggatactgaaatatatataaatcaaatagtggttatttattattagaatagcgaatacaaacaaacgacaactattttctgatttattacaaatgttttttcaaataaatttgattaccaagaaaaggtagtggtatatttactgagggatactttgaaaaacatatggtagaaacagtaacagcattttgaaaaatctttttataaaaatggaggaatcgatttgatggaagatcagtatgtacaagcaatgacgatcgcaggatcagatagcgatggaagcgcagggatgcaagcagatatgcatacattctttacaagaaatgtttacggtgtttctgtcatgaccgcatgtgttgcaggtaattcttacggaatcggagcaagtgtgacattgccaacagattttatcgacaaagaatttgaactgattgcaaaggactttcaaatacgtgcagctaaaacaggtatgctagcagattcaaagttgattgagacagttgtaaaaaattaccaaaaatatgattttggaccattagtcgtggatcccgtaatcgtaacgaaacatggaaatcttttactagaagaatctgctttgcaaagcttgaaagaaaagcttgtccctttggccgaagtactgacacctaatttttatgaagcagaaaagctgactggacggacattagcagctgaagaagattttgtgcaagcagcaaaagaactgcaagatatgggtgcaaaaaacgttatgatcaaaggacatcatgctaaagatgcgcagcaagaaacagtcaatgactacgtattgctcgaatcaggaaaatcattttggttaaatgcaccattttatcctaccgaccggatcaacggaactggcgattcgctatctgcatgtattgcagctgagttagcgaaaggaaaaacagttgaacaagcgatccgattggcaaaagactatgtaaaccgtgcaattcgtgaagaaataaatgtagggcacaaatatggacccatcaatcattgggcagctggtgaattagagtaaaagaaagaggtcgtgagcctgccgtccagctccgagtcacaaggaacaagttcaaaaaacagcttctcatgtttgttgaatattgtgacttgtgaccgaggagttggcaggagaacaccgtttgttcggaagaagggactgtgacaagatttttgtcacagtccctttaatcttagtatatttttctctacttgaataaaaaattataggattggagaaaataatcgagaaatttgttgcttgaataatagccagttagacatttccttgactgtttcagttgtcatggatgaacaatgtgtctcatcttctttgaactgagtagcaagttcttctaaaaactcaggatcgtaaatgacagcacttgtttcaaaattcaatcggtagctacgaatatcttgatttgctgaacctaccatgcagatttcatcatccattatcaatgtttttgcatggaggaagccgttctcatagacaaggatttgtacattttccttgatcagctgccgagcataatattgtgttgctcgataaataaaaggatgatccggtttgttgggaatcatgattttcacatctacaccagaggcagttgcgatttttaaagcagcaatgacactttcatcaggaacaaggtaaggtgtctgtatccaaacacgttttttagcagaagtaatcaatttgataaatgaaagcttgatttgttccctttcgttattcggtccgcttgaaacaagctggatggatgtatcagcaagcttagattcatctcgatctgcttttttaaagaaataattcaaatgatagccgacctttttttcttcaggtaccgagacgttccagtctgttaagaagcgaagctggagcaaagaagaagcggcaccgaaaatccgtatatgcgtatcgcgccaatagccgaatttttttgttgtatttacatattgattggcaatattgaaaccaccggtataactaatctttccatcgatcacaacgatttttcggtgatcatggtaattcaatcggaaacgaagtaatgccttttgtgaggtaacaaatgtatggacatgtccaccatttttgattagacgattgaaatcttttgcttttgtgccatgagagccaaatgcatcatataatattcgaacttccacgccttctgcggctttttcttctaaaacatgtaagacttgctggccgatattatctgtcacaaatgcgtaatattcgatatggatcgaatgtttggctttttttagatcttgaagcagtgaatccaatttctcttgtccgtctgtgagaagagtgacagaattcattcttgtcagcggcatacgatttaatgaagagaagaagtcaacaaattgctgtttgtctttatcgcccatgtcaggatcgtaatgttcaatggtatcccctctaaaagactgaaagttttctaattctttcaagtcactttgtcggagatagaattttttcttatccgttaatccacgtccgaaaaataaatataatacaaaacccaccccaggaagggcaaacaatactaagagccatgcccaaatggctgctacatctcggggtttgatcaaaatagccaccaaagcaataagtgcatttaatagataaagggcggttataatactagataccacaaaaatgttcctccttacatacaataacattagtatagcatgatagaagaaagaagcctaccaaggtgaatatacttttcactcctttcatgaaaatgtaggtaaatcgggctaaagtagttgctttttgtaggttaataaggtaggatattagtacagttgaatatctccttaggggagtaaccggcaacgtttgttgcgataatatcaacagtaagttaaccaaatggttttctggtattgtatgaaatggtgagacctaagacaaatgcgtatttgtcttaggtctcttttttttcagacaggactagggccaagatcaaaaaatgggggatgaaatttggaaaacaaggaacaagcacaacaagcggtctataaagaaacgatcgactcgttgatgcagcaaacgcagagctcaaccgatggattgagcaccacgcaagcgaaggaaaaattagaaagagatggcttgaaccagctaaaagaaaagccgaagaagccaacttggaaattgttcttagaaactttcaaagatgcaatggttatcgtattgctgattgttgcactgattcagatggtcatgggtgactacatcgaattcttagttatttttgcagtattgatgttgaattctataatcagtgttgtccaaacaaaaaaagcagaaggttctttagaagcgttgaaaaacctttcagcgcccgatgctcgagtgattcgtgatggtaaggaaaaaacgattccggcaaacgaacttgtggtaggagatatcgtgttgttagacgcaggcgattatgtacctgctgatggacgtttactagatgcgggatcattaaaagtagatgaaggtatgctgacaggagagtcgacttctgcagaaaaagaagtaacggatatcacaagtacggtaccaatcggagatcgtacaaatatggtattcagtggaacgatcgtaacttacggacgcggtaaattcttagtgacttcaactgggaataatacggagatcggacaagttgctggccttttggaatcaacaactgagcaagtcactccgttacaacgaggtctggataaattcagtaaaaaactaagtttggctattttggcattgtctttattgattttaggtatccaactgtttcgtatttatcttggagaaggtacaggagatatgactgcagatatcgtcagcgcagtgatgtttgccgtagccgtagccgtagctgctattccagaagcattacagtctatcgtaacaatcgtgttatctttgggaacgaataaaatggcgaaacgtcatgccattattcggaagcttccagcagttgaaacacttggttcgacaagtatcatctgtacagataagactggtacattgacacaaaacaaaatgacagttgttgactactttttaggtaatggcgatactggggatttcacaaatgacccttcaaaatggacagctgacgaacgtcgcttgatcgaaatcagtgttttagcgaatgatgcatcgatcagtgaagacggtactaaattgggcgaccctacggaagtagcgtttatcgactttagtgaaaaattaaaccagccttatcaggaaatccgaaacaactacccaagacaagcagaacttcctttcgattctgatcgaaaattaatgtctactggacacacgatcgataacgaaaattacttatttgtcaaaggcggaccagatatcgtcttccaacgcagtaaaaaagtattgctaaatggtgaagtcgttccgatgacggatgaattgatgaaaaaattccaagagcaaaatgaagctttttcaacacgcgcattacgtgtactagcttttgcttaccgtccacttgataattttgatttatcatttgaagatgaagacgatttgatccttgttggtttgcttgctatgatcgatcctccacgtgctgaagtgactcaggcggtaacagaagcaagaagtgcaggaatcaaaacaatcatgattactggtgaccacaaaacaacagctgttgctatcgcaaaacaaatcgggatttttgaagaaggaaacctggctttgaccgggacggaactagatgaattgacagaagatcaactaaacgaagttttagaaaaagtcactgtttatgcacgtgtttcacctgagaataaaattcgtatcgttcgtgcttggcaaaataaaggtcatatctcagctatgacaggtgatggtgtaaatgacgcaccagcattgaaacaagcagacatcggaattgctatgggaacgggtacagatgtggcaaaagatgcagcagcgatggtattgacggatgataactttgcttctattgtcagcgcagtagaagtaggacgtaatgtgtttgataatatcaagaaagctatttcttatctatttgcaggaaatttaggtgcgatcattgcgatcatctttgccttagttgctgactggtccaatccatttacagcattacaactgttgttcatcaatttagtcaatgattcactgccagcaattgcattaggtacagaaaaagctgaacctgctacgatgaaccgcccgccaagagatccaaattcaggaatctttacggacaaaacattgatttctgtaacgtatcgtggtgtgctgattgggattgctgttatctttgctcaatggcttggcatgcagcattcacctgaattcggtgtagccatgtcattttcaacattgatttggtgtcggacattgcaaacattcccagcacgttcaaacacacaaacagctatccaagcagggttcttctctaacagaagtgtcttactagctgtagttgtatgtagcgcgctttactgcttaacaatgatcccaggactgaaagaagtcttctctatcccatcagcatttggattgacagaagtctttacatgtatgggaatcgcacttgtgacaattgttttgatggaaatcactaaattgatcattgtacgagtacaaggaaataaataaaacgaatcaacgaggttgtgagcctgccgtttaattctgagtcacaaggtgcaatttcaacaaacagcttctcatgtttgttgaatattgtgacttgtgaccgaagagttggcaggagaacaccgtttaaggaagaagttgtaaaatcagcattttgagctaatactgagggtcatctgattggacactgtttattcggaaagagggactttgacacgactttggtcacagtccctttttttatttattactttttcttttactcatatgttaatatatctactaagtgacttttttgttctaaattttgtgagctataaataatcgtgccagcattttcttttagtaatttatctaaattttctaaagaagtaattacagctcgcgcattagtttttttcttaacaaattctaaggcagcttccacttttggcaacatacttcctggtgcaaactcaccattatctttgtatttttctaatgtctcaatatcaatttttttcagttctttttgttgcggtgtgttaaaatggacagcaacatttgcaacaccagttaagataatcagttcatttgcatcaatgatttcagcaagtttttcagaagcaaagtctttatctatcacagcttctttacctcttaggccttcaccagtttgaattaccggaataccaccacctcctcctgcaattacaattacatctgaatcaactagcgtttttataacttttgattcaactatatctataggtttaggagaagccactactttacgccatcctcttcctgcatcttctttgaagatagaatcggtcattctcgtttctttttcagcctgttctttcgtcataaatggcccaattggtttagtaggctgtttaaatcctgggtcttcttcagaaacaataacttgagtgaacaatcctactatggatttttctataccacgtttcttcaattcattcgttaacgcctgtgctagccaatatcctatgctgccttgagtcattgcaacattggtatcaagtggcattgctggattcgtttgggttgctccagctttttgttgtaataataagttacctacttgaggcccgttaccatgagtaataagtagcttatagcctttttcaactagagcagctaatgactgagctgtttcaactaaagtcttttgttgtcctgttgccgtaggatcatttgttaatattgcattccctcctaatgccacaactattttctttgtcataacacgttttctcctttagggatttgttgcgtaatacaatgaatgtttcctccacctaataagatttctcgagtataaacacccacaattttacgatcaggatataaggattgcaatgtttcctttgccttttcgtccattggatcatcaaataatggataaataactcctccatttgctgtatagtaatttacataacttgctgccaaacgatctcctttttgacgtggaagtgtaccatttatggtatctactccatgactttctttttcgttaataagtataggcttaggcacatgcaattttgttacatgaatatttcgaccttttgcatctacggagttttccagaatttctaggcattctttagaaatttcatattgtggatcctgcttatcatctgtccaagctaaaacaacttcaccaggcgctacaaaattaacaatattatctacatggccattcgtttcatctaaataaattccgcgctttaaccaaattaccttatcaatatttagatactctcctaaaatattttcaatttgttcttttgatagctgtggattacgtccttttgataataagcactcttctgtggtaattaatgtaccttctccatcaacatggatagatcccccttccaaaacaaaattatctaaacgataacggtccttccattcaatttcacaaattttttgtgcaacttgatcgtcttgatcccaagggaaataaagtccatcttccagcccgccccaagcgttgaatgtccaatccacacctcgaacttttccttgactatttgtaacaaaagtaggaccacaatctcgaacccatgaatcattattagcaatttctaccacccgtatatgttcgggaagcatgtggcgagcattatcatactgatcagaattcacacccattgtaacaggctcaaaattggcaatcgccctagcaacctctgcgaaagctcgctgggctggttttcctccatctcgccaattatcaggacgttgtggccacaacatatatactccttcatgcgccgaaaattctccgggcattctaaaatgatcttttttaggtgaactatcaattgttttcatcagtaagcactcctttatcttttttttcttttgacgaatagtgaatcacgatttcaccaataacaaaggcaaaaattgttccgagcaacacgggtactttagtatttatctctgaagaacttgaatctagaggaactacagaaaaaagtagtgtcgcgattagcaacaacattgggataatcgtcattaattttaacaaccaatttggtccaggaactttaaatggacgaacaacatgagaatcgatttttcttaacttcaagaacgctggaaacatcataatataagaaagtaacaatgctactacatttagtgagaaaaacgcccaaaaaatattctcatttgggataaagggtgcaataataattagaagtgaagcaataataccattagtgacagaagctcctactggcatatcatttttttgactttttttagcgaaaattagaggcatatcatgattttttgcagcatacaaagcgacataatttactcctaaggaccaagaaatcaagtttgctgccagcgtatacatgaagaaaataccgattaatacaacaaaaggattcaatcccccaacaagcaaaataaagctgtcaattaatcctccagaagcagataattgatctgctggtaccgccgctcccattccaaatgcagcaaacaaatagaaaaaggcgatcaaaacaccaccataaataatagcttgtggaatttgttttttagggttatccatttcatttgctagagtagtgaccacttcaaatcctaaaaaattaaacaagataacagataaaaaactaaaattttgaatatctagtttaggtaacaaagctgttccagaaaagttattagccattccttttgttaatgcatgatagatacccaaaacaccaagacatatcatgattgccactttcgcaaatgcagcgatatttaagatccacttactatcactaacagggtaacagctaattatcgtaacaatccagacaaataccaactgcaacataattagtagaggcgtactaaagtttaactgaaaaatttgagttaatacttcttgaaataaaacggcgagactcgccatccaaataggaaaattaatccagtaaaaccaagcgactctagcaccccactttcttccataagcttttttaacccagtcatagatccctccttcgccgtcatatgtcgtaccaagttcagctgatattaatccgtaaggtaagaaaaataatatcaacaataaaccccaccaaaaaaattgcgaagagccgattgcagcagctggtgctgccgactctaccactaagataactacaacggccatcaatactgcatcaaataaacggaatttctttttttctttcattattgtgctcctttcgatgagccttttatgaaaagtacgtgtaaatttttttattctctatgaattagcaaaaaattcacacgtctcttctactgcttaagcaagttcttgctaatctcttcgttctaattgacgtttaggtttcagcatacactgcagttccccatcaaatttttctgctaaagcttgatcggcataatccaaatatggattcaaaaaataaactaataaagcacgcatagctgttaatcgattttctgcttcatctaatacgatagattgttcaccatctagcacttcatctgtaacttcttcaccgcgtgttgctggtaagcagtgcaaaaattttgcatgtggtgaagcttttttcatcaattcattatttacttggtaggttggatagaaaatattcatccgttcttcttcagataattccgcttcatataagccataccatacatccgtatagacaaagtccgcatctttaagagccacattaacatcttctgtgatctgcacacttcctcctgattttttggcattttccttccctatttctaatgcttcttctttaatttggaatccctctggtccgtattgaacaaaatccattcccatttttgttgccataaacatggtagatacacaaacttgcgttgcatctccaacaaaaacaattttacaatcagataatttttttcctttcggtaaatgttcagtcatcgtaataatatcgcctagttcttgcgtaggatggttgtaatcactcatgccattaataactggaattgttgcgttctttgccaacgaaaccactgattcatgacgttcaactcgagccattaatatatctactaaacgtgataatactcgtgcagtatcaccaagactttcatgtcctcctagttgtatttgaccaggtgctaaatattgagcgtgtcctcctaattgttccattgcggtttcaaatgaaacacgggttcgagtggaagactgttcaaaaatcatacctagtgttttatttttaagtagtaatgggtaatgaccatacttaatactttttttgatttttaatcctagtttgattaagtaatcgatttcttcttttgtaaaatcatttgtatcgataaaatctcttttctgcataattaacgctccttcgaaatttttaattgatatgtcttttactcgagtaatatatctgacatatttagaataagcgtctttcgagatttatgaaagcggatttaacactttagaaatcaaagtcatttaaagaaaatttgttacattttatgtaacaagttacactaacaatcttaaattgcttaaagacttaaggatgcaatttaaccgataccattgttttaaaaaacttcttcaaatgttgccatttggtagccaacctttttaacctcattactgttaaaataaaccaaattttcgttatactatgtttcttttatagtaaatatcatttttctcacctaatagtttgtcgtttcgtgtgtgaaagcattccgtaatttttctaaaacaaaaaaggatcttttgtaacacttagttaatgttacaaagaccctttttattttagtctagttcaattgtaatattccgttattgccttactatgaccgtatatgccaatttttcaaatgacaataagatattagtataacctttcctttattctaatttcattggttaaattgaagcttcattttaaaagttgaacaaatttctagttaacaaacacgttgctaatttttagataagaggcattggcaagtagaaaataaatttaagtcacactggcaaatgtaaaaatttttaattgacagtatttagggcaaaaaattcttaagccaaattctgattggtcttgatatttgttcatattagcaaaatgatacctacttatttttgtcttgtaatacaatccttgtatataaccatgtcgtcagtacatagtagatgaaatacaatacgaagaagatcgtaaatggtgcccaaatatttttgtatggattttgcatgaatagaccaaacatttgtaatccgaacaagacatggactacacctaagattcctggtgctaagaataacacacctacttctctacggatcgattgtttaagcaatccgtatagcgaccattgaaagcatttgtgtatattcacgaatacgaaaacttaactgggacaaggtgaaattgttcaactttttcaatgaggtctgttctgatttctttagtaatgataaaaagaaaatgatcacaacatgtaatagcaacacctgcaaaaacttctacagttttaccccattaaaaagataattgtaatcttctacaggataagtcacaggtccaccagaaacttgtttgaaatagatttcaaaactgacttctgtcttgacttcctgctcctcttttttcgctttatgagaaaaagcatggaatgcgctgcatcaggtatcgaggcttagaaaaaaatcaggtgcatacgatgcttgtttttgccgaaatgagtctgaaaaaattggtcacttagcagtgggagcatatgtcttcatattttttattatacaaaaatagacaaaagtatcagtctacactcttagtaaagaggaaactgatacttttgtctacagtatgatatttcttacatctacttttggttgctgtagcaacttttatatcatatcaaagagacaagtgattgtcaactcttttttaaaagtttttttcgatttcgtttttcgaaatctttcagcaactcatttatcataacttatcgtttgttatttgtcaagaaattttttgaagttttttccgatagaatcaagcttcgcaagtggtccttttttaacgactcagttatcttatcatgtcatttctaacatgtcaacaactattttatatattttttaaaatactattttattgctttgctacttaaaacaacagaaatgaatatatcatgtaaatttacacatgtcaatatatttttaactctatatccccacctagatttgaattttgaccacataaattgagcatgtctctatagtagaaaaataaagtcaaaaaaagaacacataacacgcttgatgctaagtgttcgactgttacaactgtatgaaatgctcagtgacttgattaaaacagttaaagtctatttatttaagataagctgttccatcaactgctcattgtatccaataaatagaacttcatcgataataatcaaaggacgtctgaggagattggtatgttgtgtgcataaaaaaatcagttgtttttttcctacacaggaaaggtcaatcgcaatgttgtgaaaagcctcagaccaagtcgcaaatagctgttctgcttgcacttcttcaaaactgcataattcttctgcttcttctgtacttagatcgcgttcttctaggtcaacaaattgataaggcaattgatggtgttctaaccattgtttcgccttcagacttgttacacagtgcgctgatccatagactttcacttccacgaaggctccctccctatgaatttaagatgttattgttttgtaaatagatcagatttctggcaacacatcgaatttcacgagggacaaatgaccggatctcatcttcattaaatccgattagtattcttttttcatcaatcaaaataggtcgtctcaataatgaaggatattctttgaataagacgatcatttgctttaaagttaattcgttaaaatctatgcccagcttttcgtaaattttcgaccgagtggaaataatatcttgaactcctccttcagtcgctgccaagatctttttgatctcactttctgttaacggttcggcaaaaatattcttctcttcaaattcaagttgattcgcttgcaaccatgctcttgcttttctacaggaagtacagctaggcgaagtatatacttttatcattttctcactcttttttaattataatccaattctacagtaatttcttttaaaataccaattattagctaataaaatataaaaaaaatcaaaataactgattatttacgtttgaataatgagaattattctatatattctctattttgataatagtattctcattttcaaaataaataagggaggtgtgacaaaattcttgtcacacctcctttttccgaataaactgtgttccagaaatagcttcttcgaaaataagctgaaatttcacaaaaatttgagaagcaattttcgtacaattccttcttctttcttgaaactgaccacttctgtcacaccctctcttctatcactttccttttttcacacgactcccggtttctttgataaatctcgatactttcaattttcttgaatttttcatttgaggtacacatagatacagacgatttcttgctctagtcatcgcaacataaaatagtcttcgttcttcttctatcgtcgtcactggttctgcttttatttcattaaagtcgattactttcttttctgtcgctccgttataaggcaaacttccttcgttacaaccaatcaaaaagacatttcggtaactaagacctttacttttgtgaatgctctggatacatagtgcatcaagttttccttgtctgtaagcaatcaagcgggtttttaattctttagctgtcgcttgggtttcttgcgataaggcttggagtcttctgaaagtagcatgctgctttacttcttctcgtatccattcttgatcactctggtcgatttccttagctatacgtggcagatgaagatagctttgaacaagcgaatagatttcttgatgctggtctgttttacgcaacgcttcctcaaactctcggatttctgcagatttcgattttaaattggggcttatcgacaaaatataatctgcaacggctatattttgatatttaggagaaaagtattgatcgcattcactttttttcaggtagcagtctgccatcagctgccggagcaattgctggtaggcctgatttttcttttgcagattcagtgctgtttgccaatgaacaattttttgatagaaatgttggaaagacttgataccaaagataccttcatatggactatctgcttccagtacaaaaggaatattcgttttcagcagagattggacaagctgctgcgtttgtgaagctgatcggtataatatgattgattccttatatttcccatttttttgaataaatgtctgaatttgtttgattagccactgactttctgctttagtatcagaaaacaaataggcttccataacgcctgcttctttttgtgctggaatcatcgcctttggtatccgatcatttttattatagctgatcaatctatttgctccttggacaatagctgcccgagaacgataattagttaataagaaaagagttttggtaggatattctttttcaaagttcttgatgtatgctggctctgatcctctgaatccatagatactctgatcatcatctccaacaacaatcaacttgatcctgttttcctttgtcatccgtttcacgatttcccattgaagtggattagtatcttgaaattcatcaatgaatagataatcatatttttggccgatataatgctggatctcctcattctccaaagcgcttttcagattttggagtacatcattgaactctagcaattgctggcttcttttttgttcttggagttccgtgagcaatccatacagtcgttctgatatcggctgtcgtgcattcttatcaatggaatcatatttttctttaactaactgaaccatttcttctactgaaaggttcatattctgccaatagtctaaccgagaagcaatcgttttttctccatattgatcaaatatataaagattatatttacgtatcagctgttgcaaaacagcattcactttttgtgcagtatcctttgaaaagtctccttgtattccttgcattgctacttcaggaaattttcgacaaatttcattgtatatcctaaaaaagatactatggaatgttccgatatggacagcggtttttctctggctgaaattatctactcgtttttttagttcatttgcagcgttccttgtaaaagtgatcattagtatgcgttcttcgtctacttgtttttgcgtcatcagataaacagcttttgcacagattgtttgcgttttgccgctcccagctcctgctatgattcgaagatgtttcttcatatcatatgtgatagctgctttttgttcttgattgaagcgattataggaacgtttctccatcattttaaagaaagagctgtttccttcactttcttttacttgtacttcttcctcaataagtccgggtgcttcgccataagccgcttcataggtagcaatgatttcttcttgtagccgaaagacttgttgaagctttttatacttgttctcccagcgtttcaattctttttgtaatcggagaatttctttttcattcaactgattgatttccttcccatctttcttctttgaatttgtttatttcaagttggttatttaaagtttcgttgtctattttttctttatactaacagacctttctaaaaatgaaaatgggaagcgatatgattttagttttctgaaaatttttcctttttttcaatcgtttatgctaagataaggaagacaaaaatattcataaaaggtgatgaaaaaaatgcagacttcctttcacgaggggcgtacaataggacttttgctgacatttatcggaggagccatggacagttatacttatatccaatatggtgcttttgcctctgctcaaactggcaatatcattctatcgatcatccaagcatttgacggagaatggctaagtgttggtaaaaaagtattgtctacccttttctttttcttagggattcttctaacaaagtatgtcatatcctccattttttgtgccattttatccaaaggtaatttgacaaattcgtcatagtaattttgagccatatttttttctcctttttagttctctaatttggttaaccaatattcgttttcataagtttccatgttttcttgataatgcagttcatatcctgctatcttcactaggtcttcaaatagcatagtcggtgcatcctctactaaaggggtttctatcgtccagtaccgcggaataagtaaagcttctgctactttttcagaaatgacttctttgtccaccaaaatttgaacgacttcttttacagtcaataatttgtgttgtgttttcatcagcgtttctttcctttctcatcaatcaaaatataatcgccataagacaaggtatattttttcccgcatgttggacattgatacaaacgatagcttttgatacatttcgctctttctccacaatcgcattcgacagtatgtggtgcatgatagtttgggaataattcgctgaagggaacaccccaataatcaaatttctttcgcatgattgattctgcctcctcttaggaaaggttttacttcctttcgttagttctttctttattgatttgtttgccagaatgaatcaacgaaaagcgacaaggacaagggcgtgcagcgtgccatttacccttgtccttgtcgctttttggtgataaaaggcaacttgttgccggtctggcaaatcaataaagagatagcgaacaggaacgaaccttttggtgagaggaagcttttcctattttgtcttacaaagcaagaccccttatcttagtgaacgtgcaacgttcacttcctttcttctcgaacggcggtggcggttggagtgagagaaaggtttttcaattgagaaggcgcttgtgccttcctaaacaggcctttccctttcttcctgtttctatgtaaaacaaaaagagctgcagtcctacattaggattgcagctcttcttttatttatatgcccattgatcgcgtaaaatgatcagggtttctaatttgcattgattcaatgactagttgatttcgtttattgaagtgacctgtcactgaaatagtatacttgccttcttccaaaatcagcaatttatccgctatttctatattggccaccacacaattaatcggttcatgatttgtacgtaatgtaaatcgcacaagcaatggctgtgtcttgattacccgaattttatccaataaaccagtataatgttccatcgcgatcacctcgctaaaattatagcaaaaacagctaaaattgagaatttttattcgattttagatatgctataatgatcaagacagtaaagtttgtgacggtggctatccgattgaaagtgaggtggtgcgtatgtgcgtacttccaaaatcttacagaaaggagaagccttttgcctgttgaaacggcgctaggattaatgattagtttcggttctttgatcgcaacaatcatttttggaatcttagcagttgtaaacaacaatcaaaaaaaataaccgtcagctttagccggtcgacgattatttttcaaaaataatattaagctggtcaccgtcttaaacggtgctgttaggggggttgttagcgcaactcctcttttcgtatccattataacaactttattgatcttttacaatcagaatggtaaatcatcatcactaatatcgattgattgtccgccaaatggattttgtgaagcgttcaatccattgttgttaggcgtagctacatcccgttgttcaaaggtggtagggcttggactgctggacgattgatcagcgtgcgcacggctctctgtcgttgctttactttctaatagttgaaagttatcagctacaacttctgtcacatacacacgttgtccttgttggttatcgtaggttcgggtttgaatccgtccgacaacgccaatcaagctgccttttttagctaatgtcgccatcgtttctgctggtttgcgccaaatcacacagttgacaaaatcggcttctcgattgccgttttgattcgtgaaattacgattaacggctaaggtaaaagtggccactgctgtgccacttgcggtataacgtaaatctggatctttggttaaccgtcctactaaagttacattattaatcatctttatctctccatttcttgattcatttgttgtgatcttttaaactgcctttttctttcttgattttcaattttgatcacacttttcattaggtgatcaatttcgttgactgtatctgcaaatgaaatggaattcgcaaacgtgttaactgagcgatatttttcccactgcttttccaaatagtcgtttcccctgatcttatccatttctctttcataataaaaggataaaggctttgtatctccacgttttgtaaatgtatttcgaacacttttgtataactctttcgtatcaatattttctagtttcggaatggtaaataagtcgtagtaatcttttgctctcgaattatctgtgccaaagctgaacgtagcacttagcttttctgcaataatttgttctgttggataagctggaatctccacttttttatcttcaaacattaattggtgatagtgtgtatctacttcaggataaatagaatctcctgttgtcacgtccattttaaacggtacacgtactttctctaaattagccaccaatttaatttgaaatccaggataaaaatcggcttctcttgtttccttcattccttgaatagagaaaacaatgccttcttttgtgggttttctagttaaatcattaaaaatgctcttcaatttttcttcagttaatttgctatttctaaatgtcgtatcgatatcaattgttgtccttctatcgattccatattttgatcctaataaaaagccgcctttcaaaatgaagtcatttttgtactttgattcagaaatttgttcaattagacgatccatcataaaatgccgttgcactaactgtgcatttaatcctgtactctttgctaaatttcttgtttttgctgcaaattgtgtcggtgtcatctttttcctccatcaatataagctttgcatgtggtatttcatttctttttctacatgtagttttgtcatgtaatctcttaatttacttggatctctcaatgggtcttccatgtactcttttaatgcttctaatttcatttcatattcaatttcatatctcggattccaaatatcacaaagtgtacgctctttatcatacatagtaataggatttccttgaaaggaagttccctctacttttcctagttcataaacttctttcttcacgaaatgaaattgtaactgctgctcttttgtaattgaacgatcaacgttatagccatggggaaaagtcaagtgaatgaatttcggcatattcgtagaaagctggtaaatatctaaagtcgtttcatgagagaagattcccctggaaaatcgttgctgaagccaaaataaatcatctattccatgaccatcctctacataataaccacgatcaactttgatcaattttccttgattcaccaatctttgtacagtggttgctgcgattcctaattttctggcttccttcatagataaatttccatcgcgaatagccaacaattctttcagtttctcgatatattcgaagaaaagaacaattccctaatgaagaatctctctagagattcttagcttcgcaattcaactaatataaccagaaatttttaagtagagttcacaaaagatttaaagaaattcaagatacattagagtcgatgatttaactgtaattaacagaatggattttccatttacacataattcttgacgctacctcataataattaagagctttaaaattagtatttattagatacttaaaagctattttagtattgataaattgttaccagcaacaaaaaagaagttacttagtgctaacttttgagcaactgctagaggaggtaggatatggctaattatcctgtaatttttattgtattttctagaaatgtaattattctcttaaacattccagcaaatccaagtatatagaaaatttacgttttctgtatagttggatttgaattatagctatttgtaatttacttcaattatttcgctatagcagctaataacactataaagacacatacagcaactccttaaatgggtttcgtatgtgtctttatagtgttgatcacttcatattttagttggtcaaaatccttatcatatgtagcaatatataccactaaatttacagcatctttttgatcaatagctaaaagctgtccattgattttcaaaaagacaaaagtagctaagaaagcagtacgtttatttgcattatgaaaaggatgtttctttatcaattgtataagtaggatagctgctttttcataaatcgaaggataaacctcttcaccaaaagctgaggctcgaagttgtcctacacacatttctaaagcattcgcgtcctttacaccaatgggttcattaggagagtatttttttatttggatcacattcatttttataacatctttggcttctaggtaatgaacactcatttatcgacaagctctctaaaagtagtatcatattcagttaatgcttgagatattgctacatcgatctcatcagataaggtttgtttttttgtaattgctgctcgaagtttttcttcatctaaaaaaaccgtatctccaggatttaacccattttctttaagaaactcctttgaaatagttaatactactgaattccctacttctctgaattttctttctttgattgccatagtcttctccccttttttgtttgtatatacagtatatacgcttattgattttaaatcaatcgtagtccctctcatgtctaactctatagaaagattgttctttctatagaattaagaaaaaccaaaaaaatttttagaatacaaactgctatcccctcgcctatttatatataccatttattttatatgattatatagaaccttatataatttgtgttttccaaaaaaaatatagcataccaattgacaaacgtccctataattggtatagtccaattgtagagatactcctctctcctacttattgaaaggatgaatgacatgaaaaatacagaaatatatcaaaaaatagatacaatcatacttcatatgcccgattatataaaagattttgttcaagatcgtgaagataaagatcaatcacctcgaaccactttagaatatctaaaaaattataagctcttttatgaatggcttctgagtgagtctatcgttcctgatacttcaatcacctcgataagacatttaactgcctatgacctaaacttgtacaaatctcatttgaaacgtcgcgcaaaagaaaatgtaaaaaaagatacaacaaaagctaagctcgaagataataataacttaggcctatccacttctactatcaatagaaatataacagcattgaaagttctatttaaatatctttcgaaaagttccaataatcctctaggaaaaccatacttagacgataatcctatggaccaggtagcaactatcacagataaaacaactttagcagctcgtgcaaatgccattgagaaaaaattatttctagacgaagatacacaaaattatctagattatattgccaatgaatataaaaatactttgagcaaacgagctctgatctattaccatcgagatgtagaaagagacctggcgatcaatgcactgattttaggatctggattgagactctccgaggttgtaaatattaacttagatgatctatctttggataagaataatgtggtagtaactagaaaaggaaataagagagatgcggtcaatatagcagcgttcgcaatggaatatttagctaattatctagctattcggaaagaaagatataaagtgacagaaaacgaaaaagcattatttctagcaatttaccaaggagaagccaaacgtatatccggtattgcaatcgaacggatggtagcaaaatattcgaaaggattcagagtccaagtcagtccgcataaactgcgtcatacattggctactagactctaccaacagacgaattctttggtattgactgcccaacaattgggacattcaagtaccaatacaacgactttatatacccatatagacaatgcggctacaattgatgcattgaattcattataaaaaaaagtccaactacaaatagatttcgtagttggttttttttatctctaatcatgcaaagattaaatacctaatttaaatccttttaaggaagcaccgatttcatcttctgtaattccaatatatcttttagtaatcgattgagaactatgattaaaaataaacattaaggtagcaatgtctctagtttttttgtagtagtgatacccaaaagtttttcttaatgtatgtgttcctatatcatctcttcctaatttttccgctatatccgcatatatctgatagacacgatcccttgttatatgtcgaccttgttgccgacttggaaacaaccaatcattttcttctttgccttcagtatataataaaatctcttctctcaaattatctatgaaaatcggttttcgcttacctgttttacgttcaacaataataggcttacttttacctcgtatatctccaacttttaatcctataatatctgacatacgtaaaccattattgattccaaacaaaaataaaaaactatctctttccggattacttgttcttcttagccaaaactgaaaatcttgtatctcttcatttgtccttaacggttgtacattatagctcactattgtttcccttcttaaaaatattctgagttcatgattatatatatactttaccataatcataaacttatatacatactctgttcaaagtcaagaaaatcaagggatttagtttatgattttatatcatttcagtaactcagaatattccgacttttttgtacaaaaaaattaaccttacttatatgaagattctaagctcttatttaaattttagacgggcagttatccgtagaagttcttagaatagctaatttacataattaaattatatgaaatttaagtttgaacaatatactaagaactccccttactataaagtgaaataaattagcatatgaataaccgtgctaccaagcttttcattaataaaatatttttattaatattttataactttacgcaagatcataattttgagagttttgagactactatatgcgtttttttgttgatttaccaacatgtttagacattttcctctaggaaaaaattaactagcaccacgggttattattagttataaatattaaagggatcgtgttgcactttaaatgaggtgatctttttgaatcttttaagaaattatagctgctaatgcagcaccagtccgagagtttttatcgtttaggctatcttttggatgaccttcaaaacaaacttgaccgccgaatttaccagcatcgggtcccatatcgactaaccaatcggctcgcgaaattaatttcagattatgttcaatcagaattaatgtattgcccttatcaaccaatccttcaaataaatcgatcaattgttgagtatcctgtaagtgcaatccggttgttggttcatctaagaaatagattcggccggtatgattcaattccattgctaacttaacacgttgcacttcaccaccagataaagtggtcatcgactggctaagattcaaataaccaagtccaacttggtggagtagactaacctttttgtagatatctggcacatctttgaaaaactctaaagtgtcgttgatagaaagatttagaacctcagaaatatctttgccatgataagtgtattgtagtgcttcttggctataacgtttcccatgacacaactcacattcttgaacgattggatccatgaatgccatctcggtgatcatcacacctttacctttgcaacggggacaagcacctttaccgttataactaaatagttgtgttgaaacgccattgttggctttactgaaaagctttcgtagaggatttaaaatgttcaagtaagttgcaggtgtagaacgaatattcaaacctacagaatcctgactcaaatcaatatagtcttgatcagaaacttgttgtttgaaagcttggactaaagtactttttccagaacctgctggtccagatatcacggtcattacaccttgagggattctggtagatacgtcttttaaattatgagaagttacatgattaacatttagccaagattgaggttcacgaggctttgggaaagtgattttttctcgtaacattttacccgtaatcgtatctgaccgtaatagttcgtcgtaggtaccagtgaaagttacttgaccaccatttttgccggcttgtggtcccatttccacgacataatctgctgtcgaaataatggcagggttgtgatcaactaggataatggtattgccatgttccttgagcttttttaaggattgggtaattaatttaatatcgtgaggatggagtcctacacttggttcatcgagtacgtaaactaaatcggatagggaactcgtcaaatatttggcaattttaattcgttgagcttctccaccagatagagtatcagttccacggccaagagaaagataacctaaaccgatgtcgaccaaagcttgaattttactatatagttcacgcaccattgttttagccttggggtccgagatattatccaaaaattttaggacacttactaaatccatatcgctgacttctgcaatatttttgccagcaattttaacagttagagcctttttgttcagacgtgttccatgacatactgggcaaggttttcgagtgacaatctttgataaggcagcttcatgatgacgacctgaggcactatgaataacagagcgaagcatacgtggaactagtccttcgtataatgccgtacggccccaatttgccggtggattttttaatttttgttgcggagcgtgcatgaataaatcatattcttcatcggtgtagtctttaatttttttgtctaaatcaaataatccactgttgccatattccttccaacgccaagttcccggttgaaaaccgggaaaagtcattgcaccttcattgagtgatttattaggatcaattaattgacgttcatctatgtcgtcaacaaagcctaatccctgacattttggacacattccctgaggtaggttaaaggaaaaccattcagaatacccaacccaaggctgtccaattcgagaaaacatcaaacgtaagacggaatagatgccggtgtaggttgccagagtagatcgagaattacgaccaataggcttctgttcaaccacaattgccactggtaagttgtcgattcggttcacttcaggttgaccgtatttaggcaaatattgttgggtgaaactaggaaaagtttcattcaattcacgtcgggaaacagcgactaatgtatcaaaaactaaagaggacttaccagacccagaaagaccagcaaatacagtcgttttatgcttaggaatatctaaactgacatcctttaagttattttcttgagctccatggatagagatagtcccatctgcaaataaatcagtcataaaaacctccaacagtaaatttataattccattatatattgaaatctcgtttaacaaaaatactaggccctaatttaaaaagccattgataatggatcaaaaacggccactagggtataccctgttggacctaaaatgttattctatatggacataaatgaataactgataaagaaataataaacttagcaaaaaataaagatattacaaaaataaataattgaacctatatagtaagagtacctaaactcaattagatactcttacaaaaaaatataatggcacttattacaactcaaagtcccgaccatgctttgggagtttttacttcagcaagtaactccaataaaacttttggtgtggaaaagccgtttctaatagtgaacccactaattgcaggttgaaattctttcttataatcataataaaattcacctttagcagcactatcttttactttttctaaaatttcacatagatttttatcttttttaatttctggggtggctaatgcagtttcagttaattctagaattttgttgaaaaatttattatttttcataataggatattaatgtcccatacctgccaagccagaagcccagccactaataacaattcctgcaatattttctttagcttctccccagttaacccagcacttactattattacaataaataccattatcatatgaacgcgtagctgcatcaacttttgtaccaaaattcgtcacaactaatccaaactttccaataagagttaaactaaataatttttttctaataaatcaatacctccttttttctaaaataattataaataattttcagaaaaatttgataattatatcataaaaagtttttttgaaagcataattgcaataaaaaatcattattaaaactaatcccatttttattctaatccaaaacactaaaatacaagaaaaaaactagaatgtatattactattactcagtttaattctttcactaatttctctattgggaagtttgtatttttgatatcaacaattttgtggatttgggttctatttagagtaaatatcatttttgtttggtgattaaggagtttattaaaattaattttccctacttcaaatgcaaggtaacaagatatagcacttttaggaggaatatttagcggtacagcttcagagtatattctattatcatcgactgatcctcctttagcaattaatttcttaaatggagtagctgaccatctgcggtttaagttagcggatgaaagttctaaattaactaacatagcaggttctgttgaatagttagaaatgattacttttgtataaatcatatctgcagcgaagtaagaagcattaagttcaacttctagttgagggcgcattccttttatttttatccctgttaaaaacgtactcaatataaaacttattattgacatccactgaaaaattgttaagtgaaaaaaattcaaaataaacaccaccagtttttaactaaattataccaaaaaggagagaagaaatgattttaccagataagtattatcaagtcattaaatggacggttttaacagttttaccagctgcatctgttttagtagccacgttaggaaaagcgtatggatggaatggaacagataggacagtactcactatcaatgcagtagcaacatttttaggcgttatcactggcgtgtcggcttataatttgaaaaaataggaggaaacaaatgaaaaagaaaatgactattactgtgatgagcctgttaacggctctttttttattgccaattaatgggtttgcctatacgatcaacaatgaatttaatttgggcgcaaatgaaggtagctcacaagtagcaaataatcagtacattttgctgcatgaaacggctaatgaaacagcaacaggacgcaatgaagcgcagtatatgcaacgttcatggactagcgcttatactgcttatattgtgggagacggtggaattgtctatcaagtcggacaacctggttatgtgcagtatggggctggttcatatgctaatgccaatagtcctgtgcagattgagttacaacacacacatgataaagcaacttttgaaaaaaactataaagcatacgttgaattggctagagattcagcaaagaaatatggtattccattaacattggacactccttataaccaaccgggaatcaaatcgcatttatgggtaacacaaaacatctggggcgatcatacagatccttatggttatctttctgaaatgggcgtaagtaaagaaaaattagcatatgatttagctcatggatttaccgatgaaaatccgacaacttcagatgataaaccagtcattgatccaactagagcaggtgcagcaaatcctacgctgacagatggaacaaattacgcccacattgatcagtttggggaaatcgaaaacgcaaacttgcatgtggctggatggcacattgctaactataaatacgagtatattttcattatggactacaatactgggaaagaattagctcgagtaagagctgatggaatttatagaccagatgtaaaccaagcttataatacttctggaaatgttggttatcatgtatctttcaatatgcgtaattttcctaataagaaagtctatgtaatgatgcgggcaacgaatgatccagaagggaacactaaaggcggagcacaagattttcatgataaacgctggtatttaaatattccgcaacgataaaaaatggcccctcgttgaggggcagtacatataattaggctacatctgcaattttagttattgttataaagacggctaagatgtaaaattaacatatatttataacaaatgatcggagaagcggctgttggaagaattacatttattttttgatgattcaggcgtcttgcataggaatgcacctaatagattttttgtctacgctggatacgcattcattggcaaggataataaagaaattgcaaaaagaaaatataaaaaagtggttcaacgaatccaaaccaaacgaggtaacagagaagaattaaaagcttgttatttagataaaagtgaaaaatacgaattatacagggttttaaaaaacgaacatagtatgggattaacagttgatatcaaaagggtacagtcaaatattttagatcataaaaaatcaatacacagatataaagattatgtattaaaaagactggtcaaagaaaaaattaagttgctgataaatagaggattattgaatccagaggacgacttaaagctatgtatctgtgtggatgagcaagccactgcaagtaatggctattataattttgaggaatcagtatatgaagaactaaaaaatggtgttcataattttaattatggtgtattttatgaacctatttggaaaggtaagttagaaataaatgtgtcttattgcgattctaaacataattatttgatacaagctagtgatatattggcaaacagattatggacatcgttcaagattgataacagagaaatgagaaatataccggaacattcttgtatgaggttgccttaaaaaataagctaaatttttttaagcataactattgcatttagcagatagttactttatgattaacttacaggcgaattaatttcgcactgccgacacaaggaatacgataataattattaagcgtaatgtaagtacgccgtcccttgtgggccacctccaaaaggtggtttttttatttaattttaatcagtattgtatttgtattttcgttctgcaattaactcttctaaatgcttaaatatagttctttatattaaatcgtgttagccttgtgttaccattacattcgtgttatactaaacaagtaatctaatttgaaacgtaatctgagcgatatattcacactataaaaactccttttacaaagtaatattaattgcaacaaaacacgtattatatacgtatcaggaggaaatatatatgaataacggtacagtaaaatggtttaactcagacaaaggttttggatttatcactggagaagatggaaatgacgtatttgcacatttctcagcgatccagggagaaggcttcaagtctttagatgaaggccaagcagttacttatgatattgaagaaggtcaacgtggccctcaagcagtaaatattgtaaaataatgttgaactttaaacacctcatttgaggtgtttttttattttaagctagataccgtaattattgctagcaatttagagtagttcgttactaattaaggagcaaataaaattattataaacaggctgatttgtgagctggatagagttttttaataagttcaattgcttattttcttgatctaacttctatcgctagaagaaggatcaaaacccaaccgtaaggttgataaggttaagtgaataagggcgcacggtggatgccttggcactaggagccgatgaaggacgggactaacaccgatatgctttggggagctgtacgtaagctatgatccagagatttccgaatgggggaacccaacatctttaataggatgttacgattgtgtgaatacatagcacattcgaggtagacgcagagaactgaaacatctaagtacctgcaggaagagaaagaaaattcgattccctgagtagcggcgagcgaaacgggaaaagcccaaaccagcaagcttgcttgttggggttgtaggactccaatatggtagttctttcagatagtcgaatgacttggaaaagtcagtcaaagagggtaaaaaccccgtagacgaaatgtggaagacacctaggaggatcctgagtacggcggaacacgagaaattccgtcggaatccgggaggaccatctcccaaggctaaatactccctagtgaccgatagtgaaccagtaccgtgagggaaaggtgaaaagcaccccggaaggggagtgaaatagaacctgaaaccgtgtgcctacaacaagtcaaagcccgttaatgggtgatggcgtgccttttgtagaatgaaccggcgagttacgattgcatgcgaggttaagttgaagagacggagccgcagcgaaagcgagtctgaatagggcgtttgagtatgtagtcgtagacccgaaaccatgtgatctacccatgtccaggttgaaggtgcggtaaaacgcactggaggaccgaacccacgtacgttgaaaagtgcggggatgaggtgtgggtagcggagaaattccaaacgaacttggagatagctggttctctccgaaatagctttagggctagcctcggaattgagaatgatggaggtagagcactgtttggactaggggcccatctcgggttaccgaattcagataaactccgaatgccattcattcatatccgggagtcagactgtgagtgataagatccatagtcgaaagggaaacagcccagaccaccagctaaggtcccaaaatatatgttaagtggaaaaggatgtggggttgcacagacaactaggatgttggcttagaagcagccaccatttaaagagtgcgtaatagctcactagtcgagtgaccctgcgccgaaaatgtaccggggctaaacatattaccgaagctgtggagtacacctttaggtgtattggtaggagagcgttctaagggcgttgaaggcagatcgtgaggactgctggagcgcttagaagtgagaatgccggtatgagtagcgaaagacaggtgagaatcctgtccaccgaatgactaaggtttcctggggaaggctcgtccgcccagggttagtcgggacctaagccgaggccgacaggcgtaggcgatggataacaggttgatattcctgtacccgttgtttttgtttgagcaatggagggacgcaggaggctaaggaatgcagacgatcggaaatgtctgtccaagcagtaagtctgaagaggagtcaaatgcttcttttcttaaggacaagctgtgatggggagggaaataatagtaccgaagttcctgatgtcacactgccgagaaaagcttctagtgagaaaacagcggcccgtaccgcaaaccgacacaggtagtcgaggagagaatcctaaggtgagcgagagaactctcgttaaggaactcggcaaaatgaccccgtaacttcgggagaaggggtgctgatcatacgatcagccgcagtgaataggcccaagcgactgtttatcaaaaacacaggtctctgcaaaatcgtaagatgaagtataggggctgacgcctgcccggtgctggaaggttaagaggagtgcttagcgcaagcgaaggtacgaattgaagccccagtaaacggcggccgtaactataacggtcctaaggtagcgaaattccttgtcgggtaagttccgacccgcacgaaaggcgtaacgatttgggcactgtctcaacgagagactcggtgaaattttagtacctgtgaagatgcaggttacccgcgacaggacggaaagaccccatggagctttactgtagtttgatattgagtgtctgtaccgcatgtacaggataggtaggagccgtagaaatcggaacgctagtttcgatggaggcgctggtgggatactacccctgcgttatggccactctaacccgcaccactaatcgtggtgggagacagtgtcagatgggcagtttgactggggcggtcgcctcctaaaaggtaacggaggcgcccaaaggttccctcagaatggttggaaatcattcgaagagtgtaaaggcagaagggagcttgactgcgagaccaacaagtcgagcagggacgaaagtcgggcttagtgatccggtggttccgcatggaagggccatcgctcaacggataaaagctaccctggggataacaggcttatctcccccaagagtccacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgttggaaatttgagaggagctgtccttagtacgagaggaccgggatggacttaccgctggtgtaccagttgttctgccaagggcattgctgggtagctatgtagggaagggataaacgctgaaagcatctaagtgtgaagcccacctcaagatgagatttcccatttctttaagaaagtaagatccctgagagatgatcaggtagataggtcaggagtggaagtacagtgatgtatggagcggactgatactaatcgatcgaggacttaaccaataggttaaaagaaaagaactcggaaaaaaacttatgtgacttcaaatccagttttgagtgaacaaaatttactcaataaaagataacaccacagtgtggtggcgatagcgagaaggatacacctgtaaccatgccgaacacagaagttaagcttcttagcgccgattgtagtgaggggttgccccttgtgagagtaggacgtcgccacgctttactcctctatcaacaatctcagagcgagctctactccaatctacccaatatttttgagtattacaataaacaccatttccataataagttgcagcatctactgtaattcctaaagtagatacacttcataaaacaattcctaaaatcataaaaatactaacaaattttttcttcatataattgcctcccttttttataaaacaattatatgtaattttcagaacatttttgcaaaattttcataaatagtatctttagtgtcataatcgtcaccaatattctgtaagatcaatcaaattttatctcactaatgataatagtcttaataaataaaaaatggtcttcacttttcggaatatttattataaaaggagcttgctataaaaaagagaaaaattaaaacacaataaaacatgtacaaacatatcaaaaaaggccagtcgacaaacctgttaactagccttttttatcttaatttctaaataaacgatacagccatttttgcggacgtccacgatagatcacgtgcgtttctactgcttctatccgttgctgctcatgataattgaaaatctcatcttcagtaagatcatagtccatcatcaattgctgggctttggctaatgcgctcattgattcctcatcatttacatccgccgcaagcgccagtaatttttgaatcttttcttttctcttgtctgccattttctactcctaaaggtaagtgtatgttaagtctacttcttttttctgaacgctactttccagtgttgctagttctttttgtgcttttttcgttcgttttagtccttctttatacaccgttgaagtcttattatgacctaacaattccaactgttctaagtcttcctctaatttctctacccacattcgcttatggtctaataaattgtatttcatggtgatcttcctttcttcctttcttcctttacttgcactagcactctgtctataaagccagttcccatgccaggtttttatcctcatagaattttggatcgatatatcgggttaacttatcgcattcaagcgtaaagctttcttcctcgaatacaatagagatattgtccaatacagttccttcaaaggctagcgcacctaattctgtatgattgtttacccaaacgactttttcttcagtaattctaattccaaagtaatcacgtaccccatcgtagccacaaaggcaaatgacctttgcttggtcaaaaaagtaaggcattttaaagtaacgatcatctactaccgaaatttcagatcgttcaaattctacaacaccatcttcagttgcggttaactgtgttaaaatatctgctaacgatagtttagtttgttttttcttcatcttatttccaccttttccattgtctaaaagtgatatcacttttaggttttagtataaaaagtgacgtcactttcttagtgctggtacctcaaatcctgctttttcttggcaatcaataaatctaacgcaatacacataatcctggattcacttttgtcgtacttctgctttagttgctgcaattctttttgtctcttttcatctaatgtcacgggtaaccgtttatttcctattgcaattggcattggtactctctcctttcatcgaaataaccccatgaaaaatatggctgcaatcatcttgaatagtagactcacgaggactaatacaaaccgccaaaagatcaaacaaaacaccagtattaccaaaaatacagcgaggtttaactgtacagctgcactatctcgcataagtatttcgccaacaaacagtactaacaataagggaataatcttgttcaaatggatcaccttctttctcttaagttatcgggctttgcccgtttatttcgcaccacctaagcggcgggggcggttggtgcgaaataagaaccattcccttagttactaggctttttttgtccttatttcacacattctcacttttcggtataaatgattattgacctttttttctttcaaatcgttgatatggaatccgttgttagttgataaatcaccttattcattttcgttgtcttcctttttcatggtgtaatatgcgccatacttattgatattttcaaaataatctaaccattcacttgaaacagtcttggcttttttcgtttcgataaatttcgcatacgttagttctaaagcttggtattcagaaggtttaatagtgcttggtttgacacctacttccaaacatagtaaggcttggaaaaaccattttgcattttgctttttcagttcttccagtgttcgatagtacgtcgcaataagattcatttcgacacctgattcaatcatttattccacagctaccgacaatttttctttataatgtttttttggaacacgtgtttcgttgtataggaactattatctgcaatatttacttaataactgtaattgagattggagaatttttaaccatataagtagcatgcgaaccaaaatatcctttaattccatgcattgatcgcgatccaatgattaagatatctgcagatgttgctggcaaaatcgtcttagtaatttccttggccggatcaccttctccactgtacagctgaatgttttttacaccgctattttctgcatattgtttgtacttttccaaattaagtaacaattgactttgtttctggctcaagtactcagggtctaacgcttcataaacattcaactcttcaatttctaaaattgaggcaatcagtaatgcggctccagttttactcgcttgctttacagcatattgaaaggctttttgagctccttctgattcatctaccccaactaaaatatttttaaattcatcaaatccttccatagtgcatcttacctttcattaattaattgattatattttttatttcctttatacagttcaataattgtccacgctaacagtagtaatactgcgacgataatgacataggcaatagaatcagctagtacaagttggcttgatgtcaccttttcaccaaaaaaaccttcaatttggccgggcaatccaatcaaatttaaatatgtcaatccaattactgaaccccatcctagtatccgaataactatcgaatttttaaaccggcttcccatttccacctcactattggtcatcattaataatggtaccatcgaaaatggtaacgcaaaagctaagaagacttgtgaattattcattagtgtatttaacgctgtgtgctcccgaatcgttccttgcctgcttgtaataattacacagattaacactgggataactgaaatcaaacgcgtaattaaacgtcttagccaaattggcattctcatatgaatgaatccctccataattacttgtccagttaaagttccggtaatcgttgaattttgtccagaagctagtaacgcgactgcgaataatgtagaaagaagacctgattttgcaacggtgattaaaattccgttactcaatgtatccggatttgataaagcctcatacaacccaaagaatgatggatctttcactgcccctgttttaaaaacagcaactcccattatgagcaataaggagttaacaaaaaaagcgagagtcaattgaatgttagaatcccatgttgaaaatcgtacagcattggcgatttcatcttcatccgtacgatttatctttcgagtctgagacacagccgaatgtagatataaattatgaggcataacggttgcaccaataattcctaatgcaccagttaaaggcgtttgaccaccaattgaatgtgtagaggagaacgtttcaccagtcggaaccaatcctttaagtacatccccccaattaggatcagacaacgctacttgataaacaaacacaaaaagaattacaaaaatcaaacagacaactattgcttcaatttttctaaaaccaactttcgttaacaacaataataataaaacatcaaataccgtaataaagactgcgacgacaagcggaatattaaaaagtaaataaagagcaattgatgcgccaattacttccgcaatatctgttgccataatcgctaattccgttaaaatccataaaatgattcctagttttttactcgttctcgctcgaattgcttgagctaaatccatttgactaacaattcccaatttagcagccatatattgtaatagcattgcaattaaactagacattaaaatgaccgacattaataaatactggaagttttgcccacccgtaatcgaagtagaccagttgcctggatccatatatcccacagcaactaatgctcccggtccagaataggcgaacagggttttccaaaagcctttgccttcgggtacctcgactgttccgttaatttcctctaaagagggaccattcgcatgctgaattaatcgaggtttgtgctctttattggactgacttgttgtatctttcaaaatatttccaccttcctttaaaaatatcataagtatacacctcttttttattaaattaaagcaaaatattagacaagcctaaaaaaaaataaacattcgcctaatttaatattatttgccttcatttcatttgtatcggaatgaatcaattgtacacgttaaaaatatatctatatacccgtggtgctagttaattttaatatcctaaagaatattaatatcgaaaacagaccagagttgcaagagcttatttcttttatacgtgaacgagatacgattattattcctagtcttgatcgattagcaagaaatagtaaagatacaaaagacttacttcaattgtttcgtagtaaaggtgcttctattgaaatattagacctaacgtcgtttaatggggtaactgaccctgcattaagagacttgctgacaaatttagtcatagaagtatttagctacgtcgctgaaaacgaacggaaaaaaatcaaagagcgtcaaaaacaaggcattgaaattgcaaagaaaaatgggcgttatactggtaaaaagattcaataccatgccaatgcgacaggaaaaaacaaattgatttacgatgaaattgttgatggtctgaagaaaaaagaaactatttctaaaatagcaaagaacgcaggggttacaagaaaaactgtttatcgagtaaaaagagatttaggaatgtaatatgttccagttagaaagaagcgtaaataatgcaagaaatagaaatcggcaaaatttattattgtgaagttcctagtttggaaggttcttttgaagttcaagttttacaaatgctaaaagacaactgtgttttagtgagagccgtacgttgtacattaatgcaaagtaaatatttaaagaaaagcaaatatcgttttattgtcaatatcaagtccctaaaaggacgatcgttacacttttaataaagaataaaaatgaagaataaactgacagtattaatttgtgcaaccattttgtcaacgtgggcagtccctacacaaaatgcttttgcagaagaaacagggaatgatactacgcagcaaacagtgactagcaacagttctaatgaagaacaaactgcaattgtaaatggagaacaagtaaaattagaagcaccagtgaaagaaggacagtctgaagctgaagcgacccaagcaccaaaagaagagttacaacaagggcaaatgagtcggtctgctcgtagtacagtaaaaacaattcctatgtatcgtatgtataatccaaatagtggtgaacatttttatactcaagacactggagagcgggataatttaagaagaattggttggaattatgaagggattggttggcaagctccaacaagtggtgatccagtttatcgtctatacaatcgttacaacggcgaacatttctataccttaaatgccaaagaacgtgataatatcacgaaatacggttggaaatatgaaggtatcggttggtactcttatactggatcaaatggtattgcagttagtcgtttgtataataagcgtgtcaactggcaccattacacgttagaccaaaatgaaaaaaatattattacaaaacaaggttggaattatgaaggcgtaggttggtacgcagttggtaatggacaaccaaacaatgacgattataagcttcttggtgtaaagaattacaatcagtatgctttaggcgctccaagtggctgtgaaggagcttcattgctacaagcattgcagtataaaggaaaaatcacgaaatggagtttaactcagtttttaaacacgattcctaaatctccaaatggaaatccaaataatggttttgttggtagtccattcgttgaaaattcctggacttattcagctatctatcctgctccattagcaacttgggggcaaaaatatggaaatgtgcagaatatttcaggtagttctatgactacattgcttaatgaagtaaagaacggaaatcctgtggttgcatgggtaactatcaatttccaaccaattcgttggggaaattggagttttggtgtagcagctaataataatcacgcagtgacacttgatggatacaataaaggaagtaatcaagtacatgtatctgatccaattagtggttcttattggctgaatcgaacaacatttgaaaatatttacaacacacgaaaatatgcagttgtagtcagataacatttctatgttccatgtatcccacaatcaaaaaaaaatgaaacgattatgccttcaaaaccaccttttaggaaatgaatcgtcctttgaacgaaaactattttataatataggcgttactaagcagctaagcagaaaacagcagtaagaaaaggagtatagattctaaaaaacaatttgaatggagtgattgccttttatgaaatcgcatattttagagagacatttattatgaaaagctaattgattttaagtttaagtttattttagtttttcttggaaataaaaacagcgaaaatccgaacattttcacctctctcactttataacttttacaaaatagtacttctcataaaaagcgctctagttaaagaaaataagagaaaaatcaaaaaaaacaaaagtttcttttacacttgtttctatattcgttacaatggttatgggaagtttttcaaaaggttaagaaaagcttacgggggtttttgaaatcaaaaagtagtaggggacgataaaatgaaacatacacacaaaatcatattggctgtcacttctgtatgcactgttattattctaggtgtaagtatcttttttgttacacaagcagcaacaaacaataaattagaaaacactagtcaaacaactcaacactcaagcagcagctcaaaacctgttgaagataaacaaacgacgaaacagcttgatcaagcaaaacagcttgctgcaagttatcattatgatgaagccatcgccttacttgaaaaagacgacgccaaagaagcgcaacaattgttagcaactttgaaaaaagaaaaagaatccttggtaaaatgggaagacccgaccaaaatctcacacgtcttctttcatagtctgatcgttgatccagctaaggcttttcatacccagcaagcacaagggtataaagattatatggtcactatttccgaattcaataaaaccattgatcagttatataaaaataactatgttcttgttaatctaaatggattagtcaaaaaaggaacagatggaaaactgacctttacaggtgtttctcttccagaaggaaagaaaccgttaattctttcgcaagacgatgtcagctattatgaatacatggacaattcaggatttccaagtaagttgattgtcgataaacagaaccaaatcaagaatatttatatcgacaataagaaggaaactgttggtgactatgatatggttccattgatcgattcattcattaaaaaacatcccgatttttcttatcaaggcgccaaaggaacattagctttaacaggctataatggtttattaggttaccgtacatcaaaatcagaatatggtgataacgaaaaaacaaacaaagaaatcgaagcagccaaaaaagttgctgatcaattaaagaaagatggttggagttttgcttctcatacttggggacacttgaatatgacacaagcttctttagccgatatccaacaagataatgaacgttggcaaaatgaagttgcacctattttaggcaaaacaaatattttgatctacccatttggcgctgacatcagcgattggcaaccttattctgaagcaaatcaaaaatttgcttacttgaaacaacaaggatttgatatcttctgcaatgtcgatgcctcaactcctgcatggggacaactaggaactgactactaccgtaacgccagaatcaatattgacggtatccgtttcgaagctgacctaaaaggagaaaatccaatacttgatcaatttatcaacgtcaaagaagtgtatgaccaaaaagatcgaggatagaggttgtgaaagaagcgtccagctccgagcaaataagaactagatttctaaaatagtttctcatattttggaaatctagcgcttattgctgaggagttgcttcttgaacaccgtgaatagaggttgtaaaaagagcgttttgacttattgttgaaggtcagctctttgaacaccgcgtgttaggttgtgaaaaggctggtctgcatcaagcaataagaatgaacagagaaaaacagcttcttgaataccgcagataggttgtaaaaaaaccgttttgacctgacgataaccagtaaaacagaggtgagaccattgctaaaagtagcagtggtctcatctctttttttgcacaagtcatatttgattgtttcgttattttaatcaggataaagttcttttttttcatgctaaagagtgattctttcttctcgattttcactttcttcgtttaacttttggtaaatacttctgtcagaaaaagctctaggtagacacacgaaagcagataaaaagcctaacttttgcaacagtttatgctgtcgttcaaagttaggcttttacagtttataaatagattcttatacaatgagacacgtgttccaaaaaaacattataaggaaagattgtcggtagctgtggaagaaatgattgaatcgggtgtcgaaatgaatctcattgcgacctactatcgaacgcttgaagaactgaaaaagcaaaatggacaatggtttttccaagccttactatgcttggaagcaggcgtcaagccaaacactatcaaaccttctgaataccaagctttagaactaacgtatgggaaatttgtcgaaatgaaaaaagccaagactgtttcaagtgaatggttggactactttgaaaatgtcaacaagtatggcgcatgttacatcatgaaaaaggaggacaacgaaaatgaataaggtgatttatcaactaacaacggaagatgtgtcacactttttaacaaacaaagaacatttgaatgaagtaatcagacggattcaaaaagactttagttgtatggaagaaatgaagtactttattcaaagagtcgaagaacaattgtatttggaaagtgaaacgagtcaaacgaaggttacagtcagcaataattatttagacgtgtataaacgtcgccctgacacattaaaaaaaggagcggagcttctacgactagaaacagaaaaatatatcatgaatgtttacctagaaaggagtgaactggtcgaaaactttgtcagctacacgatttgcaggaaacactattactcagaatcagaatattattcaatttttgagagcatggaattaatggaagagctaaacagcaaagatgcgacggtagacgattattaccttgtatttactaaatttttgacgtgtgggacggaatctatcgtgttaatgggaatggattatgaactcgctgtacccgaagtatttttgagggaatatgtagaagaagtagataacccaggcgacgactggtacacgactttaactgattttttagatacctacacttacgacgatacagaagaaatccaaaatgaacttgaccgtaaacgaatgccatatcaacgatttgaaaggaaaaaaggtcaataaccatttataccgaaaagtgagaatgtgtgaaataagaacaaaaaaccttgaaattaagggaatggttcttatttcgcaccaatcgctccaaccgcccccgccgcttaggtggtgcgaaataagcgaacaaagcccgaaaacctaagagaaagaaggagatttatatgaacaaaattattcccttattattagtcctatttgttggagaaatacttatgcgacttagtgcagctgtacatttaaacctcgcagtatttttggtaatactaatgttttgtttgatcttttggcgatttgtgttagcccttgtgagtctaatattcaagttgattgcagctatatttttcatagggttatttcgatgaaaggagagagtaccaatgccaattgcaataggaaataaacggttacccgtgacgttggatgaaaagagacaaaaagaattgcagtaaccaaagcagaagtacggcaaaagtgaatccaggattatgtgtattgcgttagatctattgatcgcgcaagaaaaagcaggatttgatgtaccagcactaaaaaagtgacgtcactttttaacttgatccgtataagtgatatcacttttagcaaggagggaaataaatgttaaaaactaaaaagaattcgtacaaattaaagcttagtatactatctattatttgtcttgtagatatgataattagtggtcatttgtatagagtggcatatacgcagtttattgagtacaaggttcactatttaggattagctgggaatcgatacgttgaatatgtccattattcattaaaatgttcttcgtatattcttctttggcttattttttcattgtttgaattgctaaatttaatagcaatatcttcatatcacttagataagctaaacaccaaatctagccgttataacgaagtgttcaaggaaaatatgaagttagaaagtgacttaaacaagctaaaaaaaataaaaagaagaaaacataagttaactaaaattattttattaagaatgatggaatataaggataaggctagtaataagtcattgatttctttaaattctttatcaagttctttttcatcatatttttcatatttatcagcttcatgaagaacttttttaatttcatgaatagcctttcgttcaactaaccatttttttaggttatgttttttttctggattttcagataacgtatcaagttcgtctaactctttatccagtttattgacaacagaaacaattttgtttacaactttttcttctttgttttctaaatttgacatttatcttcacgtcctttttatttgataatttaagtatagaactttgatatagtttatacaaataaaaacgcttctttgtgtattctgtgcttttcttttggaatgaggaaaactttggagtaatatgaacgtggacagaaaaatatttaggaggaataaactatgtgtacgtctattacttatgtaacaagtgatcattattttggaaggaattttgattatgaaatatcttacaatgaagtagtcactattactccaagaaattataagttgaattttcgaaaggtaaatgatttggatactcattatgcaatgattggtattgccgctggtatagctgactaccctctttattacgatgcgacaaatgaaaaaggattgagtatggctggactaaatttttctgggtatgctgattataaagaaatacaagaagggaaagacaatgtatctccttttgaatttattccttggattttaggacaatgctcaacagtaggagaagctaaaaaattgttaaaaaatatcaatttagcaaatataaattatagtgacgaacttcctttatcccctttacattggctattagctgataaagaaaaatcaattgtcattgaaagtatgaaagatggacttcatatatatgataaccctgtgggcgttcttaccaataatccttcatttgactatcaattatttaatttaaacaattatcgtgtcttatcgagtgaaactcctaaaaataatttttcaaatcaaataagtttgaatgcctatagccgcggtatgggagggataggcttgcctggagatttatcctcagtatctcgttttgttaaagcgacttttacgaagctgaattctgtatctggagattcagagtcagaaagtattagtcaatttttccatatcttaggttcagtagaacaacaaaaaggtttgtgtgatgttggtgatggaaaatatgaatatacaatttattcttcttgttgcaatgttgacaaaggaatctattattatcgaacatatgaagacagtcaaattactgcaattgatatgaataaagaagacttagatagtcataagttaattagttatccaattatagaaaaacaacaaattaaatatataaattagttaatgtgttgtgattgattatttaatatagatataatacaaaaaggcaaagatattttcaaaacattttttcttgatgtgatatccttgtcttttttgtaatgtttttaacttattgcttttgcaaaatttatttacctgttttctggatcaacgatagtgtatattatgctatccttgtttggattttaggacgtttaaagaggcacttttttacataacttaatccatagaccttttaagcctgctgtgagataataataaagaagagtttaaagcgcaccccaaaccacttccccataagtgtattacgctttaaactcttttatatttgaattcactaagaagcataccatatttttgaaaaaaagtgagaaaaaaggcttataattaggatttagagtaattaattagatgtttattttataggactgatacaggcgtccaaccaagagtgactttctctttaatgtaatctacttcatgagcaggtaattgaatgacttttctcccacattttttcttattttctttatactggtgccaataatcaagagcagtcttgccttgcttgaacttattgactacattataaatagtggtgttagtatcaaatcttagacagcttttcgtagagacaagaataaattaaacttatctacgagaggatgaatttttatgacccgatatgaagaaaattttaaacaaatgattgttgaactgaatcaaactggacgttctgttcaagggttaacgaaagaatatggcttatctgaagcaacgatttacaaatggaagaatttatatttacctgatcagtccacaggactgactggaaaagaagtagctgaactgagaaaagaaaatgctcgtttaaatgaggaacttgaaatcttaaaaaaagccgcagccatattctctcggaaaacctaaattcgcttgttcaatttattgaaaaatggtgtaaggattacactgtttctttgttgtgtcggttattagaaatccctagaagtgtctattatttttataagaataaaccgttgacagctacagaaatcagaaataataagttgaaaaagaagatttcaacaattttttttacgaataaacaacgctatggtgccacaaagatccatcaagttttattaaaagaagggatttcagtatctcttaaacatgtccaaaagctaatgaaacaattaaatttaaggtcgattgtagttaaaaaatatagacctcaaaggtctaataaaccgatcattttaaaagagaatctcttaaatcaggacttttctactgaaacgatctgtgagaaatgggcagctgacattacgtacattcctactaagaaaaatggttggtgttacttatcttcaatcatggatttacacacgaaaaaaattattagttatacattttcaaaacgaatgactgtggattgtgtcattcaaacattgaataaagcaaaaatacattatcacattccagaaggaatgattctagacactgacttgggcagccaatacacagcaagagaagtggaacaatggcttaaaaccaacaaaataaggcattcttatagtagaaaaggaacaccttatgataatgctggaatcgaatctttccatgcctcattgaaaaaagaagaagtctacacgactagctactcagattttgaagaagcaaatcgagcgctatttagctacattgaaggattttataaccgaaatcgaatccatagctcgattcactatctaaccccacaggaatttgaagaattagcaaaagaaaaaatggcttaaccgtctctactaaaatgtgtccaagatattgactcaaatccactttcgtacttaattttgcgtatttgaaaattcttcttttagagtacttttattacgatactagtatgatatatatctatagcaaacagttaaaatcttcctaaaataagcgaatagcattcctaaaacctataaaatttttagatgaagcgacaagtggacaattaataaactacttgaacatgaaattatggatcacctttcaaatttagaaaatggaattcttatacttattgcgcaacatttattgattgcaaaattatgtgacaaaaagaactagtagaagaaggaataatggcttgataataaagtactacctattaaaggtagtactttatttaatttagtataaattaacatactactatattttaggtttcataattgatttatacgactcatttttgagtcgtcagactgcaaacaacactctaaatttaggagtttgtctacagtctgaataaattttaaatttattgtccataatgttattatgaatttatagcattaagaaaagagataagactttacatttttttaggaatgtaaagtcttatctcttttcttaattgtacaattagtattatctgcactactttctaattaaataaatttttagttattaacttgattaaaatcagagataatatcatttaattcagtttgaagggttgtaacgattaaatggaaattttcttcatctgttttattatatggggatgttttcgttatatataacaacttttctttttcaattttcattaataactctgtcgaagtctgtactttatcttgataattaaatgcagacatcccactttgtataattgtaattattgctgaagcaattgaaacaatcaatagtaaagacctgtgttcggaagcctgatcaattaatattgggatactagctgataagactatttttataatatttccgataccaattactctattataaaatcggatttctttttttaatctatcgattgtagaatcaatagattcgataaacgctttttgatccatcattttctctccaatcattttattaaaatcattaacaaaaatattataataggatttaagtaagttctaactaatcacatataaaaataaaaaaacatttgtattttatcaaagttttattatacttgtcaatttgtgtacatcctaaaatataagctatttgtttacttctgtagaatatatactttgttgttagataagttgcacatgtttatagaatctaaataataaatttttatgtaccgcccctcaaagaggggggattttttatcgttgtggaatatttaaataccaacgcttgtcatgaaaatcttgtgctccacccttagtatttccttctggatcgtttgtcgcacgcatcatgacgtatactttcttattagggaaatcacgcatattgaaagatacatgatagccaacatttcctaaagtattataagcttgatttacgtctggtctataaatcccatcagctcttactctagctagttcttttccagtattgtagtccataatgaaaatatactcgtatttataattagcaatgtgccatccagctacatgcaagtttgcgttttcgatttctccgaactgatcaatgtgggcgtaatttgttccatctgtcagcgtagaatttgcagcacctgctcgagttggatcaattactggtttatcctccgaagtagttggattatcatccgtaaaaccatgagccaaatcataggctagtttttctttacttacacccatttcagaaagataaccgtaaggatctgtatgatcgccccaaatattttgtgttacccataaatgcgatttgattcctggttggttataaggagtgtctaatgttaatggaataccatatttcattgctgaatctcttgccaattcaacgtatactttatagttcttttcaaaagtttctttatcatgtgtgtgttgtaactcgatttgcacaggacttttggctcacgaggttgtcctactctacatcttgctgatagatatgctgaaaggaaaacaccaacattatgttttgctttttcagctagaatgagacaagcaggaatacctttagaagatatcaaagattttttaggtcataaagatgtttccactacacaagtctttgagagtaaacctctcaaaactgaacaaagtaaaaacaaattgtgtagtctccgtaatattccttagaaaggaggtgatccagccgcaccttccgatacggctaccttgttacgacttcaccccaatcatctatcccaccttaggcggctggctccaaaaggttacctcaccgacttcgggtgttacaaactctcgtggtgtgacgggcggtgtgtacaaggcccgggaacgtattcaccgcggcgtgctgatccgcgattactagcgattccggcttcatgcaggcgagttgcagcctgcaatccgaactgagagaagctttaagagattagcttagcctcgcgacttcgcaactcgttgtacttcccattgtagcacgtgtgtagcccaggtcataaggggcatgatgatttgacgtcatccccaccttcctccggtttgtcaccggcagtcttgctagagtgcccaactgaatgatggcaactaacaataagggttgcgctcgttgcgggacttaacccaacatctcacgacacgagctgacgacaaccatgcaccacctgtcactttgcccccgaaggggaagctctatctctagagtggtcaaaggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctgcagcactgaagggcggaaaccctccaacacttagcactcatcgtttacggcgtggactaccagggtatctaatcctgtttgctccccacgctttcgagcctcagcgtcagttacagaccagagagccgccttcgccactggtgttcctccatatatctacgcatttcaccgctacacatggaattccactctcctcttctgcactcaagtctcccagtttccaatgaccctccccggttgagccgggggctttcacatcagacttaagaaaccgcctgcgctcgctttacgcccaataaatccggacaacgcttgccacctacgtattaccgcggctgctggcacgtagttagccgtggctttctggttagataccgtcaagggatgaacagttactctcatccttgttcttctctaacaacagagttttacgatccgaaaaccttcttcactcacgcggcgttgctcggtcagactttcgtccattgccgaagattccctactgctgcctcccgtaggagtttgggccgtgtctcagtcccaatgtggccgatcaccctctcaggtcggctatgcatcgtggccttggtgagccgttacctcaccaactagctaatgcaccgcgggtccatccatcagcgacacccgaaagcgcctttcaaatcaaaaccatgcggttttgattgttatacggtattagcacctgtttccaagtgttatccccttctgatgggcaggttacccacgtgttactcacccgttcgccactcctctttttccggtggagcaagctccggtggaaaaagaagcgttcgacttgcatgtattaggcacgccgccagcgttcgtcctgagccaggatcaaactctcataaaaagttcgaacaatcttgcgattgttaagctcaatttgtttgctagcatattgcttgcttgttaaaaatgtttgttgtcttgaattgaatcaagacgccctacacatttggtttgtcttactttgttcagttttcaaaggtctacgaattggaacggttgttccttctggcagactttgagggatgccgtttttccgaactaacttcattcgaagcttagctgttcctcgatcatgcgaccaaaaaacaacattcgtcctgtttggactagtggcttctgcttgaattacaatgattgattcattaattttaaacatctatatcctcctttcttaaataattggtattgggtcattcgttacccatgtacctgaaatataagatgatccatttcctgagtatgcgactacgcgactagcttgtgttaagcctgcccttgcgccagcaggttgggtttcattgcgatataaagccagcggatggtaagcaggataactttgatcacgttgaaatccagcgggaaccaaaataacatttcttgtgttagaagcatcagaaggataattattgcattcatacttgattgctattgtgactgtgtctccttcacgtttaatagtaccgttaacgtttgtaatattgtcacgatcgctaatatcatcgttagtgatttggcgaatgattttacctgtaacgacattcccttgatttcttacttcagcaattctattcgcttttaccttagaaccaacaactttgattctagcagttccgttatccgcaattatcccatagtcatttccagttccttgatcacttggatcaatgttaatgtcagctaaatttctagcttctgcaatacagttttgatttaggtagtaattattgtttgtagcaatttttgaacctcctgtggcaaataaacaacgatttgatttcccataagtagtttcagcaaaacgacaattccagacagctaaataactagactgttcagaataaattgcacactttaattgccctgaaatattcgcctgatctacaaactcgattccattaacttgttggtaacctaaagagctaataaatgaaatggagcgaactttaacacttaagtcagacgttacatctgttacactttgacgactgcgcaaagtaatgctaactgctttgagattgcgaatcacgacatcttcaaggtatactccatcgccaatccaaatagttactcgtgaactagttaataacggtatttgatttacagcagcttgaattgtaagaaatggatttttttctgtaccatccccactttgatcacttcctgttttagcaacatataaatcgagcgtttcgccgtatgctcccataagagttccaacagaaacatttagttgatttagctgaccttgttgattatcttgtcttgtctttaattctgtataattcaaattgaaaaggttatccaatgctaataatctcgaataaagcgttggatagatcgtaccttcagcatttattcgagcatccactacttcgttaggagaatcaccgcctgaatgaagcacgagattatcggcgaaggcattccttacatacgtattataacataatatatatatcaaggcactatatgttgtgtttaatttatttttacaacctatatgttgtatttggtatcaagtgcatttgttgagtttagaattactaaattttaataactctaccaacagtagagtaaaaagagcgtatatcatacttatatcttatgtttataagtcagtaagatagtccttataaaagctacagattcaaataaactaaaatacattttaagtctgtttcgtggatagttgtccactttgagagtcgaaaccgccttaaaatacgttttatatttttattttaaatagcgatagagtgtagctttactgataccagtcatttctgtaatttcttttatgctgtatgtttgactgtcatatagtttcaacgctctttcgatatcgcgttgattaacgcgtgggcgacctccttttctgcctctagcacgcgcgctttttaaaccttcttttgtacgttccacaatcaaatcacgttcaaactgactaaaggcttggaaaacggtcatcattaagcgtccgtgaggagtgctagtatcgaaattttctttcaaactcacaagcttaacttcatgatcttcgaagtaggtaacgagatcgatcaaatctttggtactacgacctaaacgagagaaactttccacgataaccgtgtctccaggacgcaccttatcttttaatcgattcagctgaggacgatcggctttggttccagtcattttttcagtgaggatttcattgcaattttgttcattgagtaggtcagtttgtcggtccaactcttgcgatcgtgtactcactctagcatagccatatatatatccactcataaaaaacatcctttcttttcaatattattgtatcataaacggtagttaaagaatcgcagataaaaagaaaagttttgataccaaaatagactacattttaggtaaaaaagtagtctttcaaaatcgtctcataatcgattgtttttgatacaataaaaataaatagaaaaatcgaacctcttctgattgtatgacccagaagaggtttgattttcttagttatttattttttaatcggattgattagttttcgctttagtatggaatggtacagtcttttcttggtgagtaatgactaattttgaataggtttcattatttaacttatttactatttgtgacaaatcggttattttttttagatttgaacgtttaaacacattcaaaatatagtaagaggtcatgcgatttattctttcgcatgacctctttttgagtttaagtttagtctttattccttaactatcgtttgccagtatttcttgtatcagaatctataaatctactatttgaatcaatctattaggttttaaactgtcccaccttcacacaaattttttttgatttatttgaatctggttccgttgtttaaaatttttcctatattcttttagataatatgttattttctttctcatcgctccaggtgtaccttctctttataaaaaaagatatcaacagagaaactccgtcgatatcttttttccttctcaaaaaaacaaattatgcggctaagaagactcgaacttccacgaggtcaccctcactagcgcctgaagctagcgcgtctgccaattccgccatagccgcatcacatcttttagtttaggattacatgtgttttttgtcaagaacatatttttgttctttttcatttctgtacgccctcccttatgccatctacacaaataattcatccgagcaactccatcatctattgagggttggtgaaaaaatctgttttatccatatgatcgatttcaatgttaaacgaacgactctgggattagtaactattttatttttttcttcatttcttttttcctctttttctcgattcagctatcttctttcatttagatattgattatttcttctgttggttactatccttctggaattctagacgctgaagtaattcacgttttctttcttctagaggtcataagtaacgaatgaacgaacttcaaataatttttttattgtaattcatatttgtattgttcgatgattcttaatacgatatgacacaataaataaaaataggcatggctatttacaacaatagtgctatagtagaaaacaaatgaataaggttacttaaagaggtgaatacgatgaaactgatcaaactatgggaagcagatttaaagaaagcttatcagctacaaactagctttggaccaaatgagaatggatttatcaacaatgcttatggctatacatttgctgaatttttagattattattaaaaaattttatgaatcagtaggatttgtttaagtaaaggaaatgggtggtatttcttatgtcatagatactagaagaaaaaaggtgctttttggtaatgacaaataacatataataacgtacaaaagaaaaaattctagcttagttctttagaaaaacaagaggatagacttagtatcactcaatctatcctccaatgctcagctattttatttttttactcacctctttatcaaatacaattttttgcaaattcgaactaatataaaaaaagaacacatgatttttttttaaagcaaatgctatgcgataattttttttattaattttgactttcatctcgtatattccttttgccgaacgagtacgcactggctttatacgaaaaaaattatgctccaaatactctgtcactttgtgggaaattgcttctttatacatgaaatgttcttcttgtggaaattgcttaagtagttcactgtcaaattcaacagtataatccatgttttatttcctttctatactgatacattataaaaataaacaattttataagtctctatatttcatgatgaatgacaagtatatttgattcatcttgatatagctctacgagatctccaattccaggatacatattgaaataatcatatggtatacaaacatttatttttttttcaattgtcaacactgcgtcttcttcttctaattctataatcttagcaatttgtacgtcgcttttcatgtgtgatcttcctttctatacattggatttacttttcgatgatatctacaacagctttgccacaagtcagttctttttctagctcgttctttatttttatggcacatggtttggaaaaaggagcagcttctttccatgaaccaagtaaaggatattcgttactgatacctttcacatattgtttgtttttgacgccttttgtttttacttctacataatacatttgatcctcttctttcttgctgtttttagttaatattcaaatatatgtaagtgaaaatgattatgtatctatatctttatgataaataaaaagaatcaatttgaaagtttttttcactcgatataactcttaattgtcaaattaagttagacagatcatcaatacttacgtaactcaaaaatacttccaaaggtgttcgataatccagtgattttctaggaatattatttcgtttagatgcgacagattgaataaaaaattcatctactgaattgaaatccatagatttcaataaaccatctctacgtaacaatccgttagaattctcgtttaggcctctttgagacggcgttcctggatcagcgaaataaatggcaatatcattgacattactgatctgtttccaatttgaaaattcctttccacaatcaaaagtgatggatttgaataggtttttcggtacagattcaaaccattgatttaattttttttcaatatcaatcgcttgtctaccacacggtttcaatgtgatgataacttttgataatcgttcaactaaggtaattacagcacttttatgtttcagacctacgatagtgtcaccttcaaggtgaccaaactcatttgagaattggctataatccttttcacgttcatgaatagagcggcggaaagtttgttttccacgtctttcttgatgtccattcggtttacgcttgcctttcatcggtaagtcagaagaatcaaatagcccctttttgaacatacgataaatggtacgagcagaacaactaataggaaacgctgcacgaccaacaatcacatcgggtgtccatccttgaacaacctttctttgaatatattctgattgttcctcgggtaaaacaagcggacgtctaccacagtttgatttgtttttcttatactgttgataatattctaaggctgattttccttgcttgaagaacagatatactttatggatcgtttgtcttgaacgattcaagcaatgggcagttttagcaacagattgattcattttgaaataagactctattattacaagttcatccgttgtaagatgggtataggtcatttgtactcactccttataattctttggtcggaactattttgagtgtagcacaaatgacttttttagttgtctagcttaattttacaatcggcgagcatattactggcttacagtgttctattaagtcgagcacaacgacgttttgaaggaacttcgagatattctttaggatattaaaattaactagcaccacgggtaaatattatagattattacttttgacagctgaagcaggatggatggattttccagaagttgtaaaagaagttcaagagataggtgcaactatttctgatagccgctcctctcctatgaactatcaggatgcccatggaattaaaataattgatcaagagagaaatgtcagaaaatacacaacaataaatgagtgtgtaattaatgaaaatctttgtagggcaccgataacgaaacacattaagaatagaagcaaagcaaaagacggaagaacttttactaccttctaagtttttttcatatttgtttgctatacttagatctaaggaattagactttcgctgcccattatttaagtttgaggtagcgtcttgcgagggatcaataatggaagaagaaaaaatatttgaaaaacgctgggaattggcttcagttgaacaaagagcaaggtaccataatctaatgtcctcttaccgcaatattgattggacttacaaagaaaagaagtacttgctttggttatgtcagttagatgtaaatacctttgaaacatttgaagtgattctagataagattaaaaacagcaatgaaaaaagagctgatctatagtggttcgctctttttattttattaactctttggttactatatgtaaaatacagcttcatattacaataaatttcaggatacaaatttatttaagcatatataaatataattgaaatgggacataaatatatgagtatgagaaaggtgattacatgtttaataaatgggcaaaccacccaatgaactcgagaggtagagataatttgaaggagacggacaagttctgggaagaagtatatagtaaaaacaaaaatcttaggtttcctgaaggaaaacttttatatagagttcatacaggtggatataaaaaacctgtagtgtattaggattaagtgttggtatgttccatataccccaatacttatataaataagattgaggagaaaattttatgaaaaaatttgctttagggatagctttgttaactatcgggtcagttgttttaccgtcaactactatagtttatgcttcagaaaattcccaagtggtatcattaaacgaaagcaacggcactgagaatgtagttattgagtatactgaagatggtatggtcgtaactaaatatgaggatggttatagtgcagaagattttgcaaattcttcagatatcatgacaagagctgcagttgcaagatggggcaaaaaggaatatacaaatattgctgtaaccactggagtagctgctaatgctattaatgctgccttttgggcaggaggaaaagctagcactgctatgtttggtatcccaggttgggcaattggtgctttgttaaccggtgcaagttggactcaaaaaggtgcttctccagggaatgcagttgcaaaagaatgggacaaaaatggtaatggctggattggattttattaccaaagaggatatgatgcagctggaagagttgtagctactagatattcaacgttataagttaaggagtgatgtttttgatatctaaaacattaaaaacattaaaaaaatttactaaaaagaatccgcaaatagctactattcgtatttttatatttgctatagctgttgctataattgttaatatgctaagcggggggaaattatacaaatctggtttatttttagtgttagtcttagttgtcttagacataataaagtctaaaaaaaaataaatggactatagattaaaaggctagatacgattcaagaaaaaatgtggtaattaattcaccttgtatgctttaagatcatttgttaatattaaggaacggaactctcaaaaaattccgtactctaatttgcaggctctcactcttttagagtgagagtttttattagattttcaaattatttaataaagtgggagcgtcaataattttgtgtaaatgattcttccctactgcagattgtttctaattctcaatcagttggcttagcatttgttcaagttcgccttcggcctgttgaaagcctttatgactgcgacctaggaatttttggttgtaagtatcaaaagacgagactaagaaacgttccatcgactcttcgttttggaactgttccttgcggtggctgtatttcttgatttgcttattaaaggattcaatcaagttcgtagaataaatactcttgcgtatggccaaggggaaatcatagaaagtgagcaagtgatcgttcgaaagaatcgattcaaccacttttggatagctggttttccatttttccgcaaaagcaccacgtgcttccaacgccacctctttagatgaggcttgatacaccattttaaaatcatcacagacttccttacgatcatcgacacgcactttgtgactgatattacgggaaacgtgtacacaacaatgttgaaaacgagctttgggatagaaccgactaatcgctcctaccatcccctttaagccatccgtgatgaacaggaggacatttttcaaaccgcgctcttgaaggtccaataaaatttcctcccaaatcgtgatggattcagtcggtgcaatcgcatagctcaatacttcctttgatccgtccgggcgaatgccaactgcgatatgaatagcttccttggcgacggttttccgctttaacggaatatacgttgcgtccatataaatagcagcataacggtcatgaagctcccgccctttaaacgccgttacctcttctgtaaatgattttgttatattggacatggtttggggcgtgtagtgatgcccatacattttctcaatcaagtctgcgatttccgacatggtaataccttttcggaagaggtgaatgacggtctcctctaacgtgtcattcgtccgtctataagcaggaacagtctgttgcttgaactcgggatcgtcaaaataccgatcgtatgtttctcaaaataggttctatcctttttcgcaggttcttttttcttagtaaagggatctgcacctggatttccaccttcttttgctaattgctggtttttctttgtcatgttttcttggattttagccatgacttcttcattttctttgaccgcttgttgctgataatgagagatgatctgctgatccagataattattcagcgcgtcgctaacaaatggataagctagtatccctattcctgagagaagcaagaaaagcatcagcagatctagaagtttccttttctttggtttcatttgtgttctccttgtgatgactgtttgataataaaagaaaaaggagcatttgcgtaatccgctgctcctttttccaattcttgcaaaaagactaaatctgactgtgcttgcgtctagcaaagtacagtccagcaatcaatagaaggactactcctgcaccgatatacacatagattcccttaccacctgttgaaggaagtgtacctttgtgtttatttggtattttttcaggagaaatcaactgtcctgctgttgcgtaagattgttcatcgacagtaaatgctacgcggtttgccaatggaacataattttctggtgctttcgtttcttccagatagtacgtgccgtatttgagacctgtcacatcaactaaaccattgtttgtggttgtaaaaaccgttgctgattctttcgccgatacccagctgacggcttttgtggatgggtcgatcgataaatatttcgctgtgtcactatcttgatcacgaacgacgaattctgctccagcaagtgtttgatctgatgtaacgtcaccatctactttaacaaatcgtttgcccccagtaacgacatcgactgacggtggtgtttgatcatttgtatgcccgttatcgacatttgcttggttagaaaatcctttggttggatctgctttttcgttcaaatgcataaacgagcttgtaatgatagaagcatattttcatcaagaaactccggttgctatcgttgcgaagcagcttaaacgtggacgccaaacaatttacaatgtctataactttctcaaatgtggtggaacagcacttgaatactttgaacaatacaaagaaaataagcgacgttgtgggagaaccgaaatcatttttcctgctgaggaaaaagaatacattgcaaaaagatcaactgaaggttggaccccagacgtcattattggccgtgcagagcgaaccttctcttgttcagtaagtaccctctatcgccggtttaagacgggagaattcaatgttttacatttaccgatgcaaggaaaacgaaaaccaaatggttataaggaaaaatgtggaaaacaggcattcaaaagaaatatttctgaacgtaaaaaagattatgtcgttttcgaagaagaatttggacatttagagggtgatacgattgtcggcatccaccataaaagtgccgtcatcacactcgttgagcgactttcaaaagccattatcgccttgaaaccagaaggccgtaaggcagttgatattgaaaattcgattaatgaatggcttcaatccgtacccaaaaatcttttcaaatcaattacctttgattgtggaaaagaattctctaattggaaaagtattagtaatacgaatgatattgatatttatttcgcagacccaggaacgccttcccaacggggattaaatgaactttcaaacggactcctccgaaaagatggactaccaaaagaaatggacttcaaccaagtcaatcaaggattcatctcatccgttgcgtccaaaagaaaccatatccctagaaaatcactaaattaccaaacaccattagaagtttttttgagttacgtaaatggaaagttttgtctcgcttaatttgacaaataatactttttatgtatcttttgagtatactctaatgatacaaatccatatttgcttaaagcgttgatttttcagtgtcatttttctagataaatggcataaattttcagcgctaagtgacaaaagcaactaatttttcatgatagatttttaaatatctcaatctgtctccaaaattagttgtttttgtagctatagttgcctatgaatatgacaaataattagaaaaaactgtgccaattaaatataaaaatgacagatctagtgcaaactttatattctcttcgaaacagctattaggttgcagccgctttttgatttttccctgatatgctccaggaactagaatttcaatttctttcaaacgttccttctctttttttacaagcgataccgggttttataagggattttaagtatctctgcttctaattttttatccatacttgcttcagtcgcagttataaaaacttcatcttgtaaaccatattttttatctgatatacccttccccttctgcacacgatataagatataaataattataactgtcatttttctttttaaatggcgaaatttccaatgagataaatggcaatcaaaaaaagatgggctctgcttagaccccatctttttattatagagttactaactctgataatttggcggcaatttcttccatagattcttcagtagtattaagaccgcttctggatcctagcaatggactcacttctcgtagttcctcataagttgtgccatgtactattggtacgagtaagtccctggctaatagtgcagatagttccttatctgctactccttctcctgtaatacgcttaagaaatgaaggtgtgactaagacaattccgacacgtgactttaccaatcctttatcaatttcacgtagtaaagatgatcgaaaagactggatcagcttggcgtggtggataagggcattatccaataccatcacgatttttccggtggggtattcccgcaacgtccgctccagaaaacggaggaaggccgctgcgtcgtatgccccttcttctgtacaaatgatccgaccggtttcataatccaaggtgcctatcaattttacccctttgtgttgtccataagtggggatttttcgctggtggccgcggagaaaccaggtgcagccaatggcttggtaatcccggatcatggtttcgtcctcgaataggaggtggtcaatatcgctattcagcaattttttttttaggctcgggaaggtttcttccaaaaatacctgttgtttcttggaatccgcttttttgagggtatacgtcggacgggtccagcttagtcctagccggtgaaggaggtccgccacgcctttttgcgtatatccataactccattcccggagaatcaggtcacacacaatcgccaatgtccaattggcacgggatttgaaacctacttcctccggagtgtggtaggcgacgatttggaccagttccgcttcctgttcatctgtcagccgtgaaggtcgtccgctttgttttttggagactaaaccttggattccattatggcagtagtttttcacatagtggctgacagtatgctcgtcgcggccgatggtgtgcccggcttctttccgggtgtggccttcaagaaccaacttgactgccaggaaacgctcgtacaaccggcggttgtctgtcgtattcatcgctttttccaattcacggatttggcgttctgtttccatgttccccactcctcaagtgttttctttagtatacgcctataggaggaaaaacgaatacaatttaactcaatttatatattacaaaaaacgtggatttgtcataaattgtcatgcttcttttacctatgaaatattttcacgtgttaaagtattcctcgttgaacacaacaaataaaactttttaacgaataaaggagatttttcatgacatcacttaaaactttactttttggaacaactttggctgccggcgctgcattcttcatgggaacgactgctcatgcggacgaagcttataccgttcaatcaggtgatactctatcaacgatttctcaaaaatacgttggtgataactccttgatcaatgccattgcagaatcaaattcaatttctgatattaacctgatttactcaggacaacaattaacaatcccaacagaaggctctgcacaagcagctgctgaacctcaagcagccgttcaagaagcaccagtccaagctgaacaacctgttgtacaagaaacggttcaaacggaaacacaagcagcgcctgttgctgaaacacaacctgctcctgctgtaacagaaactgctgctactccagcaagtacaagctctgcaaaagaatggatcgcacaaaaagaatcaagcggttcttacacagcaacgaacggacgttacatcgggcgttaccaactagattcttcttacttaaatggtgactactctgctgcaaaccaagaaagagtagcagaacaatatgttgcttcacgttatggttcttgggaagcggcgaaagcattctgggaagcaaacggttggtactaagattcattttattataatctcatcctataaaaaatcaatactaaaaaactattctttcgagtagctctgaacagatgtcatcataacttatgaaggaaatagacataagattgtgtataaaaaaataaccacccgaaggtggctgaagaaagcttttatttacataaatactcttctaaataattttaacacagaactaacttaattactatatgtaccctgtaggactcaacctacgaccggacggttatgagccgtctgctctaaccaattgagctaaaggtacgagaagccatcacaactactgcaaacaaaaagaatggacatagactagataataatgggtttcattcttcatgttgtgatggcatatttattattacacatttaatagcaaaaaactagattgtacttattctttgtagaatatattattttatgctattatttctaagtcataaaaagaaaaagcttcagatacttatctttttggggaaagactctagggtgagggagtatctgaagcttttttctatgtttattatctcacatagttattttttagtctattatttgcttaattttttatattacgccgtttgtataattaagcgagacaaataaaaaagccatttatgttacactcaaattgtaatacccgctaaagcatacaaggagagtgaacataaatgacttatacccatcttacaccttttaaaggaaagcaatttcagcaggatgtgattattgtagccgtgggctactatcttcgttataaccttagctatcgtgaagttcaagaaatcttatatgatcgtggcattaacgtttctcatacgacgatttatcgttgggtgcaagaatatggcaaactactctatcaaatttggaaaaagaaaaataaaaaatccttttattcatggaaaatggatgaaacgtacatcaaaattaaaggaaaatggcattatttgtatcgagccatcgatgcagatggtttaaccttggatatttggttacgtaaaaaacgggacacacaagcagcctatgcttttcttaagcggttagtgaagcagtttgatgaaccgaaggttgtagtcacagataaagccccctctattacaagtgcctttaagaaactaaaagaatacggcttttatcaagggacagaacatcgtaccattaaatacctgaataatttgattgaacaagaccatcgtccagtaaagagacgcaataaattctatcgaagtttacgcactgcctctaccacgattaaaggcatggaagccattcgaggattatataagaaaacccgaaaagaaggcactctcttcgggttttcggtctgtactgaaatcaaggtattattgggaatcccagcttaaatcatagatttttcatggattttatggctaatatatcctttgtcccctaggatattgggaagattcgcttcttccgataaagtctctaacactttcacgtcatggacacctggattcgtgattgagtaagtaatcggaaagccagtcttagtaacgatcatatgaattttaagaccataaaaataagatttttttgttgagttatagccaactttggctatttgattcaatagttttgcttgtctatttctaactggtttacataatggactaggaaaactatctataattccgactagttcacctttggtgagcttcttgatgaaaaagtatcgaataatcttgatagtgtaagctaagtttgaacttaagcgagtgaatcgactcctactaggaaagtcaccattaggaaataagacggaacaaaccgctctatacgtggctctttggctagtatagccattaattatgccccatataacacaagcaataatcactgtatcgcgttgcttcagttgatcagtatttcttcggtttttaatcttatctggtacacaattgtggtatatgttagaaacagttctcataatttccttgaatgttataaaagtatctgtataatgttcagtatattttgatgaacgcatatgtagtcctcatttcttgacgcgcccaagaggagtcgaacccctaaccttttgatccgtagtcaaacactctatccagttgagctatgggcgcatatttgaaatgccgaggaccggaatcgaaccggtacggtgatcactcaccgcaggattttaagtcctgtgcgtctgccagttccgccaccccggcgcgattgctttggcaaagcggaaaacggggttcgaacccgcgacccccaccttggcaaggtggtgctctaccactgagctatttccgcgtgtttaaagatgccggctaaaggacttgaaccctcgaccctctgattacaaatcagatgctctaccaactgagctaagccggcatgtaaaacttaaattatgcgggtgaagggacttgaacccccacgccgtaaggcgctagatcctaaatctagtgcgtctgccaattccgccacacccgcaaaaatatgagccgtacagggctcgaacctgtgaccctctgattaaaagtcagatgctctaccaactgagctaacggctcatatggaggttaacgggatcgaaccgctgaccctctgcttgtaaggcagatgctctcccagctgagctaaacctccatggataacttaatctttgacacgtactttatgagcaatattacgggaaacgtgaacacagcaatgttggtatttagctttaggataaatctggtgaatcgtatctttcatgccttttaagccatcggtaataaacagtaagacatcatgaacccctctggagtaaatgtcctgtaacaactcattccaaacgtaggtcgattcagtcggagcaatcgcataacttagtacttctttagtgccgtcttctcgtataccaatggcaatatagattgcttctttggagacggtttgccgttttaatggaatataagtagcatccatgaaaatagcgacatacttatcatttagagttctaactttaaatgcatttacttcttcagtcagcactttagtcatgttggacatggtttggggcgtgtagtgatgcccatacattttctcaatcaagtctgcgatttccgacatggtaataccttttcggaagaagtgaatgacggtctcctctaaggtatcattcgtccgtctataagcaggaacagtctgttgcttgaactcgccgttgcggtcgcgcggaatctggagatgaagttccccgtactcggtcttgacctttttcttgagccgtaggcctttcggctgcggataaattcttcagcgactacttcttcaagttctgattcgtctttctttggttttgattgataataataggactgacgtgatagacctaatattctgcacatcgctgatatagggtaaagatgcttattcgcatcgattacttgtctcttcgtccgaatatcagcgctgcttgctttaaaatatcattttccatttctaattgctggtttcttttacgtagttctaacaattctttttgttcaggcgtaagattatctttttctttgaatgaaccactcgttttagattgctttacccatttgtcaaatgctgaagccgttagttcatattctcgaatgatttctacacgtggctttccagctaagtaaagattgacgatttgttgcttgaattcttgtgaaaaagttcttcgtgttctcttagacataaaaattcctcctggtatatttttcatactgatcgtggaaaagagtttgataaccaagctattgatgaattattaacaacttttgacatcaatcgatcattgagtcataaaggctgtccttttgataatgccgtagctgaatcaacttataagtcgttgaaagtagaatttgtctatcaatacacatttgaaaccttacaacaattggatttggagttatttgactatgtcaattggtggaaccaccttcggttgcacggtacacttggctacgagacaccggttggttaccgtaaccagagattggcgcagcgaatccttgataatgagctcggatgtgctaacgctagcgaggcagtctaactttaactgttagctcctgccgaagatcgtcacatccgaggaggctcattgtcaaggacaatcggaatagcatacggaaagaagttctgcaccttataaaatttgtcaaaaaaactgttgccattccacgtcgtttaataggtcgatggtcttgttctattaaattgttaagatacttcacagttcggtgctctgtcttagtatataaacccacactctgtaactttctaaaggcggagccaagagaaggtgctttatcggtcacaattgctttcggctcaccaaactgtttatggagtcgttttaagaaagcataggctgcttgcgtatcccgtttctttcgtaaccagatatctaaggttaagccgtccgcatcaattgcacgataaagataatgccaacgtcccttaattttgatataggtttcgtccattttccatgaatagaaggattgtctatttttcttcttccaaagataatagaggactttgctgtactcttgcacccaacgataaatcgtagtatgacaaacatttattcccatgcgggtgtagtttagtggtaaaaccacagccttccaagctgttgtcgcgagttcgattctcgtcacccgcttttagttttttatgggcctatagctcagctggttagagcgcacgcctgataagcgtgaggtcgatggttcgagtccatttaggcccattagtacaaaatcttattggttttggggaagtactcaagtggctgaagaggcgcccctgctaagggtgtaggtcgggaaaccggcgcgagggttcaaatccctccttctccgtttcaatattttgttttacctggcccgttggtcaagcggttaagacaccgccctttcacggcggtaacacgggttcgaatcccgtacgggtcattaatttaatatagttttacatgaaacttacaacgccacaatggaccttgtaggactcgaacctacgaccggacggttatgagccgtctgctctaaccaactgagctaaaggtccaggctcttaaaaatcgcggcggaggggatcgaacccccgacctcccgggtatgaaccggacgctctagccagctgagctacaccgcgaaaaagatattcattatttaaatgaaatggagcctagcgggatcgaaccgctgacctcctgcgtgcaaagcaggcgctctcccagctgagctaaggccccgtgtttaaatttataattatcgggaagacaggattcgaacctgcgaccccttggtcccaaaccaagtgctctaccaagctgagctacttcccgtttaattagccattgcggtcgcgcggaatctggagatgaagttccccatactcggtcttgaccgtacggtcatagggaagtcctctcttctgtgaatgttttgtggtaactctattctacagaagggatttccttttttctatttacacaaaatattttacactctctaattttgtctgtgtagatatttcgttatattactaaagataataagatttaatgacctcattaatattgtttgctaggtccaaactcttattaaactttctttgctataaaacccaaacatagtaataaaagaataacttattacctttagattatactaccaacaaatggtagtatattattaatttatataatatgctctgtcagaggttgtttgatacggctaaatgctttttttactagaacggcatctttatgttctccacaagaatagccgagaatttctcgattgaacagatccaaaatgaaacagacataattccattttttcccgactcgtacataagtcaagtctgttacgatcgcttctaatgggttgtctcttaagaatttacgattcaatacgtttgtcgttttggcttcattgcaagtagaatgatgtactttaaaataagcaacagtatagctcgattttaatcctctatttttcatgattctactaatttttcgtcggctgatctgaatgcctcgttttgataaggctttttttaaccattgcggtcgcgcggaatctggagatgaagttccccatactcggtcttgaccgtacggtcataggagccgttacgagaattacccgtgttaaaaccaatgcgatcatacttttcgtaatctaggaaagccgttaactccgttttgagaagcgtattgactgctttctccaaatggacacggaataattcattcaaatcgcctttgttcgctagagtctttagaatttctgtagtaaaatcgttcatagggaagtcctctcttctgtgaatgtgttgtggtaactctattctacagaagggacttccttttttctatttacacaaaatattttacactctccggttccgacgggaatcgaacccgcgatctcctgcgtgacaggcaggcatgttaacccctacaccacggaaccaatgtttttagtttttaattgcgggagcaggatttgaacctacgaccttcgggttatgagcccgacgagctaccagactgctccatcccgcgataatatgaaaaaggaggataagggattcgaacccttgcacggttttacccgcctgacggttttcaagaccgttcccttcagccggacttgggtaatcctccatgtacggtcataggagccgttacgagaattacccgtgttaaaaccaatgcgatcgtacttttcgtaatcgaggaaagccgttaactccgttttgagaagcgtattgacagctttttccaaatggacacggaataattcattcaaatcgcctttgttcgctagagtctttagaatttctgtagtaaaatcgttcatatggaagtcctcttttctgtgaatgtgttgtggtaactctattctacattgaagaaaacgctaggcgcctggcactcatcttcctccctccctacagccctcagttgaacctaatggaaggcgtttggaagtggctcaaggaatcggtcatcaacaatgttttttttgaccacgtccagaaaatcaaacagtcggtccgcggtttcttagccgatgtaaacgagcgtccccttgaggtgattgaccgactgtgcgtgcggatgtaaagtatttaattcaacctatataggatattctttaggatattaaaattaactagcaccacgggttataataatagtcgtaatagctgatgaatcaaatttccaatctttttacgcatttaaacagcgaagcgtcttcggacgcttcttttttgtactacaatcaatatttatatttggattacctccagatagtttctttgtataaaaaaacgactcataatgagtcgtttaatagatcagggttctgttgcaaagttttccaaaaaatctattttagtgtaaaattgagaaaaaagacagagaggacagagtaatgaatcattttaaaggcaaacaattcaaaaaagacgtcattattgtcgctgttggttactacctgcgttacaatctaagctatcgtgaagttcaggaattgttatatgatcgtgcagacaagtgattgtcaactcttttttaaaagtttttttcgatttcgtttttcgaaatctttcagcaactcatttatcataacttatcgtttgttatttgtcaagaacttttttgaagtttttttcgatagaatcaagcttcgcaagcggttctttttaacgacttagttatcttatcattcaaatctactctctagccctttaacagaacgtgagttgaaattttgacaacctaatttttctaaggaagaaaaaacagtctcaactgtttttctttgttttccaagtaagctgtggtctagtttttctgatttatccatgtttttacgtggcggaacggatatagtaatgttcaaatctactctctagccctttaacagaacgtgagttgaaattttgacaacctaatttttctttgttttccaagtaagctgtggtctagtttttctgatttatccatgtttttacgtggcggaacggatatagtaatgcccttaagggcaagtgatcgtctcataaaatcaaagattttatggccgtccgcctattttgcttcaggctaaacaatttgttcagctttcaaattcaacgcggtgttctcggtttgtattacttacatttacttcaaatatccagttttcaatgaacaaactatttaaaaaatcttttttatagagaaaaatgcaggttaatactttcttaaataaatatttatggtgaacaaaaacaaaaaagcaagttttattaaacgtaacccttttcatttcatagattactgtatttacctcatattttgccgttttttgagctaataccgaaggacagctgattgtacaccgtttatcagaggttgtaaaatcagcgttttgtcctgagtattagagaaacaaacggaaaaatagttagtgtaagatgggtataagtcatttatgttcactctccttgtatgctttagcgggtattacaatttgagtgtaacataaatggcttttttatttgtctcgcttaattatacaaacggcggaaaagccgaagagcgttccatttcttcggttctttttatatattcctcgaatggtctccatgcccttaatcgtggaagaggctgtacggagactttgataaaatttattttttaaaacggggccttagctcagctgggagagcgcctgctttgcacgcaggaggtcagcggttcgatcccgctaggctccattaacaacattagttgttaaa
